United States Patent
Breton

(10) Patent No.: US 7,090,973 B1
(45) Date of Patent: Aug. 15, 2006

(54) **NUCLEIC ACID SEQUENCES RELATING TO *BACTEROIDES FRAGILIS* FOR DIAGNOSTICS AND THERAPEUTICS**

(75) Inventor: Gary L. Breton, Marlboro, MA (US)

(73) Assignee: Oscient Pharmaceuticals Corporation, Waltham, MA (US)

( * ) Notice: Subject to any disclaimer, the term of this patent is extended or adjusted under 35 U.S.C. 154(b) by 0 days.

(21) Appl. No.: 09/540,209

(22) Filed: Apr. 4, 2000

Related U.S. Application Data

(60) Provisional application No. 60/128,705, filed on Apr. 9, 1999.

(51) Int. Cl.
- *C12Q 1/68* (2006.01)
- *C12P 19/34* (2006.01)
- *C07H 21/02* (2006.01)
- *C07H 21/04* (2006.01)

(52) U.S. Cl. .................. 435/6; 435/91.2; 536/23.5; 536/24.31; 536/24.33

(58) Field of Classification Search ............... 435/91.1, 435/91.2, 6, 320.1, 325, 352.3; 536/23.1, 536/24.1, 23.7, 24.32, 24.3; 514/44

See application file for complete search history.

(56) References Cited

U.S. PATENT DOCUMENTS

| | | | | |
|---|---|---|---|---|
| 5,571,693 | A | * 11/1996 | Rasmussen et al. | 435/69.1 |
| 5,606,022 | A | * 2/1997 | Rasmussen et al. | 530/350 |
| 5,679,540 | A | * 10/1997 | Rasmussen et al. | 435/69.1 |
| 5,792,642 | A | * 8/1998 | Rasmussen et al. | 435/231 |
| 6,110,705 | A | * 8/2000 | Ratti et al. | 435/69.3 |

OTHER PUBLICATIONS

Coyne, MJ et al Infection and Immunity, 69(7):4342-4350 (2001).*

Martirosian, G et al. Clinical Microbiology and Infection, 3(1): 102-108 (1997).*

Moraes, S.R. et al. J. Med. Microbiology., 49: 279-284 (2000).*

Oh, H et al., Antimicrobial Agents and Chemotherapy, 45(7): 1977-1981 (2001).*

Van Den Eynde, H et al. Int. Journal of Systematic Bacteriology, 39(1): 78-84 (1989).*

Wojcik-Stojek, B., et al. Acta Microbiologica Polonica, 49(2): 171-175 (2000).*

Yanlei, L et al. 113(9) 858-861(2000).*

Korn et al. Accession # Z98448 NCBI database Sep. 22, 1997.*

Ziegelin et al. Accession # AJ011592 NCBI database Oct., 1, 1998.*

Oh, H., et al., "gyrA Mutations Associated with Quinolone Resistance in *Bacteroides fragilis* Group Strains," *Antimicrobial Agents and Chemotherapy*, 45(7): 1977-1981 (2001).

Van Den Eynde, H., et al., "5S Ribosomal Ribonucleic Acid Sequences in *Bacteroides* and *Fusobacterium*: Evolutionary Relationships Within These Genera and Among Eubacteria in General," *Int. Journal of Systematic Bacteriology*, 39(1): 78-84 (1989).

Wójcik-Stojek, B., et al., "*In Vitro* Antibiotic Susceptibility of *Bacteroides fragilis* Strains Isolated from Excised Appendix of Patients with Phlegmonous of Gangrenous Appendicitis," *Acta Microbiologica Polonica*,49(2): 171-175 (2000).

Yanlei, L., et al., "Anaerobic Bacteria and Intrahepatic Stones: Detections of *Clostridium* sp. and *Bacteroides fragilis*," 113(9) 858-861 (2000).

* cited by examiner

*Primary Examiner*—Jeffrey Fredman
*Assistant Examiner*—Sally Sakelaris
(74) *Attorney, Agent, or Firm*—Burns, Doane, Swecker & Mathis, L.L.P.

(57) ABSTRACT

The invention provides isolated polypeptide and nucleic acid sequences derived from *Bacteroides fragilis* that are useful in diagnosis and therapy of pathological conditions; antibodies against the polypeptides; and methods for the production of the polypeptides. The invention also provides methods for the detection, prevention and treatment of pathological conditions resulting from bacterial infection.

10 Claims, No Drawings

NUCLEIC ACID SEQUENCES RELATING TO *BACTEROIDES FRAGILIS* FOR DIAGNOSTICS AND THERAPEUTICS

RELATED APPLICATIONS

This application claims the benefit of U.S. Provisional Application Ser. No. 60/128,705, filed Apr. 9, 1999, the entire teachings of which are incorporated herein by reference.

FIELD OF THE INVENTION

The invention relates to isolated nucleic acids and polypeptides derived from *Bacteroides fragilis* that are useful as molecular targets for diagnostics, prophylaxis and treatment of pathological conditions, as well as materials and methods for the diagnosis, prevention, and amelioration of pathological conditions resulting from bacterial infection.

BACKGROUND OF THE INVENTION

The genus *Bacteroides* is a member of the family Bacteroidaceae. They are Gram-negative, obligately anaerobic, nonsporeforming rods. The genus contains at least 39 species, and are often isolated from sewage as well as the digestive tract of man, animals, and insects. *Bacteroides fragilis* was first described in 1898 by Veillon and Zuber, but was called *Bacillus fragilis*. In 1919, Castellani and Chalmers transferred it to the *Bacteroides* genus. The "*B. fragilis* group" refers to the saccharoelastic bacteroids that grow well in bile. Members of this group were previously subspecies of *B. fragilis* and include *B. fragilis, B. distasonis, B. ovatus, B. thetaiotaomicron*, and *B. vulgatus* (Castellani and Chalmers. 1984. Genus I. *Bacteroides* 1919, 959. Krieg and Holt (editors) In Bergey's Manual of Systematic Bacteriology, 1:604–631).

*Bacteroides fragilis* accounts for only 1% of the normal flora of the human colon, but is the most common anaerobe isolated from clinical specimens. It is associated with soft tissue infections, abscesses and bacteremia (Moncrief J., et al, 1998. Infect. Immun. 66:1735–1739). *B. fragilis* has also been associated with infection of the skeletal muscle (Katagiri, K., et al, 1996. J. Dermatology. 23:129–132), and meningitis (Aucher, P., et al, 1996. Eur. J. Clin. Microbiol. Infect. Dis. 15:820–823). The *B. fragilis* group is responsible for 65% of all anaerobic bacteremia cases, with mortality rates in excess of 19% (Redondo, M., et al, 1995. Clinical Infectious Disease. 20:1492–1496).

In 1984, strains of *B. fragilis* were found to cause diarrhea in newborn lambs (Myers, L., et al, 1984. Infect. Immun. 44:241–244). Subsequently, it has been shown that *B. fragilis* is associated with diarrhea in other livestock and young children. These strains are called enterotoxigenic strains, because they produced a 20 KD metalloprotease enterotoxin with intestinal secretory activity (Moncrief J., et al, 1995. Infect. Immun. 63:175–181).

There has been an increase in antibiotic resistance within the *Bacteroides fragilis* group. While there is still excellent activity of many antibiotics, even some of the most potent agents, the carbapenems and the β-lactamase-inhibitor combinations, are losing activity (Snydman, D., et al, 1996. Clinical Infectious Diseases. 23:S54–65). The cefoxitin resistance rate has increased from 0% in 1987 to 22% in 1995 (Bianchini, H., et al, 1997. Clinical Infectious Diseases. 25:S268–269). Resistance to metronidazole, co-amoxiclav, and imipenem is rare, but strains have been found that are resistant to one or all of these antibiotics. (Turner, P., et al, 1995. The Lancet. 345:1275–1277). Clindaycin resistance has been shown to be transferred between strains by either plasmid or transposon mechanisms. (Dalmau, D., et al, 1997. Clinical Infectious Diseases. 24:874–877). The increasing resistance to antibiotics commonly used against *Bacteroides* species may eventually lead to failures of these treatments.

Sequencing and analysis of this genome is crucial for the identification of essential genes for development of drug targets and to reduce the emerging health threat this organism poses.

SUMMARY OF THE INVENTION

The present invention fulfills the need for diagnostic tools and therapeutics by providing bacterial-specific compositions and methods for detecting *Bacteroides* species including *B. fragilis*, as well as compositions and methods useful for treating and preventing *Bacteroides* infection, in particular, *B. fragilis* infection, in vertebrates including mammals.

The present invention encompasses isolated nucleic acids and polypeptides derived from *B. fragilis* that are useful as reagents for diagnosis of bacterial disease, components of effective antibacterial vaccines, and/or as targets for antibacterial drugs including anti-BR fragilis drugs. They can also be used to detect the presence of *B. fragilis* and other *Bacteroides* species in a sample; and in screening compounds for the ability to interfere with the *B. fragilis* life cycle or to inhibit *B. fragilis* infection. They also have use as biocontrol agents for plants.

In one aspect, the invention features compositions of nucleic acids corresponding to entire coding sequences of *B. fragilis* proteins, including surface or secreted proteins or pasts thereof, nucleic acids capable of binding mRNA from *B. fragilis* proteins to block protein translation, and methods for producing *B. fragilis* proteins or parts thereof using peptide synthesis and recombinant DNA techniques. This invention also features antibodies and nucleic acids useful as probes to detect *B. fragilis* infection. In addition, vaccine compositions and methods for the protection or treatment of infection by *B. fragilis* are within the scope of this invention.

The nucleotide sequences provided in SEQ ID NO: 1–SEQ ID NO: 5222, a fragment thereof, or a nucleotide sequence at least about 99.5% identical to a sequence contained within SEQ ID NO: 1–SEQ ID NO: 5222 may be "provided" in a variety of medias to facilitate use thereof. As used herein, "provided" refers to a manufacture, other than an isolated nucleic acid molecule, which contains a nucleotide sequence of the present invention, i.e., the nucleotide sequence provided in SEQ ID NO: 1–SEQ ID NO: 5222, a fragment thereof, or a nucleotide sequence at least about 99.5% identical to a sequence contained within SEQ ID NO: 1–SEQ ID NO: 5222. Uses for and methods for providing nucleotide sequences in a variety of media is well known in the art (see e.g., EPO Publication No. EP 0 756 006).

In one application of this embodiment, a nucleotide sequence of the present invention can be recorded on computer readable media. As used herein, "computer readable media" refers to any media which can be read and accessed directly by a computer. Such media include, but are not limited to: magnetic storage media, such as floppy discs, hard disc storage media, and magnetic tape; optical storage media such as CD-ROM; electrical storage media such as RAM and ROM; and hybrids of these categories such as magnetic/optical storage media. A person skilled in the art can readily appreciate how any of the presently known computer readable media can be used to create a manufacture comprising computer readable media having recorded thereon a nucleotide sequence of the present invention.

As used herein, "recorded" refers to a process for storing information on computer readable media. A person skilled in the art can readily adopt any of the presently known methods for recording information on computer readable media to generate manufactures comprising the nucleotide sequence information of the present invention.

A variety of data storage structures are available to a person skilled in the art for creating a computer readable media having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable media. The sequence information can be represented in a word processing text file, formatted in commercially-available software such as WordPerfect and Microsoft Word, or represented in the form of an ASCII file, stored in a database application, such as DB2, Sybase, Oracle, or the like. A person skilled in the art can readily adapt any number of data processor structuring formats (e.g. text file or database) in order to obtain computer readable media having recorded thereon the nucleotide sequence information of the present invention.

By providing the nucleotide sequence of SEQ ID NO: 1–SEQ ID NO: 5222, a fragment thereof, or a nucleotide sequence at least about 99.5% identical to SEQ ID NO: 1–SEQ ID NO: 5222 in computer readable form, a person skilled in the art can routinely access the coding sequence information for a variety of purposes. Computer software is publicly available which allows a person skilled in the art to access sequence information provided in a computer readable media. Examples of such computer software include programs of the "Staden Package", "DNA Star", "MacVector", GCG "Wisconsin Package" (Genetics Computer Group, Madison, Wis.) and "NCBI Toolbox" (National Center For Biotechnology Information). Suitable programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology. Tools for Genomic and Molecular Research*, American Society for Microbiology, Washington, D.C. (1997).

Computer algorithms enable the identification of *B. fragilis* open reading frames (ORFs) within SEQ ID NO: 1–SEQ ID NO: 5222 which contain homology to ORFs or proteins from other organisms. Examples of such similarity-search algorithms include the BLAST [Altschul et al., J. Mol. Biol. 215:403–410 (1990)] and Smith-Waterman [Smith and Waterman (1981) Advances in Applied Mathematics, 2:482–489] search algorithms. Suitable search algorithms are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology. Tools for Genomic and Molecular Research*, American Society for Microbiology, Washington, D.C. (1997). Such algorithms are utilized on computer systems as exemplified below. The ORFs so identified represent protein encoding fragments within the *B. fragilis* genome and are useful in producing commercially important proteins such as enzymes used in fermentation reactions and in the production of commercially useful metabolites.

The present invention further provides systems, particularly computer-based systems, which contain the sequence information described herein. Such systems are designed to identify commercially important fragments of the *B. fragilis* genome. As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A person skilled in the art can readily appreciate that any one of the currently available computer-based systems is suitable for use in the present invention. The computer-based systems of the present invention comprise a data storage means having stored therein a nucleotide sequence of the present invention and the necessary hardware means and software means for supporting and implementing a search means. As used herein, "data storage means" refers to memory which can store nucleotide sequence information of the present invention, or a memory access means which can access manufactures having recorded thereon the nucleotide sequence information of the present invention.

As used herein, "search means" refers to one or more programs which are implemented on the computer-based system to compare a target sequence or target structural motif with the sequence information stored within the data storage means. Search means are used to identify fragments or regions of the *B. fragilis* genome which are similar to, or "match", a particular target sequence or target motif. A variety of known algorithms are known in the art and have been disclosed publicly, and a variety of commercially available software for conducting homology-based similarity searches are available and can be used in the computer-based systems of the present invention. Examples of such software includes, but is not limited to, FASTA (GCG Wisconsin Package), Bic_SW (Compugen Bioccelerator), BLASTN2, BLASTP2, BLASTX2 (NCBI) and Motifs (GCG). Suitable software programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997). A person skilled in the art can readily recognize that any one of the available algorithms or implementing software packages for conducting homology searches can be adapted for use in the present computer-based systems.

As used herein, a "target sequence" can be any DNA or amino acid sequence of six or more nucleotides or two or more amino acids. A person skilled in the art can readily recognize that the longer a target sequence is, the less likely a target sequence will be present as a random occurrence in the database. The most preferred sequence length of a target sequence is from about 10 to 100 amino acids or from about 30 to 300 nucleotide residues. However, it is well recognized that many genes are longer than 500 amino acids, or 1.5 kb in length, and that commercially important fragments of the *B. fragilis* genome, such as sequence fragments involved in gene expression and protein processing, will often be shorter than 30 nucleotides.

As used herein, "a target structural motif," or "target motif," refers to any rationally selected sequence or combination of sequences in which the sequence(s) are chosen based on a specific functional domain or three-dimensional configuration which is formed upon the folding of the target polypeptide. There are a variety of target motifs known in the art. Protein target motifs include, but are not limited to, enzymatic active sites, membrane-spanning regions, and signal sequences. Nucleic acid target motifs include, but are not limited to, promoter sequences, hairpin structures and inducible expression elements (protein binding sequences).

A variety of structural formats for the input and output means can be used to input and output the information in the computer-based systems of the present invention. A preferred format for an output means ranks fragments of the B. fragilis genome possessing varying degrees of homology to the target sequence or target motif. Such presentation provides a person skilled in the art with a ranking of sequences which contain various amounts of the target sequence or target motif and identifies the degree of homology contained in the identified fragment.

A variety of comparing means can be used to compare a target sequence or target motif with the data storage means to identify sequence fragments of the B. fragilis genome. In the present examples, implementing software which implement the BLASTP2 and bic_SW algorithms (Altschul et al., J. Mol. Biol. 215:403–410 (1990); Compugen Biocellerator) was used to identify open reading frames within the B. fragilis genome. A person skilled in the art can readily recognize that any one of the publicly available homology search programs can be used as the search means for the computer-based systems of the present invention. Suitable programs are described, for example, in Martin J. Bishop, ed., Guide to Human Genome Computing, 2d Edition, Academic Press, San Diego, Calif. (1998); and Leonard F. Peruski, Jr., and Anne Harwood Peruski, The Internet and the New Biology. Tools for Genomic and Molecular Research, American Society for Microbiology, Washington, D.C. (1997).

The invention features B. fragilis polypeptides, preferably a substantially pure preparation of an B. fragilis polypeptide, or a recombinant B. fragilis polypeptide. In preferred embodiments: the polypeptide has biological activity; the polypeptide has an amino acid sequence at least about 60%, 70%, 80%, 90%, 95%, 98%, or 99% identical to an amino acid sequence of the invention contained in the Sequence Listing, preferably it has about 65% sequence identity with an amino acid sequence of the invention contained in the Sequence Listing, and most preferably it has about 92% to about 99% sequence identity with an amino acid sequence of the invention contained in the Sequence Listing; the polypeptide has an amino acid sequence essentially the same as an amino acid sequence of the invention contained in the Sequence Listing; the polypeptide is at least about 5, 10, 20, 50, 100, or 150 amino acid residues in length; the polypeptide includes at least about 5, preferably at least about 10, more preferably at least about 20, still more preferably at least about 50, 100, or 150 contiguous amino acid residues of the invention contained in the Sequence Listing. In yet another preferred embodiment, the amino acid sequence which differs in sequence identity by about 7% to about 8% from the B. fragilis amino acid sequences of the invention contained in the Sequence Listing is also encompassed by the invention.

In preferred embodiments: the B. fragilis polypeptide is encoded by a nucleic acid of the invention contained in the Sequence Listing, or by a nucleic acid having at least about 60%, 70%, 80%, 90%, 95%, 98%, or 99% homology with a nucleic acid of the invention contained in the Sequence Listing.

In a preferred embodiment, the subject B. fragilis polypeptide differs in amino acid sequence at about 1, 2, 3, 5, 10 or more residues from a sequence of the invention contained in the Sequence Listing. The differences, however, are such that the B. fragilis polypeptide exhibits an B. fragilis biological activity, e.g., the B. fragilis polypeptide retains a biological activity of a naturally occurring B. fragilis enzyme.

In preferred embodiments, the polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

In yet other preferred embodiments, the B. fragilis polypeptide is a recombinant fusion protein having a first B. fragilis polypeptide portion and a second polypeptide portion, e.g., a second polypeptide portion having an amino acid sequence unrelated to B. fragilis. The second polypeptide portion can be, e.g., any of glutathione-S-transferase, a DNA binding domain, or a polymerase activating domain. In preferred embodiment the fusion protein can be used in a two-hybrid assay.

Polypeptides of the invention include those which arise as a result of alternative transcription events, alternative RNA splicing events, and alternative translational and postranslational events.

In a preferred embodiment, the encoded B. fragilis polypeptide differs (e.g., by amino acid substitution, addition or deletion of at least one amino acid residue) in amino acid sequence at about 1, 2, 3, 5, 10 or more residues, from a sequence of the invention contained in the Sequence Listing. The differences, however, are such that: the B. fragilis encoded polypeptide exhibits an B. fragilis biological activity, e.g., the encoded B. fragilis enzyme retains a biological activity of a naturally occurring B. fragilis.

In preferred embodiments, the encoded polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

The B. fragilis strain, 14062, from which genomic sequences have been sequenced, has been deposited on Jul. 20, 1998, in the American Type Culture Collection and assigned the ATCC designation # 202158.

Included in the invention are: allelic variations; natural mutants; induced mutants; proteins encoded by DNA that hybridize under high or low stringency conditions to a nucleic acid which encodes a polypeptide of the invention contained in the Sequence Listing (for definitions of high and low stringency see Current Protocols in Molecular Biology, John Wiley & Sons, New York, 1989, 6.3.1–6.3.6, hereby incorporated by reference); and, polypeptides specifically bound by antisera to B. fragilis polypeptides, especially by antisera to an active site or binding domain of B. fragilis polypeptide. The invention also includes fragments, preferably biologically active fragments. These and other polypeptides are also referred to herein as B. fragilis polypeptide analogs or variants.

The invention further provides nucleic acids, e.g., RNA or DNA and their respective complements, encoding a polypeptide of the invention. This includes double stranded nucleic acids as well as coding and antisense single strands.

In preferred embodiments, the subject B. fragilis nucleic acid will include a transcriptional regulatory sequence, e.g., at least one of a transcriptional promoter or transcriptional enhancer sequence, operably linked to the *B. fragilis* gene sequence, e.g., to render the *B. fragilis* gene sequence suitable for expression in a recombinant host cell.

In yet a further preferred embodiment, the nucleic acid which encodes an *B. fragilis* polypeptide of the invention, hybridizes under stringent conditions to a nucleic acid probe corresponding to at least about 8 consecutive nucleotides of the invention contained in the Sequence Listing; more preferably to at least about 12 consecutive nucleotides of the invention contained in the Sequence Listing; still more preferably to at least about 20 consecutive nucleotides of the invention contained in the Sequence Listing; most preferably to at least about 40 consecutive nucleotides of the invention contained in the Sequence Listing.

In another aspect, the invention provides a substantially pure nucleic acid having a nucleotide sequence which encodes an *B. fragilis* polypeptide. In preferred embodiments: the encoded polypeptide has biological activity; the encoded polypeptide has an amino acid sequence at least about 60%, 70%, 80%, 90%, 95%, 98% or 99% homologous to an amino acid sequence of the invention contained in the Sequence Listing; the encoded polypeptide has an amino acid sequence essentially the same as an amino acid sequence of the invention contained in the Sequence Listing; the encoded polypeptide is at least about 5, 10, 20, 50, 100, or 150 amino acids in length; the encoded polypeptide comprises at least about 5, preferably at least about 10, more preferably at least about 20, still more preferably at least about 50, 100, or 150 contiguous amino acids of the invention contained in the Sequence Listing.

In another aspect, the invention encompasses: a vector including a nucleic acid which encodes an *B. fragilis* polypeptide or an *B. fragilis* polypeptide variant as described herein; a host cell transfected with the vector; and a method of producing a recombinant *B. fragilis* polypeptide or *B. fragilis* polypeptide variant; including culturing the cell, e.g., in a cell culture medium, and isolating an *B. fragilis* or *B. fragilis* polypeptide variant, e.g., from the cell or from the cell culture medium.

One embodiment of the invention is directed to substantially isolated nucleic acids. Nucleic acids of the invention include sequences comprising at least about 8 nucleotides in length, more preferably at least about 12 nucleotides in length, even more preferably at least about 15–20 nucleotides in length, that correspond to a subsequence of any one of SEQ ID NO: 1–SEQ ID NO: 5222 or complements thereof. Alternatively, the nucleic acids comprise sequences contained within any ORF (open reading frame), including a complete protein-coding sequence, of which any of SEQ ID NO: 1–SEQ ID NO: 5222 forms a part. The invention encompasses sequence-conservative variants and function-conservative variants of these sequences. The nucleic acids may be DNA, RNA, DNA/RNA duplexes, protein-nucleic acid (PNA), or derivatives thereof.

In another aspect, the invention features a purified recombinant nucleic acid having at least about 50%, 60%, 70%, 80%, 90%, 95%, 98%, or 99% sequence identity or % homology with a sequence of the invention contained in the Sequence Listing The invention also encompasses recombinant DNA (including DNA cloning and expression vectors) comprising these *B. fragilis*-derived sequences; host cells comprising such DNA, including fungal, bacterial, yeast, plant, insect, and mammalian host cells; and methods for producing expression products comprising RNA and polypeptides encoded by the *B. fragilis* sequences. These methods are carried out by incubating a host cell comprising an *B. fragilis*-derived nucleic acid sequence under conditions in which the sequence is expressed. The host cell may be native or recombinant. The polypeptides can be obtained by (a) harvesting the incubated cells to produce a cell fraction and a medium fraction; and (b) recovering the *B. fragilis* polypeptide from the cell fraction, the medium fraction, or both. The polypeptides can also be made by in vitro translation.

In another aspect, the invention features nucleic acids capable of binding mRNA of *B. fragilis*. Such nucleic acid is capable of acting as antisense nucleic acid to control the translation of mRNA of *B. fragilis*. A further aspect features a nucleic acid which is capable of binding specifically to an *B. fragilis* nucleic acid. These nucleic acids are also referred to herein as complements and have utility as probes and as capture reagents.

In another aspect, the invention features an expression system comprising an open reading frame corresponding to *B. fragilis* nucleic acid. The nucleic acid further comprises a control sequence compatible with an intended host. The expression system is useful for making polypeptides corresponding to *B. fragilis* nucleic acid.

In another aspect, the invention encompasses: a vector including a nucleic acid which encodes an *B. fragilis* polypeptide or an *B. fragilis* polypeptide variant as described herein; a host cell transfected with the vector; and a method of producing a recombinant *B. fragilis* polypeptide or *B. fragilis* polypeptide variant; including culturing the cell, e.g., in a cell culture medium, and isolating the *B. fragilis* or *B. fragilis* polypeptide variant, e.g., from the cell or from the cell culture medium.

In yet another embodiment of the invention encompasses reagents for detecting bacterial infection, including *B. fragilis* infection, which comprise at least one *B. fragilis*-derived nucleic acid defined by any one of SEQ ID NO: 1–SEQ ID NO: 5222, or sequence-conservative or function-conservative variants thereof. Alternatively, the diagnostic reagents comprise nucleotide sequences that are contained within any open reading frames (ORFs), including preferably complete protein-coding sequences, contained within any of SEQ ID NO: 1–SEQ ID NO: 5222, or polypeptide sequences contained within any of SEQ ID NO: 5223–SEQ ID NO: 10444, or polypeptides of which any of the above sequences forms a part, or antibodies directed against any of the above peptide sequences or function-conservative variants and/or fragments thereof.

The invention further provides antibodies, preferably monoclonal antibodies, which specifically bind to the polypeptides of the invention. Methods are also provided for producing antibodies in a host animal. The methods of the invention comprise immunizing an animal with at least one *B. fragilis*-derived immunogenic component, wherein the immunogenic component comprises one or more of the polypeptides encoded by any one of SEQ ID NO: 1–SEQ ID NO: 5222 or sequence-conservative or function-conservative variants thereof; or polypeptides that are contained within any ORFs, including complete protein-coding sequences, of which any of SEQ ID NO: 1–SEQ ID NO: 5222 forms a part; or polypeptide sequences contained within any of SEQ ID NO: 5223–SEQ ID NO: 10444; or polypeptides of which any of SEQ ID NO: 5223–SEQ ID NO: 10444 forms a part. Host animals include any warm blooded animal, including without limitation mammals and birds. Such antibodies have utility as reagents for immunoassays to evaluate the abundance and distribution of *B. fragilis* —specific antigens.

In yet another aspect, the invention provides diagnostic methods for detecting *B. fragilis* antigenic components or anti-*B. fragilis* antibodies in a sample. *B. fragilis* antigenic components may be detected by known processes, including but not limited to detection by a process comprising: (i) contacting a sample suspected to contain a bacterial antigenic component with a bacterial-specific antibody, under conditions in which a stable antigen-antibody complex can form between the antibody and bacterial antigenic components in the sample; and (ii) detecting any antigen-antibody complex formed in step (i), wherein detection of an antigen-antibody complex indicates the presence of at least one bacterial antigenic component in the sample. In different embodiments of this method, the antibodies used are directed against a sequence encoded by any of SEQ ID NO: 1–SEQ ID NO: 5222 or sequence-conservative or function-conservative variants thereof, or against a polypeptide sequence contained in any of SEQ ID NO: 5223–SEQ ID NO: 10444 or function-conservative variants thereof.

In yet another aspect, the invention provides a method for detecting antibacterial-specific antibodies in a sample, which comprises: (i) contacting a sample suspected to contain antibacterial-specific antibodies with an *B. fragilis* antigenic component, under conditions in which a stable antigen-antibody complex can form between the *B. fragilis* antigenic component and antibacterial antibodies in the sample; and (ii) detecting any antigen-antibody complex formed in step (i), wherein detection of an antigen-antibody complex indicates the presence of antibacterial antibodies in the sample. In different embodiments of this method, the antigenic component is encoded by a sequence contained in any of SEQ ID NO: 1–SEQ ID NO: 5222 or sequence-conservative and function-conservative variants thereof, or is a polypeptide sequence contained in any of SEQ ID NO: 5223–SEQ ID NO: 10444 or function-conservative variants thereof.

In another aspect, the invention features a method of generating vaccines for immunizing an individual against *B. fragilis*. The method includes: immunizing a subject with an *B. fragilis* polypeptide, e.g., a surface or secreted polypeptide, or a combination of such peptides or active portion(s) thereof, and a pharmaceutically acceptable carrier. Such vaccines have therapeutic and prophylactic utilities.

In another aspect, the invention features a method of evaluating a compound, e.g., a polypeptide, e.g., a fragment of a host cell polypeptide, for the ability to bind an *B. fragilis* polypeptide. The method includes contacting the compound to be evaluated with an *B. fragilis* polypeptide and determining if the compound binds or otherwise interacts with the *B. fragilis* polypeptide. Compounds which bind or otherwise interact with *B. fragilis* polypeptides are candidates as modulators, including activators and inhibitors, of the bacterial life cycle. These assays can be performed in vitro or in vivo.

In another aspect, the invention features a method of evaluating a compound, e.g., a polypeptide, e.g., a fragment of a host cell polypeptide, for the ability to bind an *B. fragilis* nucleic acid, e.g., DNA or RNA. The method includes contacting the compound to be evaluated with an *B. fragilis* nucleic acid and determining if the compound binds or otherwise interacts with the *B. fragilis* nucleic acid. Compounds which bind *B. fragilis* are candidates as modultors, including activators and inhibitors, of the bacterial life cycle. These assays can be performed in vitro or in vivo.

A particularly preferred embodiment of the invention is directed to a method of screening test compounds for anti-bacterial activity, which method comprises: selecting as a target a bacterial specific sequence, which sequence is essential to the viability of a bacterial species; contacting a test compound with said target sequence; and selecting those test compounds which bind to said target sequence as potential anti-bacterial candidates. In one embodiment, the target sequence selected is specific to a single species, or even a single strain, such as, for example, the strain *B. fragilis* 14062. In a second embodiment, the target sequence is common to at least two species of bacteria. In a third embodiment, the target sequence is common to a family of bacteria. The target sequence may be a nucleic acid sequence or a polypeptide sequence. Methods employing sequences common to more than one species of microorganism may be used to screen candidates for broad spectrum anti-bacterial activity.

The invention also provides methods for preventing or treating disease caused by certain bacteria, including *B. fragilis*, which are carried out by administering to an animal in need of such treatment, in particular a warm-blooded vertebrate, including but not limited to birds and mammals, a compound that specifically inhibits or interferes with the function of a bacterial polypeptide or nucleic acid. In a particularly preferred embodiment, the mammal to be treated is human.

DETAILED DESCRIPTION OF THE INVENTION

The sequences of the present invention include the specific nucleic acid and amino acid sequences set forth in the Sequence Listing that forms a part of the present specification, and which are designated SEQ ID NO: 1–SEQ ID NO: 10444. Use of the terms "SEQ ID NO: 1–SEQ ID NO: 5222", "SEQ ID NO: 5223–SEQ ID NO: 10444, "the sequences depicted in Table 2", etc., is intended, for convenience, to refer to each individual SEQ ID NO individually, and is not intended to refer to the genus of these sequences unless such reference would be indicated. In other words, it is a shorthand for listing all of these sequences individually. The invention encompasses each sequence individually, as well as any combination thereof.

Definitions

"Nucleic acid" or "polynucleotide" as used herein refers to purine- and pyrimidine-containing polymers of any length, either polyribonucleotides or polydeoxyribonucleotides or mixed polyribo-polydeoxyribo nucleotides. This includes single- and double-stranded molecules, i.e., DNA—DNA, DNA-RNA and RNA—RNA hybrids, as well as "protein nucleic acids" (PNA) formed by conjugating bases to an amino acid backbone. This also includes nucleic acids containing modified bases.

A nucleic acid or polypeptide sequence that is "derived from" a designated sequence refers to a sequence that corresponds to a region of the designated sequence. For nucleic acid sequences, this encompasses sequences that are homologous or complementary to the sequence, as well as "sequence-conservative variants" and "function-conservative variants." For polypeptide sequences, this encompasses "function-conservative variants." Sequence-conservative variants are those in which a change of one or more nucleotides in a given codon position results in no alteration in the amino acid encoded at that position. Function-conservative variants are those in which a given amino acid residue in a polypeptide has been changed without altering the overall conformation and function of the native polypeptide, including, but not limited to, replacement of an amino acid with one having similar physico-chemical properties (such as, for example, acidic, basic, hydrophobic, and the like). "Function-conservative" variants also include any polypeptides that have the ability to elicit antibodies specific to a designated polypeptide.

An "B. fragilis-derived" nucleic acid or polypeptide sequence may or may not be present in other bacterial species, and may or may not be present in all B. fragilis strains. This term is intended to refer to the source from which the sequence was originally isolated. Thus, an B. fragilis-derived polypeptide, as used herein, may be used, e.g., as a target to screen for a broad spectrum antibacterial agent, to search for homologous proteins in other species of bacteria or in eukaryotic organisms such as bacteria humans, etc.

A purified or isolated polypeptide or a substantially pure preparation of a polypeptide are used interchangeably herein and, as used herein, mean a polypeptide that has been separated from other proteins, lipids, and nucleic acids with which it naturally occurs. Preferably, the polypeptide is also separated from substances, e.g., antibodies or gel matrix, e.g., polyacrylamide, which are used to purify it. Preferably, the polypeptide constitutes at least about 10, 20, 50 70, 80 or 95% dry weight of the purified preparation. Preferably, the preparation contains sufficient polypeptide to allow protein sequencing; at least about 1, 10, or preferably 100 mg of polypeptide.

A purified preparation of cells refers to, in the case of plant or animal cells, an in vitro preparation of cells and not an entire intact plant or animal. In the case of cultured cells or microbial cells, it consists of a preparation of at least about 10%, more preferably at least about 50%, of the subject cells.

A purified or isolated or a substantially pure nucleic acid, e.g., a substantially pure DNA, (are terms used interchangeably herein) is a nucleic acid which is one or both of the following: not immediately contiguous with both of the coding sequences with which it is immediately contiguous (i.e., one at the 5' end and one at the 3' end) in the naturally-occurring genome of the organism from which the nucleic acid is derived; or which is substantially free of a nucleic acid with which it occurs in the organism from which the nucleic acid is derived. The term includes, for example, a recombinant DNA which is incorporated into a vector, e.g., into an autonomously replicating plasmid or virus, or into the genomic DNA of a prokaryote or eukaryote, or which exists as a separate molecule (e.g., a cDNA or a genomic DNA fragment produced by PCR or restriction endonuclease treatment) independent of other DNA sequences. Substantially pure DNA also includes a recombinant DNA which is part of a hybrid gene encoding additional B. fragilis DNA sequence.

A "contig" as used herein is a nucleic acid representing a continuous stretch of genomic sequence of an organism.

An "open reading frame", also referred to herein as ORF, is a region of nucleic acid which encodes a polypeptide. This region may represent a portion of a coding sequence or a total sequence and can be determined from a stop to stop codon or from a start to stop codon.

As used herein, a "coding sequence" is a nucleic acid which is transcribed into messenger RNA and/or translated into a polypeptide when placed under the control of appropriate regulatory sequences. The boundaries of the coding sequence are determined by a translation start codon at the five prime terminus and a translation stop code at the three prime terminus. A coding sequence can include but is not limited to messenger RNA, synthetic DNA, and recombinant nucleic acid sequences.

A "complement" of a nucleic acid as used herein refers to an anti-parallel or antisense sequence that participates in Watson-Crick base-pairing with the original sequence.

A "gene product" is a protein or structural RNA which is specifically encoded by a gene.

As used herein, the term "probe" refers to a nucleic acid, peptide or other chemical entity which specifically binds to a molecule of interest. Probes are often associated with or capable of associating with a label. A label is a chemical moiety capable of detection. Typical labels comprise dyes, radioisotopes, luminescent and chemiluminescent moieties, fluorophores, enzymes, precipitating agents, amplification sequences, and the like. Similarly, a nucleic acid, peptide or other chemical entity which specifically binds to a molecule of interest and immobilizes such molecule is referred herein as a "capture ligand". Capture ligands are typically associated with or capable of associating with a support such as nitro-cellulose, glass, nylon membranes, beads, particles and the like. The specificity of hybridization is dependent on conditions such as the base pair composition of the nucleotides, and the temperature and salt concentration of the reaction. These conditions are readily discernable to one of ordinary skill in the art using routine experimentation.

"Homologous" refers to the sequence similarity or sequence identity between two polypeptides or between two nucleic acid molecules. When a position in both of the two compared sequences is occupied by the same base or amino acid monomer subunit, e.g., if a position in each of two DNA molecules is occupied by adenine, then the molecules are homologous at that position. The percent of homology between two sequences is a function of the number of matching or homologous positions shared by the two sequences divided by the number of positions compared× 100. For example, if 6 of 10 of the positions in two sequences are matched or homologous then the two sequences are 60% homologous. By way of example, the DNA sequences ATTGCC and TATGGC share 50% homology. Generally, a comparison is made when two sequences are aligned to give maximum homology.

Nucleic acids are hybridizable to each other when at least one strand of a nucleic acid can anneal to the other nucleic acid under defined stringency conditions. Stringency of hybridization is determined by: (a) the temperature at which hybridization and/or washing is performed; and (b) the ionic strength and polarity of the hybridization and washing solutions. Hybridization requires that the two nucleic acids contain complementary sequences; depending on the stringency of hybridization, however, mismatches may be tolerated. Typically, hybridization of two sequences at high stringency (such as, for example, in a solution of 0.5×SSC, at 65° C.) requires that the sequences be essentially completely homologous. Conditions of intermediate stringency (such as, for example, 2×SSC at 65° C.) and low stringency (such as, for example 2×SSC at 55° C.) require correspondingly less overall complementarity between the hybridizing sequences. (1×SSC is 0.15 M NaCl, 0.015 M Na citrate).

The terms peptides, proteins, and polypeptides are used interchangeably herein.

As used herein, the term "surface protein" refers to all surface accessible proteins, e.g. inner and outer membrane proteins, proteins adhering to the cell wall, and secreted proteins.

A polypeptide has B. fragilis biological activity if it has one, two or preferably more of the following properties: (1)

if when expressed in the course of an B. fragilis infection, it can promote, or mediate the attachment of B. fragilis to a cell; (2) it has an enzymatic activity, structural or regulatory function characteristic of an B. fragilis protein; (3) the gene which encodes it can rescue a lethal mutation in an B. fragilis gene.

A polypeptide has biological activity if it is an antagonist, agonist, or super-agonist of a polypeptide having one of the above-listed properties.

A biologically active fragment or analog is one having an in vivo or in vitro activity which is characteristic of the B. fragilis polypeptides of the invention contained in the Sequence Listing, or of other naturally occurring B. fragilis polypeptides, e.g., one or more of the biological activities described herein. Especially preferred are fragments which exist in vivo, e.g., fragments which arise from post transcriptional processing or which arise from translation of alternatively spliced RNA's. Fragments include those expressed in native or endogenous cells as well as those made in expression systems, e.g., in CHO (Chinese Hamster Ovary) cells. Because peptides such as B. fragilis polypeptides often exhibit a range of physiological properties and because such properties may be attributable to different portions of the molecule, a useful B. fragilis fragment or B. fragilis analog is one which exhibits a biological activity in any biological assay for B. fragilis activity. The fragment or analog possesses about 10%, preferably about 40%, more preferably about 60%, 70%, 80% or 90% or greater of the activity of B. fragilis, in any in vivo or in vitro assay.

Analogs can differ from naturally occurring B. fragilis polypeptides in amino acid sequence or in ways that do not involve sequence, or both. Non-sequence modifications include changes in acetylation, methylation, phosphorylation, carboxylation, or glycosylation. Preferred analogs include B. fragilis polypeptides (or biologically active fragments thereof) whose sequences differ from the wild-type sequence by one or more conservative amino acid substitutions or by one or more non-conservative amino acid substitutions, deletions, or insertions which do not substantially diminish the biological activity of the B. fragilis polypeptide. Conservative substitutions typically include the substitution of one amino acid for another with similar characteristics, e.g., substitutions within the following groups: valine, glycine; glycine, alanine; valine, isoleucine, leucine; aspartic acid, glutamic acid; asparagine, glutamine; serine, threonine; lysine, arginine; and phenylalanine, tyrosine. Other conservative substitutions can be made in view of the table below.

TABLE 1

CONSERVATIVE AMINO ACID REPLACEMENTS

| For Amino Acid | Code | Replace with any of |
|---|---|---|
| Alanine | A | D-Ala, Gly, beta-Ala, L-Cys, D-Cys |
| Arginine | R | D-Arg, Lys, D-Lys, homo-Arg, D-homo-Arg, Met, Ile, D-Met, D-Ile, Orn, D-Orn |
| Asparagine | N | D-Asn, Asp, D-Asp, Glu, D-Glu, Gln, D-Gln |
| Aspartic Acid | D | D-Asp, D-Asn, Asn, Glu, D-Glu, Gln, D-Gln |
| Cysteine | C | D-Cys, S-Me-Cys, Met, D-Met, Thr, D-Thr |
| Glutamine | Q | D-Gln, Asn, D-Asn, Glu, D-Glu, Asp, D-Asp |
| Glutamic Acid | E | D-Glu, D-Asp, Asp, Asn, D-Asn, Gln, D-Gln |
| Glycine | G | Ala, D-Ala, Pro, D-Pro, β-Ala, Acp |
| Isoleucine | I | D-Ile, Val, D-Val, Leu, D-Leu, Met, D-Met |
| Leucine | L | D-Leu, Val, D-Val, Leu, D-Leu, Met, D-Met |
| Lysine | K | D-Lys, Arg, D-Arg, homo-Arg, D-homo-Arg, Met, D-Met, Ile, D-Ile, Orn, D-Orn |
| Methionine | M | D-Met, S-Me-Cys, Ile, D-Ile, Leu, D-Leu, Val, D-Val |
| Phenylalanine | F | D-Phe, Tyr, D-Thr, L-Dopa, His, D-His, Trp, D-Trp, Trans-3,4, or 5-phenylproline, cis-3,4, or 5-phenylproline |
| Proline | P | D-Pro, L-I-thioazolidine-4-carboxylic acid, D-or L-1-oxazolidine-4-carboxylic acid |
| Serine | S | D-Ser, Thr, D-Thr, allo-Thr, Met, D-Met, Met(O), D-Met(O), L-Cys, D-Cys |
| Threonine | T | D-Thr, Ser, D-Ser, allo-Thr, Met, D-Met, Met(O), D-Met(O), Val, D-Val |
| Tyrosine | Y | D-Tyr, Phe, D-Phe, L-Dopa, His, D-His |
| Valine | V | D-Val, Leu, D-Leu, Ile, D-Ile, Met, D-Met |

Other analogs within the invention are those with modifications which increase peptide stability; such analogs may contain, for example, one or more non-peptide bonds (which replace the peptide bonds) in the peptide sequence. Also included are: analogs that include residues other than naturally occurring L-amino acids, e.g., D-amino acids or non-naturally occurring or synthetic amino acids, e.g., α or γ amino acids; and cyclic analogs.

As used herein, the term "fragment", as applied to an B. fragilis analog, will ordinarily be at least about 20 residues, more typically at least about 40 residues, preferably at least about 60 residues in length. Fragments of B. fragilis polypeptides can be generated by methods known to those skilled in the art. The ability of an Bacteroides fragment to exhibit a biological activity of B. fragilis polypeptide can be assessed by methods known to those skilled in the art as described herein. Also included are B. fragilis polypeptides containing residues that are not required for biological activity of the peptide or that result from alternative mRNA splicing or alternative protein processing events.

An "immunogenic component" as used herein is a moiety, such as an B. fragilis polypeptide, analog or fragment thereof, that is capable of eliciting a humoral and/or cellular immune response in a host animal.

An "antigenic component" as used herein is a moiety, such as an B. fragilis polypeptide, analog or fragment thereof, that is capable of binding to a specific antibody with sufficiently high affinity to form a detectable antigen-antibody complex.

The term "antibody" as used herein is intended to include fragments thereof which are specifically reactive with B. fragilis polypeptides.

As used herein, the term "cell-specific promoter" means a DNA sequence that serves as a promoter, i.e., regulates expression of a selected DNA sequence operably linked to the promoter, and which effects expression of the selected DNA sequence in specific cells of a tissue. The term also covers so-called "leaky" promoters, which regulate expression of a selected DNA primarily in one tissue, but cause expression in other tissues as well.

Misexpression, as used herein, refers to a non-wild type pattern of gene expression. It includes: expression at non-wild type levels, i.e., over or under expression; a pattern of expression that differs from wild type in terms of the time or stage at which the gene is expressed, e.g., increased or decreased expression (as compared with wild type) at a predetermined developmental period or stage; a pattern of expression that differs from wild type in terms of increased expression (as compared with wild type) in a predetermined cell type or tissue type; a pattern of expression that differs from wild type in terms of the splicing size, amino acid sequence, post-translational modification, or biological activity of the expressed polypeptide; a pattern of expression that differs from wild type in terms of the effect of an environmental stimulus or extracellular stimulus on expression of the gene, e.g., a pattern of increased or decreased expression (as compared with wild type) in the presence of an increase or decrease in the strength of the stimulus.

As used herein, "host cells" and other such terms denoting microorganisms or higher eukaryotic cell lines cultured as unicellular entities refers to cells which can become or have been used as recipients for a recombinant vector or other transfer DNA, and include the progeny of the original cell which has been transfected. It is understood by individuals skilled in the art that the progeny of a single parental cell may not necessarily be completely identical in genomic or total DNA compliment to the original parent, due to accident or deliberate mutation.

As used herein, the term "control sequence" refers to a nucleic acid having a base sequence which is recognized by the host organism to effect the expression of encoded sequences to which they are ligated. The nature of such control sequences differs depending upon the host organism; in prokaryotes, such control sequences generally include a promoter, ribosomal binding site, terminators, and in some cases operators; in eukaryotes, generally such control sequences include promoters, terminators and in some instances, enhancers. The term control sequence is intended to include at a minimum, all components whose presence is necessary for expression, and may also include additional components whose presence is advantageous, for example, leader sequences.

As used herein, the term "operably linked" refers to sequences joined or ligated to function in their intended manner. For example, a control sequence is operably linked to coding sequence by ligation in such a way that expression of the coding sequence is achieved under conditions compatible with the control sequence and host cell.

The "metabolism" of a substance, as used herein, means any aspect of the expression, function, action, or regulation of the substance. The metabolism of a substance includes modifications, e.g., covalent or non-covalent modifications of the substance. The metabolism of a substance includes modifications, e.g., covalent or non-covalent modification, the substance induces in other substances. The metabolism of a substance also includes changes in the distribution of the substance. The metabolism of a substance includes changes the substance induces in the distribution of other substances.

A "sample" as used herein refers to a biological sample, such as, for example, tissue or fluid isloated from an individual (including without limitation plasma, serum, cerebrospinal fluid, lymph, tears, saliva and tissue sections) or from in vitro cell culture constituents, as well as samples from the environment.

Technical and scientific terms used herein have the meanings commonly understood by one of ordinary skill in the art to which the present invention pertains, unless otherwise defined. Reference is made herein to various methodologies known to those of skill in the art. Publications and other materials setting forth such known methodologies to which reference is made are incorporated herein by reference in their entireties as though set forth in full. The practice of the invention will employ, unless otherwise indicated, conventional techniques of chemistry, molecular biology, microbiology, recombinant DNA, and immunology, which are within the skill of the art. Such techniques are explained fully in the literature. See e.g., Sambrook, Fritsch, and Maniatis, *Molecular Cloning, Laboratory Manual* 2nd ed. (1989); *DNA Cloning*, Volumes I and II (D. N Glover ed. 1985); *Oligonucleotide Synthesis* (M. J. Gait ed, 1984); *Nucleic Acid Hybridization* (B. D. Hames & S. J. Higgins eds. 1984); the series, *Methods in Enzymology* (Academic Press, Inc.), particularly Vol. 154 and Vol. 155 (Wu and Grossman, eds.); PCR-A Practical Approach (McPherson, Quirke, and Taylor, eds., 1991); *Immunology*, 2d Edition, 1989, Roitt et al., C. V. Mosby Company, and New York; *Advanced Immunology*, 2d Edition, 1991, Male et al., Grower Medical Publishing, New York.; *DNA Cloning: A Practical Approach*, Volumes I and II, 1985 (D. N. Glover ed.); *Oligonucleotide Synthesis*, 1984, (M. L. Gait ed); *Transcription and Translation*, 1984 (Hames and Higgins eds.); *Animal Cell Culture*, 1986 (R. I. Freshney ed.); *Immobilized Cells and Enzymes*, 1986 (IRL Press); Perbal, 1984, *A Practical Guide to Molecular Cloning; Gene Transfer Vectors for Mammalian Cells*, 1987 (J. H. Miller and M. P. Calos eds., Cold Spring Harbor Laboratory); Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997).

Any suitable materials and/or methods known to those of skill can be utilized in carrying out the present invention; however, preferred materials and/or methods are described. Materials, reagents and the like to which reference is made in the following description and examples are obtainable from commercial sources, unless otherwise noted.

*B. Fragilis* Genomic Sequence

This invention provides nucleotide sequences of the genome of *B. fragilis* which thus comprises a DNA sequence library of *B. fragilis* genomic DNA. The detailed description that follows provides nucleotide sequences of *B. fragilis*, and also describes how the sequences were obtained and how ORFs and protein-coding sequences were identified. Also described are compositions and methods of using the disclosed *B. fragilis* sequences in methods including diagnostic and therapeutic applications. Furthermore, the library can be used as a database for identification and comparison of medically important sequences in this and other strains of *B. fragilis*.

To determine the genomic sequence of *B. fragilis*, DNA from strain 14062 of *B. fragilis* was isolated after Zymolyase digestion, sodium dodecyl sulfate lysis, potassium acetate precipitation, phenol:chloroform extraction and ethanol precipitation (Soll, D. R., T. Srikantha and S. R. Lockhart: Characterizing Developmentally Regulated Genes in *B. fragilis*. In Microbial Genome Methods. K. W. Adolph, editor. CRC Press. New York. p 17–37.). DNA was sheared hydrodynamically using an HPLC (Oefner, et. al., 1996) to an insert size of 2000–3000 bp. After size fractionation by gel electrophoresis the fragments were blunt-ended, ligated to adapter oligonucleotides and cloned into the pGTC (Thomann) vector to construct a "shotgun" subclone library.

DNA sequencing was achieved using established ABI sequencing methods on ABI377 automated DNA sequencers. The cloning and sequencing procedures are described in more detail in the Exemplification.

Individual sequence reads were assembled using PHRAP (P. Green, Abstracts of DOE Human Genome Program Contractor-Grantee Workshop V, January 1996, p. 157). The average contig length was about 3–4 kb.

All subsequent steps were based on sequencing by ABI377 automated DNA sequencing methods. The cloning and sequencing procedures are described in more detail in the Exemplification.

A variety of approaches may be used to order the contigs so as to obtain a continuous sequence representing the entire B. fragilis genome. Synthetic oligonucleotides are designed that are complementary to sequences at the end of each contig. These oligonucleotides may be hybridized to libaries of B. fragilis genomic DNA in, for example, lambda phage vectors or plasmid vectors to identify clones that contain sequences corresponding to the junctional regions between individual contigs. Such clones are then used to isolate template DNA and the same oligonucleotides are used as primers in polymerase chain reaction (PCR) to amplify junctional fragments, the nucleotide sequence of which is then determined.

The B. fragilis sequences were analyzed for the presence of open reading frames (ORFs) comprising at least 180 nucleotides. As a result of the analysis of ORFs based on stop-to-stop codon reads, it should be understood that these ORFs may not correspond to the ORF of a naturally-occurring B. fragilis polypeptide. These ORFs may contain start codons which indicate the initiation of protein synthesis of a naturally-occurring B. fragilis polypeptide. Such start codons within the ORFs provided herein were identified by those of ordinary skill in the relevant art, and the resulting ORF and the encoded B. fragilis polypeptide is within the scope of this invention. For example, within the ORFs a codon such as AUG or GUG (encoding methionine or valine) which is part of the initiation signal for protein synthesis were identified and the portion of an ORF to corresponding to a naturally-occurring B. fragilis polypeptide was recognized. The predicted coding regions were defined by evaluating the coding potential of such sequences with the program GENEMARK™ (Borodovsky and McInch, 1993, Comp. 17:123).

Each predicted ORF amino acid sequence was compared with all sequences found in current GENBANK, SWISS-PROT, and PIR databases using the BLAST algorithm. BLAST identifies local alignments occurring by chance between the ORF sequence and the sequence in the databank (Altschal et al., 1990, L Mol. Biol. 215:403–410). Homologous ORFs (probabilities less than $10^{-5}$ by chance) and ORF's that are probably non-homologous (probabilities greater than $10^{-5}$ by chance) but have good codon usage were identified. Both homologous, sequences and non-homologous sequences with good codon usage, are likely to encode proteins and are encompassed by the invention.

B. Fragilis Nucleic Acids

The present invention provides a library of B. fragilis-derived nucleic acid sequences. The libraries provide probes, primers, and markers which are used as markers in epidemiological studies. The present invention also provides a library of B. fragilis-derived nucleic acid sequences which comprise or encode targets for therapeutic drugs.

The nucleic acids of this invention may be obtained directly from the DNA of the above referenced B. fragilis strain by using the polymerase chain reaction (PCR). See "PCR, A Practical Approach" (McPherson, Quirke, and Taylor, eds., IRL Press, Oxford, UK, 1991) for details about the PCR. High fidelity PCR is used to ensure a faithful DNA copy prior to expression. In addition, the authenticity of amplified products is verified by conventional sequencing methods. Clones carrying the desired sequences described in this invention may also be obtained by screening the libraries by means of the PCR or by hybridization of synthetic oligonucleotide probes to filter lifts of the library colonies or plaques as known in the art (see, e.g., Sambrook et al., Molecular Cloning, A Laboratory Manual 2nd edition, 1989, Cold Spring Harbor Press, NY).

It is also possible to obtain nucleic acids encoding B. fragilis polypeptides from a cDNA library in accordance with protocols herein described. A cDNA encoding an B. fragilis polypeptide can be obtained by isolating total mRNA from an appropriate strain. Double stranded cDNAs can then be prepared from the total mRNA. Subsequently, the cDNAs can be inserted into a suitable plasmid or viral (e.g., bacteriophage) vector using any one of a number of known techniques. Genes encoding B. fragilis polypeptides can also be cloned using established polymerase chain reaction techniques in accordance with the nucleotide sequence information provided by the invention. The nucleic acids of the invention can be DNA or RNA. Preferred nucleic acids of the invention are contained in the Sequence Listing.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

In another example, DNA can be chemically synthesized using, e.g., the phosphoramidite solid support method of Matteucci et al., 1981, J. Am. Chem. Soc. 103:3185, the method of Yoo et al., 1989, J. Biol. Chem. 764:17078, or other well known methods. This can be done by sequentially linking a series of oligonucleotide cassettes comprising pairs of synthetic oligonucleotides, as described below.

Nucleic acids isolated or synthesized in accordance with features of the present invention are useful, by way of example, without limitation, as probes, primers, capture ligands, antisense genes and for developing expression systems for the synthesis of proteins and peptides corresponding to such sequences. As probes, primers, capture ligands and antisense agents, the nucleic acid normally consists of all or part (approximately twenty or more nucleotides for specificity as well as the ability to form stable hybridization products) of the nucleic acids of the invention contained in the Sequence Listing. These uses are described in further detail below.

Probes

A nucleic acid isolated or synthesized in accordance with the sequence of the invention contained in the Sequence Listing can be used as a probe to specifically detect B. fragilis. With the sequence information set forth in the present application, sequences of twenty or more nucleotides are identified which provide the desired inclusivity and exclusivity with respect to B. fragilis, and extraneous nucleic acids likely to be encountered during hybridization conditions. More preferably, the sequence will comprise at least about twenty to thirty nucleotides to convey stability to the hybridization product formed between the probe and the intended target molecules.

Sequences larger than 1000 nucleotides in length are difficult to synthesize but can be generated by recombinant DNA techniques. Individuals skilled in the art will readily recognize that the nucleic acids, for use as probes, can be provided with a label to facilitate detection of a hybridization product.

Nucleic acid isolated and synthesized in accordance with the sequence of the invention contained in the Sequence Listing can also be useful as probes to detect homologous regions (especially homologous genes) of other *Bacteroides* species using appropriate stringency hybridization conditions as described herein.

Capture Ligand

For use as a capture ligand, the nucleic acid selected in the manner described above with respect to probes, can be readily associated with a support. The manner in which nucleic acid is associated with supports is well known. Nucleic acid having twenty or more nucleotides in a sequence of the invention contained in the Sequence Listing have utility to separate *B. fragilis* nucleic acid from one strain from the nucleic acid of other another strain as well as from other organisms. Nucleic acid having twenty or more nucleotides in a sequence of the invention contained in the Sequence Listing can also have utility to separate other *Bacteroides* species from each other and from other organisms. Preferably, the sequence will comprise at least about twenty nucleotides to convey stability to the hybridization product formed between the probe and the intended target molecules. Sequences larger than 1000 nucleotides in length are difficult to synthesize but can be generated by recombinant DNA techniques.

Primers

Nucleic acid isolated or synthesized in accordance with the sequences described herein have utility as primers for the amplification of *B. fragilis* nucleic acid. These nucleic acids may also have utility as primers for the amplification of nucleic acids in other *Bacteroides* species. With respect to polymerase chain reaction (PCR) techniques, nucleic acid sequences of $\geq$10–15 nucleotides of the invention contained in the Sequence Listing have utility in conjunction with suitable enzymes and reagents to create copies of *B. fragilis* nucleic acid. More preferably, the sequence will comprise twenty or more nucleotides to convey stability to the hybridization product formed between the primer and the intended target molecules. Binding conditions of primers greater than 100 nucleotides are more difficult to control to obtain specificity. High fidelity PCR can be used to ensure a faithful DNA copy prior to expression. In addition, amplified products can be checked by conventional sequencing methods.

The copies can be used in diagnostic assays to detect specific sequences, including genes from *B. fragilis* and/or other *Bacteroides* species. The copies can also be incorporated into cloning and expression vectors to generate polypeptides corresponding to the nucleic acid synthesized by PCR, as is described in greater detail herein.

The nucleic acids of the present invention find use as templates for the recombinant production of *B. fragilis*-derived peptides or polypeptides Antisense Nucleic acid or nucleic acid-hybridizing derivatives isolated or synthesized in accordance with the sequences described herein have utility as antisense agents to prevent the expression of *B. fragilis* genes. These sequences also have utility as antisense agents to prevent expression of genes of other *Bacteroides* species.

In one embodiment, nucleic acid or derivatives corresponding to *B. fragilis* nucleic acids is loaded into a suitable carrier such as a liposome or bacteriophage for introduction into bacterial cells. For example, a nucleic acid having twenty or more nucleotides is capable of binding to bacteria nucleic acid or bacteria messenger RNA. Preferably, the antisense nucleic acid is comprised of 20 or more nucleotides to provide necessary stability of a hybridization product of non-naturally occurring nucleic acid and bacterial nucleic acid and/or bacterial messenger RNA. Nucleic acid having a sequence greater than 1000 nucleotides in length is difficult to synthesize but can be generated by recombinant DNA techniques. Methods for loading antisense nucleic acid in liposomes is known in the art as exemplified by U.S. Pat. No. 4,241,046 issued Dec. 23, 1980 to Papahadjopoulos et al.

The present invention encompasses isolated polypeptides and nucleic acids derived from *B. fragilis* that are useful as reagents for diagnosis of bacterial infection, components of effective anti-bacterial vaccines, and/or as targets for anti-bacterial drugs, including anti-*B. fragilis* drugs.

Expression of *B. Fragilis* Nucleic Acids

Table 2, which is appended herewith and which forms part of the present specification, provides a list of open reading frames (ORFs) in both strands and a putative identification of the particular function of a polypeptide which is encoded by each ORF, based on the homology match (determined by the BLASTP2 algorithm) of the predicted polypeptide with known proteins encoded by ORFs in other organisms. An ORF is a region of nucleic acid which encodes a polypeptide. This region may represent a portion of a coding sequence or a total sequence and was determined from stop to stop codons. The first column contains a designation for the ORF ("ORF Name"). The second and third columns list the SEQ ID numbers for the nucleic acid ("NT ID") and amino acid ("AA ID") sequences corresponding to each ORF, respectively. The fourth and fifth columns list the length of the nucleic acid ORF ("NT Length") and the length of the amino acid ORF ("AA Length"), respectively. The nucleotide sequence corresponding to each ORF begins at the first nucleotide immediately following a stop codon and ends at the nucleotide immediately preceding the next downstream stop codon in the same reading frame. It will be recognized by one skilled in the art that the natural translation initiation sites will correspond to ATG, GTG, or TTG codons located within the ORFs. The natural initiation sites depend not only on the sequence of a start codon but also on the context of the DNA sequence adjacent to the start codon. Usually, a recognizable ribosome binding site is found within 20 nucleotides upstream from the initiation codon. In some cases where genes are translationally coupled and coordinately expressed together in "operons", ribosome binding sites are not present, but the initiation codon of a downstream gene may occur very close to, or overlap, the stop codon of the an upstream gene in the same operon. The correct start codons can be generally identified without undue experimentation because only a few codons need be tested. It is recognized that the translational machinery in bacteria initiates all polypeptide chains with the amino acid methionine, regardless of the sequence of the start codon. In some cases, polypeptides are post-translationally modified, resulting in an N-terminal amino acid other than methionine in vivo. The sixth and seventh columns provide metrics for assessing the likelihood of the homology match (determined by the BLASTP2 algorithm), as is known in the art, to the genes indicated in the description frame ("Description") defined further below. These genes in the Description were identified when the designated ORF was compared against a comprehensive non-redundant protein database. Specifically, the sixth column represents the Blast Score ("Score") for the match (a higher score is a better match), and the seventh column represents the probability ("Probability") for the match (the probability that such a match can have occurred by chance; the lower the value, the more likely the match is valid). If a BLASTP2 score of less than 100 was obtained, no value is reported in the table. The remaining fields below the columns contain additional information relating to the potential function of the sequence based on the BLASTP2 analysis. Where a match was discovered, the field "Protein name" list the protein's name identified from the match. In addition, one skilled in the art would be able to identify the match and elucidate its function using the "Locus name" and where available the accession number, "Acc#" from the database. Lastly, one skilled in the art would appreciate the "Description" field to further describe the potential function of the protein based on this analysis. This information allows one of ordinary skill in the art to determine a potential use for each identified coding sequence and, as a result, allows to use the polypeptides of the present invention for commercial and industrial purposes.

Using the information provided in SEQ ID NO: 1–SEQ ID NO: 5222, SEQ ID NO: 5223–SEQ ID NO: 10444 and in Table 2 together with routine cloning and sequencing methods, one of ordinary skill in the art will be able to clone and sequence all the nucleic acid fragments of interest including open reading frames (ORFs) encoding a large variety of proteins of B. fragilis.

Nucleic acid isolated or synthesized in accordance with the sequences described herein have utility to generate polypeptides. The nucleic acid of the invention exemplified in SEQ ID NO: 1–SEQ ID NO: 5222 and in Table 2 or fragments of said nucleic acid encoding active portions of B. fragilis polypeptides can be cloned into suitable vectors or used to isolate nucleic acid. The isolated nucleic acid is combined with suitable DNA linkers and cloned into a suitable vector.

The function of a specific gene or operon can be ascertained by expression in a bacterial strain under conditions where the activity of the gene product(s) specified by the gene or operon in question can be specifically measured. Alternatively, a gene product may be produced in large quantities in an expressing strain for use as an antigen, an industrial reagent, for structural studies, etc. This expression can be accomplished in a mutant strain which lacks the activity of the gene to be tested, or in a strain that does not produce the same gene product(s). This includes, but is not limited to, Eucaryotic species such as the yeast *Saccharomyces cerevisiae*, *Methanobacterium* strains or other Archaea, and Eubacteria such as *E. coli*, *B. Subtilis*, *S. Aureus*, *S. Pneumonia* or *Pseudomonas putida*. In some cases the expression host will utilize the natural *B. fragilis* promoter whereas in others, it will be necessary to drive the gene with a promoter sequence derived from the expressing organism (e.g., an *E. coli* beta-galactosidase promoter for expression in *E. coli*).

To express a gene product using the natural *B. fragilis* promoter, a procedure such as the following can be used. A restriction fragment containing the gene of interest, together with its associated natural promoter element and regulatory sequences (identified using the DNA sequence data) is cloned into an appropriate recombinant plasmid containing an origin of replication that functions in the host organism and an appropriate selectable marker. This can be accomplished by a number of procedures known to those skilled in the art. It is most preferably done by cutting the plasmid and the fragment to be cloned with the same restriction enzyme to produce compatible ends that can be ligated to join the two pieces together. The recombinant plasmid is introduced into the host organism by, for example, electroporation and cells containing the recombinant plasmid are identified by selection for the marker on the plasmid. Expression of the desired gene product is detected using an assay specific for that gene product.

In the case of a gene that requires a different promoter, the body of the gene (coding sequence) is specifically excised and cloned into an appropriate expression plasmid. This subcloning can be done by several methods, but is most easily accomplished by PCR amplification of a specific fragment and ligation into an expression plasmid after treating the PCR product with a restriction enzyme or exonuclease to create suitable ends for cloning.

A suitable host cell for expression of a gene can be any procaryotic or eucaryotic cell. Suitable methods for transforming host cells can be found in Sambrook et al. (*Molecular Cloning: A Laboratory Manual*, 2nd Edition, Cold Spring Harbor Laboratory Press (1989)), and other laboratory textbooks.

For example, a host cell transfected with a nucleic acid vector directing expression of a nucleotide sequence encoding an *B. fragilis* polypeptide can be cultured under appropriate conditions to allow expression of the polypeptide to occur. Suitable media for cell culture are well known in the art. Polypeptides of the invention can be isolated from cell culture medium, host cells, or both using techniques known in the art for purifying proteins including ion-exchange chromatography, gel filtration chromatography, ultrafiltration, electrophoresis, and immunoaffinity purification with antibodies specific for such polypeptides. Additionally, in many situations, polypeptides can be produced by chemical cleavage of a native protein (e.g., tryptic digestion) and the cleavage products can then be purified by standard techniques.

In the case of membrane bound proteins, these can be isolated from a host cell by contacting a membrane-associated protein fraction with a detergent forming a solubilized complex, where the membrane-associated protein is no longer entirely embedded in the membrane fraction and is solubilized at least to an extent which allows it to be chromatographically isolated from the membrane fraction. Chromatographic techniques which can be used in the final purification step are known in the art and include hydrophobic interaction, lectin affinity, ion exchange, dye affinity and immunoaffinity.

One strategy to maximize recombinant *B. fragilis* peptide expression in *E. coli* is to express the protein in a host bacteria with an impaired capacity to proteolytically cleave the recombinant protein (Gottesman, S., *Gene Expression Technology: Methods in Enzymology* 185, Academic Press, San Diego, Calif. (1990) 119–128). Another strategy would be to alter the nucleic acid encoding an *B. fragilis* peptide to be inserted into an expression vector so that the individual codons for each amino acid would be those preferentially utilized in highly expressed *E. coli* proteins (Wada et al., (1992) *Nuc. Acids Res.* 20:2111–2118). Such alteration of nucleic acids of the invention can be carried out by standard DNA synthesis techniques.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See, e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

The present invention provides a library of *B. fragilis*-derived nucleic acid sequences. The libraries provide probes, primers, and markers which can be used as markers in epidemiological studies. The present invention also provides a library of *B. fragilis*-derived nucleic acid sequences which comprise or encode targets for therapeutic drugs.

Nucleic acids comprising any of the sequences disclosed herein or sub-sequences thereof can be prepared by standard methods using the nucleic acid sequence information provided in SEQ ID NO: 1–SEQ ID NO: 5222. For example, DNA can be chemically synthesized using, e.g., the phosphoramidite solid support method of Matteucci et al., 1981, *J. Am. Chem. Soc.* 103:3185, the method of Yoo et al., 1989, *J. Biol. Chem.* 764:17078, or other well known methods. This can be done by sequentially linking a series of oligonucleotide cassettes comprising pairs of synthetic oligonucleotides, as described below.

Of course, due to the degeneracy of the genetic code, many different nucleotide sequences can encode polypeptides having the amino acid sequences defined by SEQ ID NO: 5223–SEQ ID NO: 10444 or sub-sequences thereof. The codons can be selected for optimal expression in prokaryotic or eukaryotic systems. Such degenerate variants are also encompassed by this invention.

Insertion of nucleic acids (typically DNAs) encoding the polypeptides of the invention into a vector is easily accomplished when the termini of both the DNAs and the vector comprise compatible restriction sites. If this cannot be done, it may be necessary to modify the termini of the DNAs and/or vector by digesting back single-stranded DNA overhangs generated by restriction endonuclease cleavage to produce blunt ends, or to achieve the same result by filling in the single-stranded termini with an appropriate DNA polymerase.

Alternatively, any site desired may be produced, e.g., by ligating nucleotide sequences (linkers) onto the termini. Such linkers may comprise specific oligonucleotide sequences that define desired restriction sites. Restriction sites can also be generated by the use of the polymerase chain reaction (PCR). See, e.g., Saiki et al., 1988, *Science* 239:48. The cleaved vector and the DNA fragments may also be modified if required by homopolymeric tailing.

The nucleic acids of the invention may be isolated directly from cells. Alternatively, the polymerase chain reaction (PCR) method can be used to produce the nucleic acids of the invention, using either chemically synthesized strands or genomic material as templates. Primers used for PCR can be synthesized using the sequence information provided herein and can further be designed to introduce appropriate new restriction sites, if desirable, to facilitate incorporation into a given vector for recombinant expression.

The nucleic acids of the present invention may be flanked by natural *B. fragilis* regulatory sequences, or may be associated with heterologous sequences, including promoters, enhancers, response elements, signal sequences, polyadenylation sequences, introns, 5'- and 3'-noncoding regions, and the like. The nucleic acids may also be modified by many means known in the art. Non-limiting examples of such modifications include methylation, "caps", substitution of one or more of the naturally occurring nucleotides with an analog, internucleotide modifications such as, for example, those with uncharged linkages (e.g., methyl phosphonates, phosphotriesters, phosphoroamidates, carbamates, etc.) and with charged linkages (e.g., phosphorothioates, phosphorodithioates, etc.). Nucleic acids may contain one or more additional covalently linked moieties, such as, for example, proteins (e.g., nucleases, toxins, antibodies, signal peptides, poly-L-lysine, etc.), intercalators (e.g., acridine, psoralen, etc.), chelators (e.g., metals, radioactive metals, iron, oxidative metals, etc.), and alkylators. PNAs are also included. The nucleic acid may be derivatized by formation of a methyl or ethyl phosphotriester or an alkyl phosphoramidate linkage. Furthermore, the nucleic acid sequences of the present invention may also be modified with a label capable of providing a detectable signal, either directly or indirectly. Exemplary labels include radioisotopes, fluorescent molecules, biotin, and the like.

The invention also provides nucleic acid vectors comprising the disclosed *B. fragilis*-derived sequences or derivatives or fragments thereof. A large number of vectors, including plasmid and bacterial vectors, have been described for replication and/or expression in a variety of eukaryotic and prokaryotic hosts, and may be used for cloning or protein expression.

The encoded *B. fragilis* polypeptides may be expressed by using many known vectors, such as pUC plasmids, pET plasmids (Novagen, Inc., Madison, Wis.), or pRSET or pREP (Invitrogen, San Diego, Calif.), and many appropriate host cells, using methods disclosed or cited herein or otherwise known to those skilled in the relevant art. The particular choice of vector/host is not critical to the practice of the invention.

Recombinant cloning vectors will often include one or more replication systems for cloning or expression, one or more markers for selection in the host, e.g. antibiotic resistance, and one or more expression cassettes. The inserted *B. fragilis* coding sequences may be synthesized by standard methods, isolated from natural sources, or prepared as hybrids, etc. Ligation of the *B. fragilis* coding sequences to transcriptional regulatory elements and/or to other amino acid coding sequences may be achieved by known methods. Suitable host cells may be transformed/transfected/infected as appropriate by any suitable method including electroporation, $CaCl_2$ mediated DNA uptake, bacterial infection, microinjection, microprojectile, or other established methods.

Appropriate host cells include bacteria, archebacteria, fungi, especially yeast, and plant and animal cells, especially mammalian cells. Of particular interest are *B. fragilis, E. coli, B. Subtilis, Saccharomyces cerevisiae, Saccharomyces carlsbergensis, Schizosaccharomyces pombi*, SF9 cells, C129 cells, 293 cells, *Neurospora*, and CHO cells, COS cells, HeLa cells, and immortalized mammalian myeloid and lymphoid cell lines. Preferred replication systems include M13, ColE1, SV40, baculovirus, lambda, adenovirus, and the like. A large number of transcription initiation and termination regulatory regions have been isolated and shown to be effective in the transcription and translation of heterologous proteins in the various hosts. Examples of these regions, methods of isolation, manner of manipulation, etc. are known in the art. Under appropriate expression conditions, host cells can be used as a source of recombinantly produced *B. fragilis*-derived peptides and polypeptides.

Advantageously, vectors may also include a transcription regulatory element (i.e., a promoter) operably linked to the *B. fragilis* portion. The promoter may optionally contain operator portions and/or ribosome binding sites. Non-limiting examples of bacterial promoters compatible with *E. coli* include: b-lactamase (penicillinase) promoter; lactose promoter; tryptophan (trp) promoter; araBAD (arabinose) operon promoter; lambda-derived $P_1$ promoter and N gene ribosome binding site; and the hybrid tac promoter derived from sequences of the trp and lac UV5 promoters. Non-limiting examples of yeast promoters include 3-phosphoglycerate kinase promoter, glyceraldehyde-3-phosphate dehydrogenase (GAPDH) promoter, galactokinase (GAL1)

promoter, galactoepimerase promoter, and alcohol dehydrogenase (ADH) promoter. Suitable promoters for mammalian cells include without limitation viral promoters such as that from Simian Virus 40 (SV40), Rous sarcoma virus (RSV), adenovirus (ADV), and bovine papilloma virus (BPV). Mammalian cells may also require terminator sequences, polyA addition sequences and enhancer sequences to increase expression. Sequences which cause amplification of the gene may also be desirable. Furthermore, sequences that facilitate secretion of the recombinant product from cells, including, but not limited to, bacteria, yeast, and animal cells, such as secretory signal sequences and/or prohormone pro region sequences, may also be included. These sequences are well described in the art.

Nucleic acids encoding wild-type or variant *B. fragilis*-derived polypeptides may also be introduced into cells by recombination events. For example, such a sequence can be introduced into a cell, and thereby effect homologous recombination at the site of an endogenous gene or a sequence with substantial identity to the gene. Other recombination-based methods such as nonhomologous recombinations or deletion of endogenous genes by homologous recombination may also be used.

The nucleic acids of the present invention find use as templates for the recombinant production of *B. fragilis*-derived peptides or polypeptides.

Identification and use of *B. Fragilis* Nucleic Acid Sequences

The disclosed *B. fragilis* polypeptide and nucleic acid sequences, or other sequences that are contained within ORFs, including complete protein-coding sequences, of which any of the disclosed *B. fragilis*-specific sequences forms a part, are useful as target components for diagnosis and/or treatment of *B. fragilis*-caused infection It will be understood that the sequence of an entire protein-coding sequence of which each disclosed nucleic acid sequence forms a part can be isolated and identified based on each disclosed sequence. This can be achieved, for example, by using an isolated nucleic acid encoding the disclosed sequence, or fragments thereof, to prime a sequencing reaction with genomic *B. fragilis* DNA as template; this is followed by sequencing the amplified product. The isolated nucleic acid encoding the disclosed sequence, or fragments thereof, can also be hybridized to *B. fragilis* genomic libraries to identify clones containing additional complete segments of the protein-coding sequence of which the shorter sequence forms a part. Then, the entire protein-coding sequence, or fragments thereof, or nucleic acids encoding all or part of the sequence, or sequence-conservative or function-conservative variants thereof, may be employed in practicing the present invention.

Preferred sequences are those that are useful in diagnostic and/or therapeutic applications. Diagnostic applications include without limitation nucleic-acid-based and antibody-based methods for detecting bacterial infection. Therapeutic applications include without limitation vaccines, passive immunotherapy, and drug treatments directed against gene products that are both unique to bacteria and essential for growth and/or replication of bacteria.

Identification of Nucleic Acids Encoding Vaccine Components and Targets for Agents Effective Against *B. Fragilis*

The disclosed *B. fragilis* genome sequence includes segments that direct the synthesis of ribonucleic acids and polypeptides, as well as origins of replication, promoters, other types of regulatory sequences, and intergenic nucleic acids. The invention encompasses nucleic acids encoding immunogenic components of vaccines and targets for agents effective against *B. fragilis*. Identification of said immunogenic components involved in the determination of the function of the disclosed sequences, which can be achieved using a variety of approaches. Non-limiting examples of these approaches are described briefly below.

Homology to Known Sequences:

Computer-assisted comparison of the disclosed *B. fragilis* sequences with previously reported sequences present in publicly available databases is useful for identifying functional *B. fragilis* nucleic acid and polypeptide sequences. It will be understood that protein-coding sequences, for example, may be compared as a whole, and that a high degree of sequence homology between two proteins (such as, for example, >80–90%) at the amino acid level indicates that the two proteins also possess some degree of functional homology, such as, for example, among enzymes involved in metabolism, DNA synthesis, or cell wall synthesis, and proteins involved in transport, cell division, etc. In addition, many structural features of particular protein classes have been identified and correlate with specific consensus sequences, such as, for example, binding domains for nucleotides, DNA, metal ions, and other small molecules; sites for covalent modifications such as phosphorylation, acylation, and the like; sites of protein:protein interactions, etc. These consensus sequences may be quite short and thus may represent only a fraction of the entire protein-coding sequence. Identification of such a feature in an *B. fragilis* sequence is therefore useful in determining the function of the encoded protein and identifying useful targets of antibacterial drugs.

Of particular relevance to the present invention are structural features that are common to secretory, transmembrane, and surface proteins, including secretion signal peptides and hydrophobic transmembrane domains. *B. fragilis* proteins identified as containing putative signal sequences and/or transmembrane domains are useful as immunogenic components of vaccines.

Targets for therapeutic drugs according to the invention include, but are not limited to, polypeptides of the invention, whether unique to *B. fragilis* or not, that are essential for growth and/or viability of *B. fragilis* under at least one growth condition. Polypeptides essential for growth and/or viability can be determined by examining the effect of deleting and/or disrupting the genes, i.e., by so-called gene "knockout". Alternatively, genetic footprinting can be used (Smith et al., 1995, *Proc. Natl. Acad. Sci. USA* 92:5479–6433; Published International Application WO 94/26933; U.S. Pat. No. 5,612,180). Still other methods for assessing essentiality includes the ability to isolate conditional lethal mutations in the specific gene (e.g., temperature sensitive mutations). Other useful targets for therapeutic drugs, which include polypeptides that are not essential for growth or viability per se but lead to loss of viability of the cell, can be used to target therapeutic agents to cells.

Strain-Specific Sequences:

Because of the evolutionary relationship between different *B. fragilis* strains, it is believed that the presently disclosed *B. fragilis* sequences are useful for identifying, and/or discriminating between, previously known and new *B. fragilis* strains. It is believed that other *B. fragilis* strains will exhibit at least about 70% sequence homology with the presently disclosed sequence. Systematic and routine analyses of DNA sequences derived from samples containing *B. fragilis* strains, and comparison with the present sequence allows for the identification of sequences that can be used to discriminate between strains, as well as those that are common to all *B. fragilis* strains. In one embodiment, the invention provides nucleic acids, including probes, and peptide and polypeptide sequences that discriminate between different strains of *B. fragilis*. Strain-specific components can also be identified functionally by their ability to elicit or react with antibodies that selectively recognize one or more *B. fragilis* strains.

In another embodiment, the invention provides nucleic acids, including probes, and peptide and polypeptide sequences that are common to all *B. fragilis* strains but are not found in other bacterial species.

B. *Fragilis* Polypeptides

This invention encompasses isolated *B. fragilis* polypeptides encoded by the disclosed *B. fragilis* genomic sequences, including the polypeptides of the invention contained in the Sequence Listing. Polypeptides of the invention are preferably at least about 5 amino acid residues in length. Using the DNA sequence information provided herein, the amino acid sequences of the polypeptides encompassed by the invention can be deduced using methods well-known in the art. It will be understood that the sequence of an entire nucleic acid encoding an *B. fragilis* polypeptide can be isolated and identified based on an ORF that encodes only a fragment of the cognate protein-coding region. This can be achieved, for example, by using the isolated nucleic acid encoding the ORF, or fragments thereof, to prime a polymerase chain reaction with genomic *B. fragilis* DNA as template; this is followed by sequencing the amplified product.

The polypeptides of the present invention, including function-conservative variants of the disclosed ORFs, may be isolated from wild-type or mutant *B. fragilis* cells, or from heterologous organisms or cells (including, but not limited to, bacteria, fungi, insect, plant, and mammalian cells) including *B. fragilis* into which an *B. fragilis* derived protein-coding sequence has been introduced and expressed. Furthermore, the polypeptides may be part of recombinant fusion proteins.

*B. fragilis* polypeptides of the invention can be chemically synthesized using commercially automated procedures such as those referenced herein, including, without limitation, exclusive solid phase synthesis, partial solid phase methods, fragment condensation or classical solution synthesis. The polypeptides are preferably prepared by solid phase peptide synthesis as described by Merrifield, 1963, *J. Am. Chem. Soc.* 85:2149. The synthesis is carried out with amino acids that are protected at the alpha-amino terminus. Trifunctional amino acids with labile side-chains are also protected with suitable groups to prevent undesired chemical reactions from occurring during the assembly of the polypeptides. The alpha-amino protecting group is selectively removed to allow subsequent reaction to take place at the amino-terminus. The conditions for the removal of the alpha-amino protecting group do not remove the side-chain protecting groups.

Methods for polypeptide purification are well-known in the art, including, without limitation, preparative disc-gel electrophoresis, isoelectric focusing, HPLC, reversed-phase HPLC, gel filtration, ion exchange and partition chromatography, and countercurrent distribution. For some purposes, it is preferable to produce the polypeptide in a recombinant system in which the *B. fragilis* protein contains an additional sequence tag that facilitates purification, such as, but not limited to, a polyhistidine sequence. The polypeptide can then be purified from a crude lysate of the host cell by chromatography on an appropriate solid-phase matrix. Alternatively, antibodies produced against an *B. fragilis* protein or against peptides derived therefrom can be used as purification reagents. Other purification methods are possible.

The present invention also encompasses derivatives and homologues of *B. fragilis*-encoded polypeptides. For some purposes, nucleic acid sequences encoding the peptides may be altered by substitutions, additions, or deletions that provide for functionally equivalent molecules, i.e., function-conservative variants. For example, one or more amino acid residues within the sequence can be substituted by another amino acid of similar properties, such as, for example, positively charged amino acids (arginine, lysine, and histidine); negatively charged amino acids (aspartate and glutamate); polar neutral amino acids; and non-polar amino acids.

The isolated polypeptides may be modified by, for example, phosphorylation, sulfation, acylation, or other protein modifications. They may also be modified with a label capable of providing a detectable signal, either directly or indirectly, including, but not limited to, radioisotopes and fluorescent compounds.

To identify *B. fragilis*-derived polypeptides for use in the present invention, essentially the complete genomic sequence of a virulent, methicillin-resistant isolate of *Bacteroides fragilis* isolate was analyzed. While, in very rare instances, a nucleic acid sequencing error may be revealed, resolving a rare sequencing error is well within the art, and such an occurrence will not prevent one skilled in the art from practicing the invention.

Also encompassed are any *B. fragilis* polypeptide sequences that are contained within the open reading frames (ORFs), including complete protein-coding sequences, of which any of SEQ ID NO: 1–SEQ ID NO: 5222 forms a part. Table 2, which is appended herewith and which forms part of the present specification, provides a putative identification of the particular function of a polypeptide which is encoded by each ORF, based on the homology match (determined by the BLAST algorithm) of the predicted polypeptide with known proteins encoded by ORFs in other organisms. As a result, one skilled in the art can use the polypeptides of the present invention for commercial and industrial purposes consistent with the type of putative identification of the polypeptide.

The present invention provides a library of *B. fragilis*-derived polypeptide sequences, and a corresponding library of nucleic acid sequences encoding the polypeptides, wherein the polypeptides themselves, or polypeptides contained within ORFs of which they form a part, comprise sequences that are contemplated for use as components of vaccines. Non-limiting examples of such sequences are listed by SEQ ID NO in Table 2, which is appended herewith and which forms part of the present specification.

The present invention also provides a library of *B. fragilis*-derived polypeptide sequences, and a corresponding library of nucleic acid sequences encoding the polypeptides, wherein the polypeptides themselves, or polypeptides contained within ORFs of which they form a part, comprise sequences lacking homology to any known prokaryotic or eukaryotic sequences. Such libraries provide probes, primers, and markers which can be used to diagnose *B. fragilis* infection, including use as markers in epidemiological studies. Non-limiting examples of such sequences are listed by SEQ ID NO in Table 2, which is appended hereto and part hereof.

The present invention also provides a library of *B. fragilis*-derived polypeptide sequences, and a corresponding library of nucleic acid sequences encoding the polypeptides, wherein the polypeptides themselves, or polypeptides contained within ORFs of which they form a part, comprise targets for therapeutic drugs.

Specific Example: Determination of Bacteroides Protein Antigens for Antibody and Vaccine Development The selection of *Bacteroides* protein antigens for vaccine development can be derived from the nucleic acids encoding *B. fragilis* polypeptides. First, the ORF's can be analyzed for homology to other known exported or membrane proteins and analyzed using the discriminant analysis described by Klein, et al. (Klein, P., Kanehsia, M., and DeLisi, C. (1985) *Biochimica et Biophysica Acta* 815, 468–476) for predicting exported and membrane proteins.

Homology searches can be performed using the BLAST algorithm contained in the Wisconsin Sequence Analysis Package (Genetics Computer Group, University Research Park, 575 Science Drive, Madison, Wis. 53711) to compare each predicted ORF amino acid sequence with all sequences found in the current GenBank, SWISS-PROT and PIR databases. BLAST searches for local alignments between the ORF and the databank sequences and reports a probability score which indicates the probability of finding this sequence by chance in the database. ORF's with significant homology (e.g. probabilities lower than $1 \times 10^{-6}$ that the homology is only due to random chance) to membrane or exported proteins represent protein antigens for vaccine development. Possible functions can be provided to *B. fragilis* genes based on sequence homology to genes cloned in other organisms.

Discriminant analysis (Klein, et al. supra) can be used to examine the ORF amino acid sequences. This algorithm uses the intrinsic information contained in the ORF amino acid sequence and compares it to information derived from the properties of known membrane and exported proteins. This comparison predicts which proteins will be exported, membrane associated or cytoplasmic. ORF amino acid sequences identified as exported or membrane associated by this algorithm are likely protein antigens for vaccine development.

Production of Fragments and Analogs of *B. Fragilis* Nucleic Acids and Polypeptides Based on the discovery of the *B. fragilis* gene products of the invention provided in the Sequence Listing, one skilled in the art can alter the disclosed structure of *B. fragilis* genes, e.g., by producing fragments or analogs, and test the newly produced structures for activity. Examples of techniques known to those skilled in the relevant art which allow the production and testing of fragments and analogs are discussed below. These, or analogous methods can be used to make and screen libraries of polypeptides, e.g., libraries of random peptides or libraries of fragments or analogs of cellular proteins for the ability to bind *B. fragilis* polypeptides. Such screens are useful for the identification of inhibitors of *B. fragilis*.

Generation of Fragments

Fragments of a protein can be produced in several ways, e.g., recombinantly, by proteolytic digestion, or by chemical synthesis. Internal or terminal fragments of a polypeptide can be generated by removing one or more nucleotides from one end (for a terminal fragment) or both ends (for an internal fragment) of a nucleic acid which encodes the polypeptide. Expression of the mutagenized DNA produces polypeptide fragments. Digestion with "end-nibbling" endonucleases can thus generate DNAs which encode an array of fragments. DNAs which encode fragments of a protein can also be generated by random shearing, restriction digestion or a combination of the above-discussed methods.

Fragments can also be chemically synthesized using techniques known in the art such as conventional Merrifield solid phase f-Moc or t-Boc chemistry. For example, peptides of the present invention may be arbitrarily divided into fragments of desired length with no overlap of the fragments, or divided into overlapping fragments of a desired length.

Alteration of Nucleic Acids and Polypeptides: Random Methods

Amino acid sequence variants of a protein can be prepared by random mutagenesis of DNA which encodes a protein or a particular domain or region of a protein. Useful methods include PCR mutagenesis and saturation mutagenesis. A library of random amino acid sequence variants can also be generated by the synthesis of a set of degenerate oligonucleotide sequences. (Methods for screening proteins in a library of variants are elsewhere herein).

PCR Mutagenesis

In PCR mutagenesis, reduced Taq polymerase fidelity is used to introduce random mutations into a cloned fragment of DNA (Leung et al., 1989, *Technique* 1:11–15). The DNA region to be mutagenized is amplified using the polymerase chain reaction (PCR) under conditions that reduce the fidelity of DNA synthesis by Taq DNA polymerase, e.g., by using a dGTP/dATP ratio of five and adding $Mn^{2+}$ to the PCR reaction. The pool of amplified DNA fragments are inserted into appropriate cloning vectors to provide random mutant libraries.

Saturation Mutagenesis

Saturation mutagenesis allows for the rapid introduction of a large number of single base substitutions into cloned DNA fragments (Mayers et al., 1985, *Science* 229:242). This technique includes generation of mutations, e.g., by chemical treatment or irradiation of single-stranded DNA in vitro, and synthesis of a complimentary DNA strand. The mutation frequency can be modulated by modulating the severity of the treatment, and essentially all possible base substitutions can be obtained. Because this procedure does not involve a genetic selection for mutant fragments both neutral substitutions, as well as those that alter function, are obtained. The distribution of point mutations is not biased toward conserved sequence elements.

Degenerate Oligonucleotides

A library of homologs can also be generated from a set of degenerate oligonucleotide sequences. Chemical synthesis of a degenerate sequences can be carried out in an automatic DNA synthesizer, and the synthetic genes then ligated into an appropriate expression vector. The synthesis of degenerate oligonucleotides is known in the art (see for example, Narang, SA (1983) *Tetrahedron* 39:3; Itakura et al. (1981) *Recombinant DNA, Proc* 3rd *Cleveland Sympos. Macromolecules*, ed. AG Walton, Amsterdam: Elsevier pp273–289; Itakura et al. (1984) *Annu. Rev. Biochem.* 53:323; Itakura et al. (1984) *Science* 198:1056; Ike et al. (1983) *Nucleic Acid Res.* 11:477. Such techniques have been employed in the directed evolution of other proteins (see, for example, Scott et al. (1990) *Science* 249:386–390; Roberts et al. (1992) *PNAS* 89:2429–2433; Devlin et al. (1990) *Science* 249: 404–406; Cwirla et al. (1990) *PNAS* 87: 6378–6382; as well as U.S. Pat. Nos. 5,223,409, 5,198,346, and 5,096,815).

Alteration of Nucleic Acids and Polypeptides: Methods for Directed Mutagenesis

Non-random or directed, mutagenesis techniques can be used to provide specific sequences or mutations in specific regions. These techniques can be used to create variants which include, e.g., deletions, insertions, or substitutions, of residues of the known amino acid sequence of a protein. The sites for mutation can be modified individually or in series, e.g., by (1) substituting first with conserved amino acids and then with more radical choices depending upon results achieved, (2) deleting the target residue, or (3) inserting residues of the same or a different class adjacent to the located site, or combinations of options 1–3.

Alanine Scanning Mutagenesis

Alanine scanning mutagenesis is a useful method for identification of certain residues or regions of the desired protein that are preferred locations or domains for mutagenesis, Cunningham and Wells (*Science* 244:1081–1085, 1989). In alanine scanning, a residue or group of target residues are identified (e.g., charged residues such as Arg, Asp, His, Lys, and Glu) and replaced by a neutral or negatively charged amino acid (most preferably alanine or polyalanine). Replacement of an amino acid can affect the interaction of the amino acids with the surrounding aqueous environment in or outside the cell. Those domains demonstrating functional sensitivity to the substitutions are then refined by introducing further or other variants at or for the sites of substitution. Thus, while the site for introducing an amino acid sequence variation is predetermined, the nature of the mutation per se need not be predetermined. For example, to optimize the performance of a mutation at a given site, alanine scanning or random mutagenesis may be conducted at the target codon or region and the expressed desired protein subunit variants are screened for the optimal combination of desired activity.

Oligonucleotide-Mediated Mutagenesis

Oligonucleotide-mediated mutagenesis is a useful method for preparing substitution, deletion, and insertion variants of DNA, see, e.g., Adelman et al., (*DNA* 2:183, 1983). Briefly, the desired DNA is altered by hybridizing an oligonucleotide encoding a mutation to a DNA template, where the template is the single-stranded form of a plasmid or bacteriophage containing the unaltered or native DNA sequence of the desired protein. After hybridization, a DNA polymerase is used to synthesize an entire second complementary strand of the template that will thus incorporate the oligonucleotide primer, and will code for the selected alteration in the desired protein DNA. Generally, oligonucleotides of at least about 25 nucleotides in length are used. An optimal oligonucleotide will have 12 to 15 nucleotides that are completely complementary to the template on either side of the nucleotide(s) coding for the mutation. This ensures that the oligonucleotide will hybridize properly to the single-stranded DNA template molecule. The oligonucleotides are readily synthesized using techniques known in the art such as that described by Crea et al. (*Proc. Natl. Acad. Sci.* USA, 75: 5765 [1978]).

Cassette Mutagenesis

Another method for preparing variants, cassette mutagenesis, is based on the technique described by Wells et al. (*Gene,* 34:315 [1985]). The starting material is a plasmid (or other vector) which includes the protein subunit DNA to be mutated. The codon(s) in the protein subunit DNA to be mutated are identified. There must be a unique restriction endonuclease site on each side of the identified mutation site(s). If no such restriction sites exist, they may be generated using the above-described oligonucleotide-mediated mutagenesis method to introduce them at appropriate locations in the desired protein subunit DNA. After the restriction sites have been introduced into the plasmid, the plasmid is cut at these sites to linearize it. A double-stranded oligonucleotide encoding the sequence of the DNA between the restriction sites but containing the desired mutation(s) is synthesized using standard procedures. The two strands are synthesized separately and then hybridized together using standard techniques. This double-stranded oligonucleotide is referred to as the cassette. This cassette is designed to have 3' and 5' ends that are comparable with the ends of the linearized plasmid, such that it can be directly ligated to the plasmid. This plasmid now contains the mutated desired protein subunit DNA sequence.

Combinatorial Mutagenesis

Combinatorial mutagenesis can also be used to generate mutants (Ladner et al., WO 88/06630). In this method, the amino acid sequences for a group of homologs or other related proteins are aligned, preferably to promote the highest homology possible. All of the amino acids which appear at a given position of the aligned sequences can be selected to create a degenerate set of combinatorial sequences. The variegated library of variants is generated by combinatorial mutagenesis at the nucleic acid level, and is encoded by a variegated gene library. For example, a mixture of synthetic oligonucleotides can be enzymatically ligated into gene sequences such that the degenerate set of potential sequences are expressible as individual peptides, or alternatively, as a set of larger fusion proteins containing the set of degenerate sequences.

Other Modifications of *B. Fragilis* Nucleic Acids and Polypeptides

It is possible to modify the structure of an *B. fragilis* polypeptide for such purposes as increasing solubility, enhancing stability (e.g., shelf life ex vivo and resistance to proteolytic degradation in vivo). A modified *B. fragilis* protein or peptide can be produced in which the amino acid sequence has been altered, such as by amino acid substitution, deletion, or addition as described herein.

An *B. fragilis* peptide can also be modified by substitution of cysteine residues preferably with alanine, serine, threonine, leucine or glutamic acid residues to minimize dimerization via disulfide linkages. In addition, amino acid side chains of fragments of the protein of the invention can be chemically modified. Another modification is cyclization of the peptide.

In order to enhance stability and/or reactivity, an *B. fragilis* polypeptide can be modified to incorporate one or more polymorphisms in the amino acid sequence of the protein resulting from any natural allelic variation. Additionally, D-amino acids, non-natural amino acids, or non-amino acid analogs can be substituted or added to produce a modified protein within the scope of this invention. Furthermore, an *B. fragilis* polypeptide can be modified using polyethylene glycol (PEG) according to the method of A. Sehon and co-workers (Wie et al., supra) to produce a protein conjugated with PEG. In addition, PEG can be added during chemical synthesis of the protein. Other modifications of *B. fragilis* proteins include reduction/alkylation (Tarr, *Methods of Protein Microcharacterization*, J. E. Silver ed., Humana Press, Clifton N.J. 155–194 (1986)); acylation (Tarr, supra); chemical coupling to an appropriate carrier (Mishell and Shiigi, eds, *Selected Methods in Cellular Immunology*, W H Freeman, San Francisco, Calif. (1980), U.S. Pat. No. 4,939,239; or mild formalin treatment (Marsh, (1971) *Int. Arch. of Allergy and Appl. Immunol.*, 41: 199–215).

To facilitate purification and potentially increase solubility of an *B. fragilis* protein or peptide, it is possible to add an amino acid fusion moiety to the peptide backbone. For example, hexa-histidine can be added to the protein for purification by immobilized metal ion affinity chromatography (Hochuli, E. et al., (1988) *Bio/Technology*, 6: 1321–1325). In addition, to facilitate isolation of peptides free of irrelevant sequences, specific endoprotease cleavage sites can be introduced between the sequences of the fusion moiety and the peptide.

To potentially aid proper antigen processing of epitopes within an *B. fragilis* polypeptide, canonical protease sensitive sites can be engineered between regions, each comprising at least one epitope via recombinant or synthetic methods. For example, charged amino acid pairs, such as KK or RR, can be introduced between regions within a protein or fragment during recombinant construction thereof. The resulting peptide can be rendered sensitive to cleavage by cathepsin and/or other trypsin-like enzymes which would generate portions of the protein containing one or more epitopes. In addition, such charged amino acid residues can result in an increase in the solubility of the peptide.

Primary Methods for Screening Polypeptides and Analogs

Various techniques are known in the art for screening generated mutant gene products. Techniques for screening large gene libraries often include cloning the gene library into replicable expression vectors, transforming appropriate cells with the resulting library of vectors, and expressing the genes under conditions in which detection of a desired activity, e.g., in this case, binding to *B. fragilis* polypeptide or an interacting protein, facilitates relatively easy isolation of the vector encoding the gene whose product was detected. Each of the techniques described below is amenable to high through-put analysis for screening large numbers of sequences created, e.g., by random mutagenesis techniques.

Two Hybrid Systems

Two hybrid assays such as the system described below (as with the other screening methods described herein), can be used to identify polypeptides, e.g., fragments or analogs of a naturally-occurring *B. fragilis* polypeptide, e.g., of cellular proteins, or of randomly generated polypeptides which bind to an *B. fragilis* protein. (The *B. fragilis* domain is used as the bait protein and the library of variants are expressed as prey fusion proteins.) In an analogous fashion, a two hybrid assay (as with the other screening methods described herein), can be used to find polypeptides which bind an *B. fragilis* polypeptide.

Display Libraries

In one approach to screening assays, the *Bacteroides* peptides are displayed on the surface of a cell or viral particle, and the ability of particular cells or viral particles to bind an appropriate receptor protein via the displayed product is detected in a "panning assay". For example, the gene library can be cloned into the gene for a surface membrane protein of a bacterial cell, and the resulting fusion protein detected by panning (Ladner et al., WO 88/06630; Fuchs et al. (1991) *Bio/Technology* 9:1370–1371; and Goward et al. (1992) *TIBS* 18:136–140). In a similar fashion, a detectably labeled ligand can be used to score for potentially functional peptide homologs. Fluorescently labeled ligands, e.g., receptors, can be used to detect homologs which retain ligand-binding activity. The use of fluorescently labeled ligands, allows cells to be visually inspected and separated under a fluorescence microscope, or, where the morphology of the cell permits, to be separated by a fluorescence-activated cell sorter.

A gene library can be expressed as a fusion protein on the surface of a viral particle. For instance, in the filamentous phage system, foreign peptide sequences can be expressed on the surface of infectious phage, thereby conferring two significant benefits. First, since these phage can be applied to affinity matrices at concentrations well over $10^-$ phage per milliliter, a large number of phage can be screened at one time. Second, since each infectious phage displays a gene product on its surface, if a particular phage is recovered from an affinity matrix in low yield, the phage can be amplified by another round of infection. The group of almost identical *E. coli* filamentous phages, M13, fd., and f1, are most often used in phage display libraries. Either of the phage gIII or gVIII coat proteins can be used to generate fusion proteins without disrupting the ultimate packaging of the viral particle. Foreign epitopes can be expressed at the $NH_2$-terminal end of pIII and phage bearing such epitopes recovered from a large excess of phage lacking this epitope (Ladner et al. PCT publication WO 90/02909; Garrard et al., PCT publication WO 92/09690; Marks et al. (1992) *J. Biol. Chem.* 267: 16007–16010; Griffiths et al. (1993) *EMBO J.* 12:725–734; Clackson et al. (1991) *Nature* 352:624–628; and Barbas et al. (1992) *PNAS* 89:4457–4461).

A common approach uses the maltose receptor of *E. coli* (the outer membrane protein, LamB) as a peptide fusion partner (Charbit et al. (1986) *EMBO* 5, 3029–3037). Oligonucleotides have been inserted into plasmids encoding the LamB gene to produce peptides fused into one of the extracellular loops of the protein. These peptides are available for binding to ligands, e.g., to antibodies, and can elicit an immune response when the cells are administered to animals. Other cell surface proteins, e.g., OmpA (Schorr et al. (1991) *Vaccines* 91, pp. 387–392), PhoE (Agterberg, et al. (1990) *Gene* 88, 37–45), and PAL (Fuchs et al. (1991) *Bio/Tech* 9, 1369–1372), as well as large bacterial surface structures have served as vehicles for peptide display. Peptides can be fused to pilin, a protein which polymerizes to form the pilus-a conduit for interbacterial exchange of genetic information (Thiry et al. (1989) *Appl. Environ. Microbiol.* 55, 984–993). Because of its role in interacting with other cells, the pilus provides a useful support for the presentation of peptides to the extracellular environment. Another large surface structure used for peptide display is the bacterial motive organ, the flagellum. Fusion of peptides to the subunit protein flagellin offers a dense array of many peptide copies on the host cells (Kuwajima et al. (1988) *Bio/Tech.* 6, 1080–1083). Surface proteins of other bacterial species have also served as peptide fusion partners. Examples include the *Staphylococcus* protein A and the outer membrane IgA protease of *Neisseria* (Hansson et al. (1992) *J. Bacteriol.* 174, 4239–4245 and Klauser et al. (1990) *EMBO J.* 9, 1991–1999).

In the filamentous phage systems and the LamB system described above, the physical link between the peptide and its encoding DNA occurs by the containment of the DNA within a particle (cell or phage) that carries the peptide on its surface. Capturing the peptide captures the particle and the DNA within. An alternative scheme uses the DNA-binding protein LacI to form a link between peptide and DNA (Cull et al. (1992) *PNAS USA* 89:1865–1869). This system uses a plasmid containing the LacI gene with an oligonucleotide cloning site at its 3'-end. Under the controlled induction by arabinose, a LacI-peptide fusion protein is produced. This fusion retains the natural ability of LacI to bind to a short DNA sequence known as LacO operator (LacO). By installing two copies of LacO on the expression plasmid, the LacI-peptide fusion binds tightly to the plasmid that encoded it. Because the plasmids in each cell contain only a single oligonucleotide sequence and each cell expresses only a single peptide sequence, the peptides become specifically and stably associated with the DNA sequence that directed its synthesis. The cells of the library are gently lysed and the peptide-DNA complexes are exposed to a matrix of immobilized receptor to recover the complexes containing active peptides. The associated plasmid DNA is then reintroduced into cells for amplification and DNA sequencing to determine the identity of the peptide ligands. As a demonstration of the practical utility of the method, a large random library of dodecapeptides was made and selected on a monoclonal antibody raised against the opioid peptide dynorphin B. A cohort of peptides was recovered, all related by a consensus sequence corresponding to a six-residue portion of dynorphin B. (Cull et al. (1992) Proc. Natl. Acad. Sci. U.S.A. 89–1869)

This scheme, sometimes referred to as peptides-on-plasmids, differs in two important ways from the phage display methods. First, the peptides are attached to the C-terminus of the fusion protein, resulting in the display of the library members as peptides having free carboxy termini. Both of the filamentous phage coat proteins, pIII and pVIII, are anchored to the phage through their C-termini, and the guest peptides are placed into the outward-extending N-terminal domains. In some designs, the phage-displayed peptides are presented right at the amino terminus of the fusion protein. (Cwirla, et al. (1990) Proc. Natl. Acad. Sci. U.S.A. 87, 6378–6382) A second difference is the set of biological biases affecting the population of peptides actually present in the libraries. The LacI fusion molecules are confined to the cytoplasm of the host cells. The phage coat fusions are exposed briefly to the cytoplasm during translation but are rapidly secreted through the inner membrane into the periplasmic compartment, remaining anchored in the membrane by their C-terminal hydrophobic domains, with the N-termini, containing the peptides, protruding into the periplasm while awaiting assembly into phage particles. The peptides in the LacI and phage libraries may differ significantly as a result of their exposure to different proteolytic activities. The phage coat proteins require transport across the inner membrane and signal peptidase processing as a prelude to incorporation into phage. Certain peptides exert a deleterious effect on these processes and are underrepresented in the libraries (Gallop et al. (1994) J. Med. Chem. 37(9):1233–1251). These particular biases are not a factor in the LacI display system.

The number of small peptides available in recombinant random libraries is enormous. Libraries of $10^7$–$10^9$ independent clones are routinely prepared. Libraries as large as $10^{11}$ recombinants have been created, but this size approaches the practical limit for clone libraries. This limitation in library size occurs at the step of transforming the DNA containing randomized segments into the host bacterial cells. To circumvent this limitation, an in vitro system based on the display of nascent peptides in polysome complexes has recently been developed. This display library method has the potential of producing libraries 3–6 orders of magnitude larger than the currently available phage/phagemid or plasmid libraries. Furthermore, the construction of the libraries, expression of the peptides, and screening, is done in an entirely cell-free format.

In one application of this method (Gallop et al. (1994) J. Med. Chem. 37(9):1233–1251), a molecular DNA library encoding $10^{12}$ decapeptides was constructed and the library expressed in an E. coli S30 in vitro coupled transcription/translation system. Conditions were chosen to stall the ribosomes on the mRNA, causing the accumulation of a substantial proportion of the RNA in polysomes and yielding complexes containing nascent peptides still linked to their encoding RNA. The polysomes are sufficiently robust to be affinity purified on immobilized receptors in much the same way as the more conventional recombinant peptide display libraries are screened. RNA from the bound complexes is recovered, converted to cDNA, and amplified by PCR to produce a template for the next round of synthesis and screening. The polysome display method can be coupled to the phage display system. Following several rounds of screening, cDNA from the enriched pool of polysomes was cloned into a phagemid vector. This vector serves as both a peptide expression vector, displaying peptides fused to the coat proteins, and as a DNA sequencing vector for peptide identification. By expressing the polysome-derived peptides on phage, one can either continue the affinity selection procedure in this format or assay the peptides on individual clones for binding activity in a phage ELISA, or for binding specificity in a completion phage ELISA (Barret, et al. (1992) Anal. Biochem 204,357–364). To identify the sequences of the active peptides one sequences the DNA produced by the phagemid host.

Secondary Screening of Polypeptides and Analogs

The high through-put assays described above can be followed by secondary screens in order to identify further biological activities which will, e.g., allow one skilled in the art to differentiate agonists from antagonists. The type of a secondary screen used will depend on the desired activity that needs to be tested. For example, an assay can be developed in which the ability to inhibit an interaction between a protein of interest and its respective ligand can be used to identify antagonists from a group of peptide fragments isolated though one of the primary screens described above.

Therefore, methods for generating fragments and analogs and testing them for activity are known in the art. Once the core sequence of interest is identified, it is routine for one skilled in the art to obtain analogs and fragments.

Peptide Mimetics of B. Fragilis Polypeptides

The invention also provides for reduction of the protein binding domains of the subject B. fragilis polypeptides to generate mimetics, e.g. peptide or non-peptide agents. The peptide mimetics are able to disrupt binding of a polypeptide to its counter ligand, e.g., in the case of an B. fragilis polypeptide binding to a naturally occurring ligand. The critical residues of a subject B. fragilis polypeptide which are involved in molecular recognition of a polypeptide can be determined and used to generate B. fragilis-derived peptidomimetics which competitively or noncompetitively inhibit binding of the B. fragilis polypeptide with an interacting polypeptide (see, for example, European patent applications EP-412,762A and EP-B31,080A).

For example, scanning mutagenesis can be used to map the amino acid residues of a particular B. fragilis polypeptide involved in binding an interacting polypeptide, peptidomimetic compounds (e.g. diazepine or isoquinoline derivatives) can be generated which mimic those residues in binding an interacting polypeptide, and which therefore can inhibit binding of an B. fragilis polypeptide to an interacting polypeptide and thereby interfere with the function of *B. fragilis* polypeptide. For instance, non-hydrolyzable peptide analogs of such residues can be generated using benzodiazepine (e.g., see Freidinger et al. in *Peptides. Chemistry and Biology*, G. R. Marshall ed., ESCOM Publisher: Leiden, Netherlands, 1988), azepine (e.g., see Huffman et al. in *Peptides. Chemistry and Biology*, G. R. Marshall ed., ESCOM Publisher: Leiden, Netherlands, 1988), substituted gama lactam rings (Garvey et al. in *Peptides: Chemistry and Biology*, G. R. Marshall ed., ESCOM Publisher: Leiden, Netherlands, 1988), keto-methylene pseudopeptides (Ewenson et al. (1986) *J Med Chem* 29:295; and Ewenson et al. in *Peptides: Structure and Function* (Proceedings of the 9th American Peptide Symposium) Pierce Chemical Co. Rockland, Ill., 1985), b-turn dipeptide cores (Nagai et al. (1985) *Tetrahedron Lett* 26:647; and Sato et al. (1986) *J Chem Soc Perkin Trans* 1:1231), and b-aminoalcohols (Gordon et al. (1985) *Biochem Biophys Res Commun* 126:419; and et al. (1986) *Biochem Biophys Res Commun* 134:71).

Vaccine Formulations for *B. Fragilis* Nucleic Acids and Polypeptides

This invention also features vaccine compositions for protection against infection by *B. fragilis* or for treatment of *B. fragilis* infection. In one embodiment, the vaccine compositions contain one or more immunogenic components such as a surface protein from *B. fragilis*, or portion thereof, and a pharmaceutically acceptable carrier. Nucleic acids within the scope of the invention are exemplified by the nucleic acids of the invention contained in the Sequence Listing which encode *B. fragilis* surface proteins. Any nucleic acid encoding an immunogenic *B. fragilis* protein, or portion thereof, which is capable of expression in a cell, can be used in the present invention. These vaccines have therapeutic and prophylactic utilities.

One aspect of the invention provides a vaccine composition for protection against infection by *B. fragilis* which contains at least one immunogenic fragment of an *B. fragilis* protein and a pharmaceutically acceptable carrier. Preferred fragments include peptides of at least about 10 amino acid residues in length, preferably about 10–20 amino acid residues in length, and more preferably about 12–16 amino acid residues in length.

Immunogenic components of the invention can be obtained, for example, by screening polypeptides recombinantly produced from the corresponding fragment of the nucleic acid encoding the full-length *B. fragilis* protein. In addition, fragments can be chemically synthesized using techniques known in the art such as conventional Merrifield solid phase f-Moc or t-Boc chemistry.

In one embodiment, immunogenic components are identified by the ability of the peptide to stimulate T cells. Peptides which stimulate T cells, as determined by, for example, T cell proliferation or cytokine secretion are defined herein as comprising at least one T cell epitope. T cell epitopes are believed to be involved in initiation and perpetuation of the immune response to the protein allergen which is responsible for the clinical symptoms of allergy. These T cell epitopes are thought to trigger early events at the level of the T helper cell by binding to an appropriate HLA molecule on the surface of an antigen presenting cell, thereby stimulating the T cell subpopulation with the relevant T cell receptor for the epitope. These events lead to T cell proliferation, lymphokine secretion, local inflammatory reactions, recruitment of additional immune cells to the site of antigen/T cell interaction, and activation of the B cell cascade, leading to the production of antibodies. A T cell epitope is the basic element, or smallest unit of recognition by a T cell receptor, where the epitope comprises amino acids essential to receptor recognition (e.g., approximately 6 or 7 amino acid residues). Amino acid sequences which mimic those of the T cell epitopes are within the scope of this invention.

Screening immunogenic components can be accomplished using one or more of several different assays. For example, in vitro, peptide T cell stimulatory activity is assayed by contacting a peptide known or suspected of being immunogenic with an antigen presenting cell which presents appropriate MHC molecules in a T cell culture. Presentation of an immunogenic *B. fragilis* peptide in association with appropriate MHC molecules to T cells in conjunction with the necessary co-stimulation has the effect of transmitting a signal to the T cell that induces the production of increased levels of cytokines, particularly of interleukin-2 and interleukin-4. The culture supernatant can be obtained and assayed for interleukin-2 or other known cytokines. For example, any one of several conventional assays for interleukin-2 can be employed, such as the assay described in *Proc. Natl. Acad. Sci USA*, 86: 1333 (1989) the pertinent portions of which are incorporated herein by reference. A kit for an assay for the production of interferon is also available from Genzyme Corporation (Cambridge, Mass.).

Alternatively, a common assay for T cell proliferation entails measuring tritiated thymidine incorporation. The proliferation of T cells can be measured in vitro by determining the amount of $^3$H-labeled thymidine incorporated into the replicating DNA of cultured cells. Therefore, the rate of DNA synthesis and, in turn, the rate of cell division can be quantified.

Vaccine compositions of the invention containing immunogenic components (e.g., *B. fragilis* polypeptide or fragment thereof or nucleic acid encoding an *B. fragilis* polypeptide or fragment thereof) preferably include a pharmaceutically acceptable carrier. The term "pharmaceutically acceptable carrier" refers to a carrier that does not cause an allergic reaction or other untoward effect in patients to whom it is administered. Suitable pharmaceutically acceptable carriers include, for example, one or more of water, saline, phosphate buffered saline, dextrose, glycerol, ethanol and the like, as well as combinations thereof. Pharmaceutically acceptable carriers may further comprise minor amounts of auxiliary substances such as wetting or emulsifying agents, preservatives or buffers, which enhance the shelf life or effectiveness of the antibody. For vaccines of the invention containing *B. fragilis* polypeptides, the polypeptide is co-administered with a suitable adjuvant.

It will be apparent to those of skill in the art that the therapeutically effective amount of DNA or protein of this invention will depend, inter alia, upon the administration schedule, the unit dose of antibody administered, whether the protein or DNA is administered in combination with other therapeutic agents, the immune status and health of the patient, and the therapeutic activity of the particular protein or DNA.

Vaccine compositions are conventionally administered parenterally, e.g., by injection, either subcutaneously or intramuscularly. Methods for intramuscular immunization are described by Wolff et al. (1990) *Science* 247: 1465–1468 and by Sedegah et al. (1994) *Immunology* 91: 9866–9870. Other modes of administration include oral and pulmonary formulations, suppositories, and transdermal applications. Oral immunization is preferred over parenteral methods for inducing protection against infection by *B. fragilis*. Cain et. al. (1993) *Vaccine* 11: 637–642. Oral formulations include such normally employed excipients as, for example, pharmaceutical grades of mannitol, lactose, starch, magnesium stearate, sodium saccharine, cellulose, magnesium carbonate, and the like.

The vaccine compositions of the invention can include an adjuvant, including, but not limited to aluminum hydroxide; N-acetyl-muramyl-L-threonyl-D-isoglutamine (thr-MDP); N-acetyl-nor-muramyl-L-alanyl-D-isoglutamine (CGP 11637, referred to as nor-MDP); N-acetylmuramyl-L-alanyl-D-isoglutaminyl-L-alanine-2-(1'-2'-dipalmitoyl-sn-glycero-3-hydroxyphos-phoryloxy)-ethylamine (CGP 19835A, referred to a MTP-PE); RIBI, which contains three components from bacteria; monophosphoryl lipid A; trehalose dimycoloate; cell wall skeleton (MPL+TDM+CWS) in a 2% squalene/Tween 80 emulsion; and cholera toxin. Others which may be used are non-toxic derivatives of cholera toxin, including its B subunit, and/or conjugates or genetically engineered fusions of the *B. fragilis* polypeptide with cholera toxin or its B subunit, procholeragenoid, fungal polysaccharides, including schizophyllan, muramyl dipeptide, muramyl dipeptide derivatives, phorbol esters, labile toxin of *E. coli*, non-*B. fragilis* bacterial lysates, block polymers or saponins.

Other suitable delivery methods include biodegradable microcapsules or immuno-stimulating complexes (IS-COMs), cochleates, or liposomes, genetically engineered attenuated live vectors such as viruses or bacteria, and recombinant (chimeric) virus-like particles, e.g., bluetongue. The amount of adjuvant employed will depend on the type of adjuvant used. For example, when the mucosal adjuvant is cholera toxin, it is suitably used in an amount of 5 mg to 50 mg, for example 10 mg to 35 mg. When used in the form of microcapsules, the amount used will depend on the amount employed in the matrix of the microcapsule to achieve the desired dosage. The determination of this amount is within the skill of a person of ordinary skill in the art.

Carrier systems in humans may include enteric release capsules protecting the antigen from the acidic environment of the stomach, and including *B. fragilis* polypeptide in an insoluble form as fusion proteins. Suitable carriers for the vaccines of the invention are enteric coated capsules and polylactide-glycolide microspheres. Suitable diluents are 0.2 N NaHCO$_3$ and/or saline.

Vaccines of the invention can be administered as a primary prophylactic agent in adults or in children, as a secondary prevention, after successful eradication of *B. fragilis* in an infected host, or as a therapeutic agent in the aim to induce an immune response in a susceptible host to prevent infection by *B. fragilis*. The vaccines of the invention are administered in amounts readily determined by persons of ordinary skill in the art. Thus, for adults a suitable dosage will be in the range of 10 mg to 10 g, preferably 10 mg to 100 mg. A suitable dosage for adults will also be in the range of 5 mg to 500 mg. Similar dosage ranges will be applicable for children. Those skilled in the art will recognize that the optimal dose may be more or less depending upon the patient's body weight, disease, the route of administration, and other factors. Those skilled in the art will also recognize that appropriate dosage levels can be obtained based on results with known oral vaccines such as, for example, a vaccine based on an *E. coli* lysate (6 mg dose daily up to total of 540 mg) and with an enterotoxigenic *E. coli* purified antigen (4 doses of 1 mg) (Schulman et al., *J Urol.* 150:917–921 (1993); Boedecker et al., *American Gastroenterological Assoc.* 999:A-222 (1993)). The number of doses will depend upon the disease, the formulation, and efficacy data from clinical trials. Without intending any limitation as to the course of treatment, the treatment can be administered over 3 to 8 doses for a primary immunization schedule over 1 month (Boedeker, *American Gastroenterological Assoc.* 888:A-222 (1993)).

In a preferred embodiment, a vaccine composition of the invention can be based on a killed whole *E. coli* preparation with an immunogenic fragment of an *B. fragilis* protein of the invention expressed on its surface or it can be based on an *E. coli* lysate, wherein the killed *E. coli* acts as a carrier or an adjuvant.

It will be apparent to those skilled in the art that some of the vaccine compositions of the invention are useful only for preventing *B. fragilis* infection, some are useful only for treating *B. fragilis* infection, and some are useful for both preventing and treating *B. fragilis* infection. In a preferred embodiment, the vaccine composition of the invention provides protection against *B. fragilis* infection by stimulating humoral and/or cell-mediated immunity against *B. fragilis*. It should be understood that amelioration of any of the symptoms of *B. fragilis* infection is a desirable clinical goal, including a lessening of the dosage of medication used to treat *B. fragilis*-caused disease, or an increase in the production of antibodies in the serum or mucous of patients.

Antibodies Reactive with *B. Fragilis* Polypeptides

The invention also includes antibodies specifically reactive with the subject *B. fragilis* polypeptide. Anti-protein/anti-peptide antisera or monoclonal antibodies can be made by standard protocols (See, for example, *Antibodies. A Laboratory Manual* ed. by Harlow and Lane (Cold Spring Harbor Press: 1988)). A mammal such as a mouse, a hamster or rabbit can be immunized with an immunogenic form of the peptide. Techniques for conferring immunogenicity on a protein or peptide include conjugation to carriers or other techniques well known in the art. An immunogenic portion of the subject *B. fragilis* polypeptide can be administered in the presence of adjuvant. The progress of immunization can be monitored by detection of antibody titers in plasma or serum. Standard ELISA or other immunoassays can be used with the immunogen as antigen to assess the levels of antibodies.

In a preferred embodiment, the subject antibodies are immunospecific for antigenic determinants of the *B. fragilis* polypeptides of the invention, e.g. antigenic determinants of a polypeptide of the invention contained in the Sequence Listing, or a closely related human or non-human mammalian homolog (e.g., 90% homologous, more preferably at least about 95% homologous). In yet a further preferred embodiment of the invention, the anti-*B. fragilis* antibodies do not substantially cross react (i.e., react specifically) with a protein which is for example, less than 80% percent homologous to a sequence of the invention contained in the Sequence Listing. By "not substantially cross react", it is meant that the antibody has a binding affinity for a non-homologous protein which is less than 10 percent, more preferably less than 5 percent, and even more preferably less than 1 percent, of the binding affinity for a protein of the invention contained in the Sequence Listing. In a most preferred embodiment, there is no cross-reactivity between bacterial and mammalian antigens.

The term antibody as used herein is intended to include fragments thereof which are also specifically reactive with *B. fragilis* polypeptides. Antibodies can be fragmented using conventional techniques and the fragments screened for utility in the same manner as described above for whole antibodies. For example, F(ab')$_2$ fragments can be generated by treating antibody with pepsin. The resulting F(ab')$_2$ fragment can be treated to reduce disulfide bridges to produce Fab' fragments. The antibody of the invention is further intended to include bispecific and chimeric molecules having an anti-*B. fragilis* portion.

Both monoclonal and polyclonal antibodies (Ab) directed against *B. fragilis* polypeptides or *B. fragilis* polypeptide variants, and antibody fragments such as Fab' and F(ab')$_2$, can be used to block the action of *B. fragilis* polypeptide and allow the study of the role of a particular *B. fragilis* polypeptide of the invention in aberrant or unwanted intracellular signaling, as well as the normal cellular function of the *B. fragilis* and by microinjection of anti-*B. fragilis* polypeptide antibodies of the present invention.

Antibodies which specifically bind *B. fragilis* epitopes can also be used in immunohistochemical staining of tissue samples in order to evaluate the abundance and pattern of expression of *B. fragilis* antigens. Anti-*B. fragilis* polypeptide antibodies can be used diagnostically in immuno-precipitation and immuno-blotting to detect and evaluate *B. fragilis* levels in tissue or bodily fluid as part of a clinical testing procedure. Likewise, the ability to monitor *B. fragilis* polypeptide levels in an individual can allow determination of the efficacy of a given treatment regimen for an individual afflicted with such a disorder. The level of an *B. fragilis* polypeptide can be measured in cells found in bodily fluid, such as in urine samples or can be measured in tissue, such as produced by gastric biopsy. Diagnostic assays using anti-*B. fragilis* antibodies can include, for example, immunoassays designed to aid in early diagnosis of *B. fragilis* infections. The present invention can also be used as a method of detecting antibodies contained in samples from individuals infected by this bacterium using specific *B. fragilis* antigens.

Another application of anti-*B. fragilis* polypeptide antibodies of the invention is in the immunological screening of cDNA libraries constructed in expression vectors such as λgt11, λgt18–23, λZAP, and λORF8. Messenger libraries of this type, having coding sequences inserted in the correct reading frame and orientation, can produce fusion proteins. For instance, λgt11 will produce fusion proteins whose amino termini consist of β-galactosidase amino acid sequences and whose carboxy termini consist of a foreign polypeptide. Antigenic epitopes of a subject *B. fragilis* polypeptide can then be detected with antibodies, as, for example, reacting nitrocellulose filters lifted from infected plates with anti-*B. fragilis* polypeptide antibodies. Phage, scored by this assay, can then be isolated from the infected plate. Thus, the presence of *B. fragilis* gene homologs can be detected and cloned from other species, and alternate isoforms (including splicing variants) can be detected and cloned.

Kits Containing Nucleic Acids, Polypeptides or Antibodies of the Invention

The nucleic acid, polypeptides and antibodies of the invention can be combined with other reagents and articles to form kits. Kits for diagnostic purposes typically comprise the nucleic acid, polypeptides or antibodies in vials or other suitable vessels. Kits typically comprise other reagents for performing hybridization reactions, polymerase chain reactions (PCR), or for reconstitution of lyophilized components, such as aqueous media, salts, buffers, and the like. Kits may also comprise reagents for sample processing such as detergents, chaotropic salts and the like. Kits may also comprise immobilization means such as particles, supports, wells, dipsticks and the like. Kits may also comprise labeling means such as dyes, developing reagents, radioisotopes, fluorescent agents, luminescent or chemiluminescent agents, enzymes, intercalating agents and the like. With the nucleic acid and amino acid sequence information provided herein, individuals skilled in art can readily assemble kits to serve their particular purpose. Kits further can include instructions for use.

Bio Chip Technology

The nucleic acid sequence of the present invention may be used to detect *B. fragilis* or other species of *Bacteroides* acid sequence using bio chip technology. Bio chips containing arrays of nucleic acid sequence can also be used to measure expression of genes of *B. fragilis* or other species of *Bacteroides*. For example, to diagnose a patient with a *B. fragilis* or other *Bacteroides* infection, a sample from a human or animal can be used as a probe on a bio chip containing an array of nucleic acid sequence from the present invention. In addition, a sample from a disease state can be compared to a sample from a non-disease state which would help identify a gene that is up-regulated or expressed in the disease state. This would provide valuable insight as to the mechanism by which the disease manifests. Changes in gene expression can also be used to identify critical pathways involved in drug transport or metabolism, and may enable the identification of novel targets involved in virulence or host cell interactions involved in maintenance of an infection. Procedures using such techniques have been described by Brown et al., 1995, *Science* 270: 467–470.

Bio chips can also be used to monitor the genetic changes of potential therapeutic compounds including, deletions, insertions or mismatches. Once the therapeutic is added to the patient, changes to the genetic sequence can be evaluated for its efficacy. In addition, the nucleic acid sequence of the present invention can be used to determine essential genes in cell cycling. As described in Iyer et al., 1999 (*Science*, 283:83–87) genes essential in the cell cycle can be identified using bio chips. Furthermore, the present invention provides nucleic acid sequence which can be used with bio chip technology to understand regulatory networks in bacteria, measure the response to environmental signals or drugs as in drug screening, and study virulence induction. (Mons et al., 1998, *Nature Biotechnology*, 16: 45–48. Patents teaching this technology include U.S. Pat. Nos. 5,445,934, 5,744,305, and 5,800,992.

Drug Screening Assays Using *B. Fragilis* Polypeptides

By making available purified and recombinant *B. fragilis* polypeptides, the present invention provides assays which can be used to screen for drugs which are either agonists or antagonists of the normal cellular function, in this case, of the subject *B. fragilis* polypeptides, or of their role in intracellular signaling. Such inhibitors or potentiators may be useful as new therapeutic agents to combat *B. fragilis* infections in humans. A variety of assay formats will suffice and, in light of the present inventions, will be comprehended by the person skilled in the art.

In many drug screening programs which test libraries of compounds and natural extracts, high throughput assays are desirable in order to maximize the number of compounds surveyed in a given period of time. Assays which are performed in cell-free systems, such as may be derived with purified or semi-purified proteins, are often preferred as "primary" screens in that they can be generated to permit rapid development and relatively easy detection of an alteration in a molecular target which is mediated by a test compound. Moreover, the effects of cellular toxicity and/or bioavailability of the test compound can be generally ignored in the in vitro system, the assay instead being focused primarily on the effect of the drug on the molecular target as may be manifest in an alteration of binding affinity with other proteins or change in enzymatic properties of the molecular target. Accordingly, in an exemplary screening assay of the present invention, the compound of interest is contacted with an isolated and purified *B. fragilis* polypeptide.

Screening assays can be constructed in vitro with a purified *B. fragilis* polypeptide or fragment thereof, such as an *B. fragilis* polypeptide having enzymatic activity, such that the activity of the polypeptide produces a detectable reaction product. The efficacy of the compound can be assessed by generating dose response curves from data obtained using various concentrations of the test compound. Moreover, a control assay can also be performed to provide a baseline for comparison. Suitable products include those with distinctive absorption, fluorescence, or chemi-luminescence properties, for example, because detection may be easily automated. A variety of synthetic or naturally occurring compounds can be tested in the assay to identify those which inhibit or potentiate the activity of the *B. fragilis* polypeptide. Some of these active compounds may directly, or with chemical alterations to promote membrane permeability or solubility, also inhibit or potentiate the same activity (e.g., enzymatic activity) in whole, live *B. fragilis* cells.

Overexpression Assays

Overexpression assays are based on the premise that overproduction of a protein would lead to a higher level of resistance to compounds that selectively interfere with the function of that protein. Overexpression assays may be used to identify compounds that interfere with the function of virtually any type of protein, including without limitation enzymes, receptors, DNA- or RNA-binding proteins, or any proteins that are directly or indirectly involved in regulating cell growth.

Typically, two bacterial strains are constructed. One contains a single copy of the gene of interest, and a second contains several copies of the same gene. Identification of useful inhibitory compounds of this type of assay is based on a comparison of the activity of a test compound in inhibiting growth and/or viability of the two strains. The method involves constructing a nucleic acid vector that directs high level expression of a particular target nucleic acid. The vectors are then transformed into host cells in single or multiple copies to produce strains that express low to moderate and high levels of protein encoding by the target sequence (strain A and B, respectively). Nucleic acid comprising sequences encoding the target gene can, of course, be directly integrated into the host cell.

Large numbers of compounds (or crude substances which may contain active compounds) are screened for their effect on the growth of the two strains. Agents which interfere with an unrelated target equally inhibit the growth of both strains. Agents which interfere with the function of the target at high concentration should inhibit the growth of both strains. It should be possible, however, to titrate out the inhibitory effect of the compound in the overexpressing strain. That is, if the compound is affecting the particular target that is being tested, it should be possible to inhibit the growth of strain A at a concentration of the compound that allows strain B to grow.

Alternatively, a bacterial strain is constructed that contains the gene of interest under the control of an inducible promoter. Identification of useful inhibitory agents using this type of assay is based on a comparison of the activity of a test compound in inhibiting growth and/or viability of this strain under both inducing and non-inducing conditions. The method involves constructing a nucleic acid vector that directs high-level expression of a particular target nucleic acid. The vector is then transformed into host cells that are grown under both non-inducing and inducing conditions (conditions A and B, respectively).

Large numbers of compounds (or crude substances which may contain active compounds) are screened for their effect on growth under these two conditions. Agents that interfere with the function of the target should inhibit growth under both conditions. It should be possible, however, to titrate out the inhibitory effect of the compound in the overexpressing strain. That is, if the compound is affecting the particular target that is being tested, it should be possible to inhibit growth under condition A at a concentration that allows the strain to grow under condition B.

Ligand-Binding Assays

Many of the targets according to the invention have functions that have not yet been identified. Ligand-binding assays are useful to identify inhibitor compounds that interfere with the function of a particular target, even when that function is unknown. These assays are designed to detect binding of test compounds to particular targets. The detection may involve direct measurement of binding. Alternatively, indirect indications of binding may involve stabilization of protein structure or disruption of a biological function. Non-limiting examples of useful ligand-binding assays are detailed below.

A useful method for the detection and isolation of binding proteins is the Biomolecular Interaction Assay (BIAcore) system developed by Pharmacia Biosensor and described in the manufacturer's protocol (LKB Pharmacia, Sweden). The BIAcore system uses an affinity purified anti-GST antibody to immobilize GST-fusion proteins onto a sensor chip. The sensor utilizes surface plasmon resonance which is an optical phenomenon that detects changes in refractive indices. In accordance with the practice of the invention, a protein of interest is coated onto a chip and test compounds are passed over the chip. Binding is detected by a change in the refractive index (surface plasmon resonance).

A different type of ligand-binding assay involves scintillation proximity assays (SPA, described in U.S. Pat. No. 4,568,649).

Another type of ligand binding assay, also undergoing development, is based on the fact that proteins containing mitochondrial targeting signals are imported into isolated mitochondria in vitro (Hurt et al., 1985, *Embo J* 4:2061–2068; Eilers and Schatz, *Nature*, 1986, 322:228–231). In a mitochondrial import assay, expression vectors are constructed in which nucleic acids encoding particular target proteins are inserted downstream of sequences encoding mitochondrial import signals. The chimeric proteins are synthesized and tested for their ability to be imported into isolated mitochondria in the absence and presence of test compounds. A test compound that binds to the target protein should inhibit its uptake into isolated mitochondria in vitro.

Another ligand-binding assay is the yeast two-hybrid system (Fields and Song, 1989, *Nature* 340:245–246). The yeast two-hybrid system takes advantage of the properties of the GAL4 protein of the yeast *Saccharomyces cerevisiae*. The GAL4 protein is a transcriptional activator required for the expression of genes encoding enzymes of galactose utilization. This protein consists of two separable and functionally essential domains: an N-terminal domain which binds to specific DNA sequences (UAS$_G$); and a C-terminal domain containing acidic regions, which is necessary to activate transcription. The native GAL4 protein, containing both domains, is a potent activator of transcription when yeast are grown on galactose media. The N-terminal domain binds to DNA in a sequence-specific manner but is unable to activate transcription. The C-terminal domain contains the activating regions but cannot activate transcription because it fails to be localized to UAS$_G$. In the two-hybrid system, a system of two hybrid proteins containing parts of GAL4: (1) a GAL4 DNA-binding domain fused to a protein 'X' and (2) a GAL4 activation region fused to a protein 'Y'. If X and Y can form a protein—protein complex and reconstitute proximity of the GAL4 domains, transcription of a gene regulated by UAS$_G$ occurs. Creation of two hybrid proteins, each containing one of the interacting proteins X and Y, allows the activation region of UAS$_G$ to be brought to its normal site of action.

The binding assay described in Fodor et al., 1991, *Science* 251:767–773, which involves testing the binding affinity of test compounds for a plurality of defined polymers synthesized on a solid substrate, may also be useful.

Compounds which bind to the polypeptides of the invention are potentially useful as antibacterial agents for use in therapeutic compositions.

Pharmaceutical formulations suitable for antibacterial therapy comprise the antibacterial agent in conjunction with one or more biologically acceptable carriers. Suitable biologically acceptable carriers include, but are not limited to, phosphate-buffered saline, saline, deionized water, or the like. Preferred biologically acceptable carriers are physiologically or pharmaceutically acceptable carriers.

The antibacterial compositions include an antibacterial effective amount of active agent. Antibacterial effective amounts are those quantities of the antibacterial agents of the present invention that afford prophylactic protection against bacterial infections or which result in amelioration or cure of an existing bacterial infection. This antibacterial effective amount will depend upon the agent, the location and nature of the infection, and the particular host. The amount can be determined by experimentation known in the art, such as by establishing a matrix of dosages and frequencies and comparing a group of experimental units or subjects to each point in the matrix.

The antibacterial active agents or compositions can be formed into dosage unit forms, such as for example, creams, ointments, lotions, powders, liquids, tablets, capsules, suppositories, sprays, aerosols or the like. If the antibacterial composition is formulated into a dosage unit form, the dosage unit form may contain an antibacterial effective amount of active agent. Alternatively, the dosage unit form may include less than such an amount if multiple dosage unit forms or multiple dosages are to be used to administer a total dosage of the active agent. Dosage unit forms can include, in addition, one or more excipient(s), diluent(s), disintegrant(s), lubricant(s), plasticizer(s), colorant(s), dosage vehicle(s), absorption enhancer(s), stabilizer(s), bactericide(s), or the like.

For general information concerning formulations, see, e.g., Gilman et al. (eds.), 1990, *Goodman and Gilman's. The Pharmacological Basis of Therapeutics*, 8th ed., Pergamon Press; and *Remington's Pharmaceutical Sciences*, 17th ed., 1990, Mack Publishing Co., Easton, Pa.; Avis et al. (eds.), 1993, *Pharmaceutical Dosage Forms: Parenteral Medications*, Dekker, N.Y.; Lieberman et al (eds.), 1990, *Pharmaceutical Dosage Forms. Disperse Systems*, Dekker, N.Y.

The antibacterial agents and compositions of the present invention are useful for preventing or treating *B. fragilis* infections. Infection prevention methods incorporate a prophylactically effective amount of an antibacterial agent or composition. A prophylactically effective amount is an amount effective to prevent *B. fragilis* infection and will depend upon the specific bacterial strain, the agent, and the host. These amounts can be determined experimentally by methods known in the art and as described above.

*B. fragilis* infection treatment methods incorporate a therapeutically effective amount of an antibacterial agent or composition. A therapeutically effective amount is an amount sufficient to ameliorate or eliminate the infection. The prophylactically and/or therapeutically effective amounts can be administered in one administration or over repeated administrations. Therapeutic administration can be followed by prophylactic administration, once the initial bacterial infection has been resolved.

The antibacterial agents and compositions can be administered topically or systemically. Topical application is typically achieved by administration of creams, ointments, lotions, or sprays as described above. Systemic administration includes both oral and parental routes. Parental routes include, without limitation, subcutaneous, intramuscular, intraperitoneal, intravenous, transdermal, inhalation and intranasal administration.

Exemplification

Cloning and Sequencing *B. Fragilis* Genomic Sequence

This invention provides nucleotide sequences of the genome of *B. fragilis* which thus comprises a DNA sequence library of *B. fragilis* genomic DNA. The detailed description that follows provides nucleotide sequences of *B. fragilis*, and also describes how the sequences were obtained and how ORFs (Open Reading Frames) and protein-coding sequences can be identified. Also described are methods of using the disclosed *B. fragilis* sequences in methods including diagnostic and therapeutic applications. Furthermore, the library can be used as a database for identification and comparison of medically important sequences in this and other strains of *B. fragilis* as well as other species of *Bacteroides*.

Chromosomal DNA from strain 14062 of *B. fragilis* was isolated after Zymolyase digestion, sodium dodecyl sulfate lysis, potassium acetate precipitation, phenol:chloroform extraction and ethanol precipitation (Soll, D. R., T. Srikantha and S. R. Lockhart: Characterizing Developmentally Regulated Genes in *B. fragilis*. In Microbial Genome Methods. K. W. Adolph, editor. CRC Press. New York. p 17–37.). Genomic *B. fragilis* DNA was hydrodynamically sheared in an HPLC and then separated on a standard 1% agarose gel. Fractions corresponding to 2500–3000 bp in length were excised from the gel and purifed by the GeneClean procedure (Bio101, Inc.).

The purified DNA fragments were then blunt-ended using T4 DNA polymerase. The healed DNA was then ligated to unique BstXI-linker adapters (5'-GTCTTCACCACGGGG-3' and 5'-GTGGTGAAGAC-3' in 100–1000 fold molar excess). These linkers are complimentary to the BstXI-cut pGTC vector, while the overhang is not self-complimentary. Therefore, the linkers will not concatermerize nor will the cut-vector religate itself easily. The linker-adapted inserts were separated from the unincorporated linkers on a 1% agarose gel and purified using GeneClean. The linker-adapted inserts were then ligated to BstXI-cut vector to construct a "shotgun" sublclone libraries.

Only major modifications to the protocols are highlighted. Briefly, the library was then transformed into DH5α competent cells (Gibco/BRL, DH5á transformation protocol). It was assessed by plating onto antibiotic plates containing ampicillin and IPTG/Xgal. The plates were incubated overnight at 37° C. Transformants were then used for plating of clones and picking for sequencing. The cultures were grown overnight at 37° C. DNA was purified using a silica bead DNA preparation (Engelstein, 1996) method. In this manner, 25 μg of DNA was obtained per clone.

These purified DNA samples were then sequenced using primarily ABI dye-terminator chemistry. All subsequent steps were based on sequencing by ABI377 automated DNA sequencing methods. The ABI dye terminator sequence reads were run on ABI377 machines and the data was transferred to UNIX machines following lane tracking of the gels. Base calls and quality scores were determined using the program PHRED (Ewing et al., 1998, Genome Res. 8: 175–185; Ewing and Green, 1998, Genome Res. 8: 685–734). Reads were assembled using PHRAP (P. Green, Abstracts of DOE Human Genome Program Contractor-Grantee Workshop V, January 1996, p. 157) with default program parameters and quality scores. The initial assembly was done at 7.8 fold coverage and yielded 223 contigs.

Finishing can follow the initial assembly. Missing mates (sequences from clones that only gave reads from one end of the *Bacteroides* DNA inserted in the plasmid) can be identified and sequenced with ABI technology to allow the identification of additional overlapping contigs.

End-sequencing of randomly picked genomic lambda was also performed. Sequencing on a both sides was done for all lambda sequences. The lambda library backbone helped to verify the integrity of the assembly and allowed closure of some of the physical gaps. Primers for walking off the ends of contigs would be selected using pick_primer (a GTC program) near the ends of the clones to facilitate gap closure. These walks can be sequenced using the selected clones and primers. These data are then reassembled with PHRAP. Additional sequencing using PCR-generated templates and screened and/or unscreened lambda templates can be done in addition.

To identify *B. fragilis* polypeptides the complete genomic sequence of *B. fragilis* were analyzed essentially as follows: First, all possible stop-to-stop open reading frames (ORFS) greater than 180 nucleotides in all six reading frames were translated into amino acid sequences. Second, the identified ORFs were analyzed for homology to known (archeabacter, prokaryotic and eukaryotic) protein sequences. Third, the coding potential of non-homologous sequences were evaluated with the program GENEMARK™ (Borodovsky and McIninch, 1993, Comp. Chem. 17:123).

Identification, Cloning and Expression of *B. Fragilis* Nucleic Acids

Expression and purification of the *B. fragilis* polypeptides of the invention can be performed essentially as outlined below.

To facilitate the cloning, expression and purification of membrane and secreted proteins from *B. fragilis*, a gene expression system, such as the pET System (Novagen), for cloning and expression of recombinant proteins in *E. coli*, is selected. Also, a DNA sequence encoding a peptide tag, the His-Tag, is fused to the 3' end of DNA sequences of interest in order to facilitate purification of the recombinant protein products. The 3' end is selected for fusion in order to avoid alteration of any 5' terminal signal sequence.

PCR Amplification and Cloning of Nucleic Acids Containing ORF'S Encoding Enzymes Nucleic acids chosen (for example, from the nucleic acids set forth in SEQ ID NO: 1–SEQ ID NO: 5222 for cloning from the 14062 strain of *B. fragilis* are prepared for amplification cloning by polymerase chain reaction (PCR). Synthetic oligonucleotide primers specific for the 5' and 3' ends of open reading frames (ORFs) are designed and purchased from GibcoBRL Life Technologies (Gaithersburg, Md., USA). All forward primers (specific for the 5' end of the sequence) are designed to include an NcoI cloning site at the extreme 5' terminus. These primers are designed to permit initiation of protein translation at a methionine residue followed by a valine residue and the coding sequence for the remainder of the native *B. fragilis* DNA sequence. All reverse primers (specific for the 3' end of any *B. fragilis* ORF) include a EcoRI site at the extreme 5' terminus to permit cloning of each *B. fragilis* sequence into the reading frame of the pET-28b. The pET-28b vector provides sequence encoding an additional 20 carboxy-terminal amino acids including six histidine residues (at the extreme C-terminus), which comprise the His-Tag.

Genomic DNA prepared from the 14062 strain of *B. fragilis* is used as the source of template DNA for PCR amplification reactions (Current Protocols in Molecular Biology, John Wiley and Sons, Inc., F. Ausubel et al., eds., 1994). To amplify a DNA sequence containing an *B. fragilis* ORF, genomic DNA (50 nanograms) is introduced into a reaction vial containing 2 mM $MgCl_2$, 1 micromolar synthetic oligonucleotide primers (forward and reverse primers) complementary to and flanking a defined *B. fragilis* ORF, 0.2 mM of each deoxynucleotide triphosphate; dATP, dGTP, dCTP, dTTP and 2.5 units of heat stable DNA polymerase (Amplitaq, Roche Molecular Systems, Inc., Branchburg, N.J., USA) in a final volume of 100 microliters.

Upon completion of thermal cycling reactions, each sample of amplified DNA is washed and purified using the Qiaquick Spin PCR purification kit (Qiagen, Gaithersburg, Md., USA). All amplified DNA samples are subjected to digestion with the restriction endonucleases, e.g., NcoI and EcoRI (New England BioLabs, Beverly, Mass., USA)(Current Protocols in Molecular Biology, John Wiley and Sons, Inc., F. Ausubel et al., eds., 1994). DNA samples are then subjected to electrophoresis on 1.0% NuSeive (FMC Bio-Products, Rockland, Me. USA) agarose gels. DNA is visualized by exposure to ethidium bromide and long wave uv irradiation. DNA contained in slices isolated from the agarose gel is purified using the Bio 101 GeneClean Kit protocol (Bio 101 Vista, Calif., USA).

Cloning of *B. Fragilis* Nucleic Acids into an Expression Vector

The pET-28b vector is prepared for cloning by digestion with restriction endonucleases, e.g., NcoI and EcoRI (Current Protocols in Molecular Biology, John Wiley and Sons, Inc., F. Ausubel et al., eds., 1994). The pET-28a vector, which encodes a His-Tag that can be fused to the 5' end of an inserted gene, is prepared by digestion with appropriate restriction endonucleases.

Following digestion, DNA inserts are cloned (Current Protocols in Molecular Biology, John Wiley and Sons, Inc., F. Ausubel et al., eds., 1994) into the previously digested pET-28b expression vector. Products of the ligation reaction are then used to transform the BL21 strain of *E. coli* (Current Protocols in Molecular Biology, John Wiley and Sons, Inc., F. Ausubel et al., eds., 1994) as described below.

Transformation of Competent Bacteria with Recombinant Plasmids

Competent bacteria, *E coli* strain BL21 or *E. coli* strain BL21(DE3), are transformed with recombinant pET expression plasmids carrying the cloned *B. fragilis* sequences according to standard methods (Current Protocols in Molecular, John Wiley and Sons, Inc., F. Ausubel et al., eds., 1994). Briefly, 1 microliter of ligation reaction is mixed with 50 microliters of electrocompetent cells and subjected to a high voltage pulse, after which, samples are incubated in 0.45 milliliters SOC medium (0.5% yeast extract, 2.0% tryptone, 10 mM NaCl, 2.5 mM KCl, 10 mM MgCl2, 10 mM MgSO4 and 20, mM glucose) at 37° C. with shaking for 1 hour. Samples are then spread on LB agar plates containing 25 microgram/ml kanamycin sulfate for growth overnight. Transformed colonies of BL21 are then picked and analyzed to evaluate cloned inserts as described below.

Identification of Recombinant Expression Vectors with B. Fragilis Nucleic Acids

Individual BL21 clones transformed with recombinant pET-28b B. fragilis ORFs are analyzed by PCR amplification of the cloned inserts using the same forward and reverse primers, specific for each B. fragilis sequence, that were used in the original PCR amplification cloning reactions. Successful amplification verifies the integration of the B. fragilis sequences in the expression vector (Current Protocols in Molecular Biology, John Wiley and Sons, Inc., F. Ausubel et al., eds., 1994).

Isolation and Preparation of Nucleic Acids from Transformants

Individual clones of recombinant pET-28b vectors carrying properly cloned B. fragilis ORFs are picked and incubated in 5 mls of LB broth plus 25 microgram/ml kanamycin sulfate overnight. The following day plasmid DNA is isolated and purified using the Qiagen plasmid purification protocol (Qiagen Inc., Chatsworth, Calif., USA).

Expression of Recombinant B. Fragilis Sequences in E. COLI

The pET vector can be propagated in any E. coli K-12 strain e.g. HMS174, HB101, JM109, DH5, etc. for the purpose of cloning or plasmid preparation. Hosts for expression include E. coli strains containing a chromosomal copy of the gene for T7 RNA polymerase. These hosts are lysogens of bacteriophage DE3, a lambda derivative that carries the lacI gene, the lacUV5 promoter and the gene for T7 RNA polymerase. T7 RNA polymerase is induced by addition of isopropyl-B-D-thiogalactoside (IPTG), and the T7 RNA polymerase transcribes any target plasmid, such as pET-28b, carrying its gene of interest. Strains used include: BL21(DE3) (Studier, F. W., Rosenberg, A. H., Dunn, J. J., and Dubendorff, J. W. (1990) Meth. Enzymol. 185, 60–89).

To express recombinant B. fragilis sequences, 50 nanograms of plasmid DNA isolated as described above is used to transform competent BL21(DE3) bacteria as described above (provided by Novagen as part of the pET expression system kit). The lacZ gene (beta-galactosidase) is expressed in the pET-System as described for the B. fragilis recombinant constructions. Transformed cells are cultured in SOC medium for 1 hour, and the culture is then plated on LB plates containing 25 micrograms/ml kanamycin sulfate. The following day, bacterial colonies are pooled and grown in LB medium containing kanamycin sulfate (25 micrograms/ml) to an optical density at 600 nM of 0.5 to 1.0 O. D. units, at which point, 1 millimolar IPTG was added to the culture for 3 hours to induce gene expression of the B. fragilis recombinant DNA constructions.

After induction of gene expression with IPTG, bacteria are pelleted by centrifugation in a Sorvall RC-3B centrifuge at 3500×g for 15 minutes at 4° C. Pellets are resuspended in 50 milliliters of cold 10 mM Tris-HCl, pH 8.0, 0.1 M NaCl and 0.1 mM EDTA (STE buffer). Cells are then centrifuged at 2000×g for 20 min at 4° C. Wet pellets are weighed and frozen at −80° C. until ready for protein purification.

A variety of methodologies known in the art can be utilized to purify the isolated proteins. (Current Protocols in Protein Science, John Wiley and Sons, Inc., J. E. Coligan et al., eds., 1995). For example, the frozen cells may be thawed, resupended in buffer and ruptured by several passages through a small volume microfluidizer (Model M-110S, Microfluidics International Corporation, Newton, Mass.). The resultant homogenate may be centrifuged to yield a clear supernatant (crude extract) and following filtration the crude extract may be fractionated over columns. Fractions may be monitored by absorbance at $OD_{280}$ nm. and peak fractions may analyzed by SDS-PAGE The concentrations of purified protein preparations may be quantified spectrophotometrically using absorbance coefficients calculated from amino acid content (Perkins, S. J. 1986 Eur. J. Biochem. 157, 169–180). Protein concentrations are also measured by the method of Bradford, M. M. (1976) Anal. Biochem. 72, 248–254, and Lowry, O. H., Rosebrough, N., Farr, A. L. & Randall, R. J. (1951) J. Biol. Chem. 193, pages 265–275, using bovine serum albumin as a standard.

SDS-polyacrylamide gels of various concentrations may be purchased from BioRad (Hercules, Calif., USA), and stained with Coomassie blue. Molecular weight markers may include rabbit skeletal muscle myosin (200 kDa), E. coli (-galactosidase (116 kDa), rabbit muscle phosphorylase B (97.4 kDa), bovine serum albumin (66.2 kDa), ovalbumin (45 kDa), bovine carbonic anhydrase (31 kDa), soybean trypsin inhibitor (21.5 kDa), egg white lysozyme (14.4 kDa) and bovine aprotinin (6.5 kDa).

Equivalents

Those skilled in the art will recognize, or be able to ascertain using no more than routine experimentation, many equivalents to the specific embodiments and methods described herein. The specific embodiments described herein are offered by way of example only, and the invention is to limited only by the terms of the appended claims, along with the full scope of equivalents to which such claims are entitled.

TABLE 2

| ORF Name | NTID | AAID | NT Length | AA Length | Score | Probability |
| --- | --- | --- | --- | --- | --- | --- |
| 32245287_f2_2 | 1 | 5223 | 139 | 420 | 196 | 1.5e−15 |
| Protein name | | | | Locus Name | | Acc# |
| hypothetical protein jhp1211 | | | | pir:C71832 | | C71832 |
| Description | | | | | | |

-continued

| ORF Name | NTID | AAID | NT Length | AA Length | Score | Probability |
|---|---|---|---|---|---|---|
| 10020167_c1_80 | 2 | 5224 | 611 | 1836 | 706 | 1.4e−69 |

| Protein name | Locus Name | Acc# |
|---|---|---|
| glutaminase A | gp:AB029552 | AB029552 |

Description

*Aspergillus oryzae* gtaA gene for glutaminase A, complete cds.

| ORF Name | NTID | AAID | NT Length | AA Length | Score | Probability |
|---|---|---|---|---|---|---|
| 1064765_c1_89 | 3 | 5225 | 249 | 750 | 324 | 1.8e−28 |

| Protein name | Locus Name | Acc# |
|---|---|---|
| alpha-1,6-mannanase | gp:AB024331 | AB024331 |

Description

*Bacillus circulans* aman6 gene for alpha-1,6-mannanase, complete cds.

| ORF Name | NTID | AAID | NT Length | AA Length | Score | Probability |
|---|---|---|---|---|---|---|
| 10945326_f3_56 | 4 | 5226 | 481 | 1446 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 12109430_c2_116 | 5 | 5227 | 788 | 2367 | 2343 | 4.6e−243 |

| Protein name | Locus Name | Acc# |
|---|---|---|
| immunoreactive 89 kD antigen PG87 | gp:AF175722 | AF175722 |

Description

*Porphyromonas gingivalis* strain W50 immunoreactive 89 kD antigen PG87 gene, complete cds.

| ORF Name | NTID | AAID | NT Length | AA Length | Score | Probability |
|---|---|---|---|---|---|---|
| 14647327_c1_92 | 6 | 5228 | 837 | 2514 | 706 | 2.7e−76 |

| Protein name | Locus Name | Acc# |
|---|---|---|
| glutaminase A | gp:AB029552 | AB029552 |

Description

*Aspergillus oryzae* gtaA gene for glutaminase A, complete cds.

| ORF Name | NTID | AAID | NT Length | AA Length | Score | Probability |
|---|---|---|---|---|---|---|
| 19125_c1_98 | 7 | 5229 | 406 | 1221 | 760 | 2.6e−75 |

| Protein name | Locus Name | Acc# |
|---|---|---|
| putative aldose 1-epimerase | gp:SC4A7 | AL133423 |

Description

*Streptomyces coelicolor* cosmid 4A7.

-continued

| ORF Name | NTID | AAID | NT Length | AA Length | Score | Probability |
|---|---|---|---|---|---|---|
| 19536316_c2_107 | 8 | 5230 | 1085 | 3258 | 755 | 1.9e−78 |

| Protein name | | | Locus Name | | | Acc# |
|---|---|---|---|---|---|---|
| 115K outer membrane protein precursor:SusC protein | | | pir:JC6027 | | | JC6027 |

Description

| ORF Name | NTID | AAID | NT Length | AA Length | Score | Probability |
|---|---|---|---|---|---|---|
| 22455343_c1_88 | 9 | 5231 | 65 | 198 | 55 | 0.031 |

| Protein name | | | Locus Name | | | Acc# |
|---|---|---|---|---|---|---|
| | | | gp:AP000969 | | | AP000969 |

Description

*Oryza sativa* genomic DNA, chromosome 1, clone:P0011D01.

| ORF Name | NTID | AAID | NT Length | AA Length | Score | Probability |
|---|---|---|---|---|---|---|
| 22457686_c2_112 | 10 | 5232 | 724 | 2175 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 23492786_c3_124 | 11 | 5233 | 85 | 258 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 23866437_c3_134 | 12 | 5234 | 493 | 1482 | 822 | 6.9e−82 |

| Protein name | | | Locus Name | | | Acc# |
|---|---|---|---|---|---|---|
| hypothetical protein SCJ4.42c | | | pir:T37125 | | | T37125 |

Description

| ORF Name | NTID | AAID | NT Length | AA Length | Score | Probability |
|---|---|---|---|---|---|---|
| 24645308_f1_20 | 13 | 5235 | 1207 | 3624 | 741 | 5.9e−71 |

| Protein name | | | Locus Name | | | Acc# |
|---|---|---|---|---|---|---|
| hypothetical protein | | | pir:S76045 | | | S76045 |

Description

-continued

| ORF Name | NTID | AAID | NT Length | AA Length | Score | Probability |
|---|---|---|---|---|---|---|
| 24647811_c2_108 | 14 | 5236 | 619 | 1860 | 126 | 6.0e−11 |

| Protein name | | | | Locus Name | | Acc# |
|---|---|---|---|---|---|---|
| unknown | | | | gp:U96771 | | U96771 |

Description

*Prevotella bryantii* putative polygalacturonase, B-1,4-endoglucanase, and mannanase genes, complete cds; and unknown genes.

| ORF Name | NTID | AAID | NT Length | AA Length | Score | Probability |
|---|---|---|---|---|---|---|
| 26307018_c2_119 | 15 | 5237 | 427 | 1284 | 351 | 5.6e−32 |

| Protein name | | | | Locus Name | | Acc# |
|---|---|---|---|---|---|---|
| | | | | sp:YXAH_BACSU | | P42107 |

Description

HYPOTHETICAL 46.2 KD PROTEIN IN ASNH-GNTR INTERGENIC REGION

| ORF Name | NTID | AAID | NT Length | AA Length | Score | Probability |
|---|---|---|---|---|---|---|
| 29461537_c3_138 | 16 | 5238 | 158 | 477 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 3027177_c1_87 | 17 | 5239 | 336 | 1011 | 370 | 5.4e−34 |

| Protein name | | | | Locus Name | | Acc# |
|---|---|---|---|---|---|---|
| endo-arabinase | | | | gp:D85132 | | D85132 |

Description

*Bacillus subtilis* DNA for endo-arabinase, complete cds.

| ORF Name | NTID | AAID | NT Length | AA Length | Score | Probability |
|---|---|---|---|---|---|---|
| 4142127_c2_109 | 18 | 5240 | 147 | 444 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 4492168_c3_125 | 19 | 5241 | 161 | 486 | 222 | 2.3e−17 |

| Protein name | | | | Locus Name | | Acc# |
|---|---|---|---|---|---|---|
| alpha-1,6-mannanase | | | | gp:AB024331 | | AB024331 |

Description

*Bacillus circulans* aman6 gene for alpha-1,6-mannanase, complete cds.

-continued

| ORF Name | NTID | AAID | NT Length | AA Length | Score | Probability |
|---|---|---|---|---|---|---|
| 4756687_c1_86 | 20 | 5242 | 240 | 723 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 818876_c2_110 | 21 | 5243 | 142 | 429 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 12203438_c1_6 | 22 | 5244 | 420 | 1263 | 1627 | 3.4e−167 |

| Protein name | | | | Locus Name | | Acc# |
|---|---|---|---|---|---|---|
| hypothetical protein | | | | pir:JQ1020 | | JQ1020 |

Description

| ORF Name | NTID | AAID | NT Length | AA Length | Score | Probability |
|---|---|---|---|---|---|---|
| 26365816_f3_4 | 23 | 5245 | 857 | 2574 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 32631533_f1_1 | 24 | 5246 | 295 | 885 | 435 | 2.3e−48 |

| Protein name | | | | Locus Name | | Acc# |
|---|---|---|---|---|---|---|
| glucan 1,4-beta-glucosidase, :exo-1,4-beta-glucosidase | | | | pir:JC4825 | | JC4825 |

Description

| ORF Name | NTID | AAID | NT Length | AA Length | Score | Probability |
|---|---|---|---|---|---|---|
| 22275187_f1_1 | 25 | 5247 | 170 | 513 | 482 | 7.4e−46 |

| Protein name | | | | Locus Name | | Acc# |
|---|---|---|---|---|---|---|
| gluthatione peroxidase | | | | gp:LLAJ109 | | AJ000109 |

Description

*Lactococcus lactis* carB and gpo genes.

-continued

| ORF Name | NTID | AAID | NT Length | AA Length | Score | Probability |
|---|---|---|---|---|---|---|
| 24432962_f2_1 | 26 | 5248 | 91 | 273 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 31767067_f1_1 | 27 | 5249 | 294 | 885 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 14257180_f2_19 | 28 | 5250 | 493 | 1482 | 250 | 6.5e−36 |

| Protein name | | | | Locus Name | | Acc# |
|---|---|---|---|---|---|---|
| | | | | sp:ARSF_HUMAN | | P54793 |

Description

ARYLSULFATASE F PRECURSOR, (ASF)

| ORF Name | NTID | AAID | NT Length | AA Length | Score | Probability |
|---|---|---|---|---|---|---|
| 24025282_c2_75 | 29 | 5251 | 550 | 1653 | 1045 | 1.6e−105 |

| Protein name | | | | Locus Name | | Acc# |
|---|---|---|---|---|---|---|
| | | | | sp:HEXA_PORGI | | P49008 |

Description (BETA-NAHASE)

| ORF Name | NTID | AAID | NT Length | AA Length | Score | Probability |
|---|---|---|---|---|---|---|
| 24486016_f2_21 | 30 | 5252 | 980 | 2943 | 165 | 1.4e−09 |

| Protein name | | | | Locus Name | | Acc# |
|---|---|---|---|---|---|---|
| response regulator | | | | gp:SPAJ6398 | | AJ006398 |

Description

*Streptococcus pneumoniae* rr09 and hk09 genes; two component system09.

| ORF Name | NTID | AAID | NT Length | AA Length | Score | Probability |
|---|---|---|---|---|---|---|
| 25584525_f1_10 | 31 | 5253 | 786 | 2361 | 212 | 2.8e−14 |

| Protein name | | | | Locus Name | | Acc# |
|---|---|---|---|---|---|---|
| putative secreted protein | | | | gp:SCF41 | | AL117387 |

Description

*Streptomyces coelicolor* cosmid F41.

-continued

| ORF Name | NTID | AAID | NT Length | AA Length | Score | Probability |
|---|---|---|---|---|---|---|
| 26209530_c3_98 | 32 | 5254 | 535 | 1608 | 280 | 5.0e−32 |
| Protein name | | | Locus Name | | | Acc# |
| phosphonate monoester hydrolase | | | gp:BCU44852 | | | U44852 |

Description

*Burkholderia caryophylii* PG2982 phosphonate monoester hydrolase (pehA) gene, complete cds.

| ORF Name | NTID | AAID | NT Length | AA Length | Score | Probability |
|---|---|---|---|---|---|---|
| 267517_f3_30 | 33 | 5255 | 60 | 183 | | |
| Protein name | | | Locus Name | | | Acc# |

Description

NO-HIT

| ORF Name | NTID | AAID | NT Length | AA Length | Score | Probability |
|---|---|---|---|---|---|---|
| 2932812_c2_68 | 34 | 5256 | 509 | 1530 | 258 | 1.4e−34 |
| Protein name | | | Locus Name | | | Acc# |
| | | | sp:ARSE_HUMAN | | | P51690 |

Description

ARYLSULFATASE E PRECURSOR, (ASE)

| ORF Name | NTID | AAID | NT Length | AA Length | Score | Probability |
|---|---|---|---|---|---|---|
| 3020203_c2_67 | 35 | 5257 | 423 | 1272 | 666 | 2.e3−65 |
| Protein name | | | Locus Name | | | Acc# |
| | | | sp:HEXA_PORGI | | | P49008 |

Description (BETA-NAHASE)

| ORF Name | NTID | AAID | NT Length | AA Length | Score | Probability |
|---|---|---|---|---|---|---|
| 3949012_c2_69 | 36 | 5258 | 487 | 1464 | 726 | 1.0e−71 |
| Protein name | | | Locus Name | | | Acc# |
| | | | sp:MODF_ECOLI | | | P31060 |

Description

PROTEIN PHRA)

| ORF Name | NTID | AAID | NT Length | AA Length | Score | Probability |
|---|---|---|---|---|---|---|
| 4726588_c3_86 | 37 | 5259 | 370 | 1113 | 1233 | 1.9e−125 |
| Protein name | | | Locus Name | | | Acc# |
| hypothetical protein b2097 | | | pir:H64976 | | | H64976 |

Description

-continued

| ORF Name | NTID | AAID | NT Length | AA Length | Score | Probability |
|---|---|---|---|---|---|---|
| 5273452_c1_61 | 38 | 5260 | 248 | 747 | 783 | 9.4e−78 |

| Protein name | Locus Name | Acc# |
|---|---|---|
| | sp:PMG1_ECOLI | P31217 |

Description (PGAM 1) (BPG-DEPENDENT PGAM 1)

| ORF Name | NTID | AAID | NT Length | AA Length | Score | Probability |
|---|---|---|---|---|---|---|
| 10569587_c1_59 | 39 | 5261 | 768 | 2307 | 924 | 1.1e−92 |

| Protein name | Locus Name | Acc# |
|---|---|---|
| melibiase | gp:TEMELA | Y08557 |

Description

T. ethanolicus melA and lacA genes.

| ORF Name | NTID | AAID | NT Length | AA Length | Score | Probability |
|---|---|---|---|---|---|---|
| 1369077_f3_49 | 40 | 5262 | 405 | 1218 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 15631576_c1_74 | 41 | 5263 | 400 | 1203 | 111 | 0.0016 |

| Protein name | Locus Name | Acc# |
|---|---|---|
| cytochrome-c oxidase, chain III | pir:S36954 | S36954 |

Description

| ORF Name | NTID | AAID | NT Length | AA Length | Score | Probability |
|---|---|---|---|---|---|---|
| 16532750_c2_104 | 42 | 5264 | 174 | 525 | 140 | 3.5e−08 |

| Protein name | Locus Name | Acc# |
|---|---|---|
| F14N23.29 | gp:AC005489 | AC005489 |

Description

Genomic sequence for *Arabidopsis thaliana* BAC F14N23 from Chromosome 1, complete sequence.

| ORF Name | NTID | AAID | NT Length | AA Length | Score | Probability |
|---|---|---|---|---|---|---|
| 1682842_f1_5 | 43 | 5265 | 422 | 1269 | 593 | 1.3e−57 |

| Protein name | Locus Name | Acc# |
|---|---|---|
| N utilization substance protein A | pir:H72213 | H72213 |

Description

-continued

| ORF Name | NTID | AAID | NT Length | AA Length | Score | Probability |
|---|---|---|---|---|---|---|
| 1935126_f3_53 | 44 | 5266 | 284 | 855 | 820 | 1.1e−81 |

| Protein name | Locus Name | Acc# |
|---|---|---|
| | sp:ABCX_CYAPA | P48255 |

Description

PROBABLE ATP-DEPENDENT TRANSPORTER YCF16

| ORF Name | NTID | AAID | NT Length | AA Length | Score | Probability |
|---|---|---|---|---|---|---|
| 20214450_f1_7 | 45 | 5267 | 64 | 195 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 2054635_f2_34 | 46 | 5268 | 115 | 348 | 353 | 3.4e−32 |

| Protein name | Locus Name | Acc# |
|---|---|---|
| hypothetical protein b0866 | pir:B64825 | B64825 |

Description

| ORF Name | NTID | AAID | NT Length | AA Length | Score | Probability |
|---|---|---|---|---|---|---|
| 20724002_c1_63 | 47 | 5269 | 553 | 1662 | 742 | 2.1e−73 |

| Protein name | Locus Name | Acc# |
|---|---|---|
| probable secreted alpha-galactosidase | pir:T36472 | T36472 |

Description

| ORF Name | NTID | AAID | NT Length | AA Length | Score | Probability |
|---|---|---|---|---|---|---|
| 22519677_f1_3 | 48 | 5279 | 449 | 1350 | 1532 | 4.0e−157 |

| Protein name | Locus Name | Acc# |
|---|---|---|
| L-fucose permease | gp:AF137263 | AF137263 |

Description

Bacteroides thetaiotaomicron 30S ribosomal protein S16-like protein, fucose gene cluster, and RNA polymerase sigma factor SigZ-like protein (sigZ) genes, complete cds.

| ORF Name | NTID | AAID | NT Length | AA Length | Score | Probability |
|---|---|---|---|---|---|---|
| 22917183_c1_62 | 49 | 5271 | 573 | 1722 | 297 | 9.3e−23 |

| Protein name | Locus Name | Acc# |
|---|---|---|
| receptor antigen (RagA) | gp:PGI130872 | AJ130872 |

Description

*Porphyromonas gingivalis* W50 receptor antigen (rag) locus encoding a major immunodominant 55 kDa antigen.

-continued

| ORF Name | NTID | AAID | NT Length | AA Length | Score | Probability |
|---|---|---|---|---|---|---|
| 23679512_c1_61 | 50 | 5272 | 555 | 1668 | 432 | 7.7e−42 |

| Protein name | Locus Name | Acc# |
|---|---|---|
| 115K outer membrane protein precursor:SusC protein | pir:JC6027 | JC6027 |

Description

| ORF Name | NTID | AAID | NT Length | AA Length | Score | Probability |
|---|---|---|---|---|---|---|
| 24490677_c3_119 | 51 | 5273 | 136 | 411 | 111 | 1.6e−06 |

| Protein name | Locus Name | Acc# |
|---|---|---|
| probable sigK protein | pir:F70830 | F70830 |

Description

| ORF Name | NTID | AAID | NT Length | AA Length | Score | Probability |
|---|---|---|---|---|---|---|
| 24640927_c3_121 | 52 | 5274 | 616 | 1851 | 116 | 0.00016 |

| Protein name | Locus Name | Acc# |
|---|---|---|
| unknown | gp:U96771 | U96771 |

Description

*Prevotella bryantii* putative polygalacturonase, B-1,4-endoglucanase, and mannanase genes, complete cds; and unknown genes.

| ORF Name | NTID | AAID | NT Length | AA Length | Score | Probability |
|---|---|---|---|---|---|---|
| 24803457_c1_65 | 53 | 5275 | 112 | 339 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 25963692_f2_28 | 54 | 5276 | 377 | 1134 | 123 | 0.00063 |

| Protein name | Locus Name | Acc# |
|---|---|---|
| | sp:TRHY_RABIT | P37709 |

Description

TRICHOHYALIN

| ORF Name | NTID | AAID | NT Length | AA Length | Score | Probability |
|---|---|---|---|---|---|---|
| 26212805_f2_29 | 55 | 5277 | 156 | 471 | 119 | 2.2e−07 |

| Protein name | Locus Name | Acc# |
|---|---|---|
| | sp:YHBC_ECOLI | P03843 |

Description

HYPOTHETICAL 16.8 KD PROTEIN IN NUSA-METY INTERGENIC REGION

-continued

| ORF Name | NTID | AAID | NT Length | AA Length | Score | Probability |
|---|---|---|---|---|---|---|
| 26364056_f2_31 | 56 | 5278 | 521 | 1566 | 1803 | 7.7e−186 |

| Protein name | Locus Name | Acc# |
|---|---|---|
| | sp:Y074_SYNY3 | Q55790 |

Description

HYPOTHETICAL 52.8 KD PROTEIN SLR0074

| ORF Name | NTID | AAID | NT Length | AA Length | Score | Probability |
|---|---|---|---|---|---|---|
| 29480306_f3_51 | 57 | 5279 | 81 | 246 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 30578126_f1_4 | 58 | 5280 | 446 | 1341 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 31663925_f3_50 | 59 | 5281 | 89 | 270 | 76 | 0.0077 |

| Protein name | Locus Name | Acc# |
|---|---|---|
| probable serine proteinase | pir:T36552 | T36552 |

Description

| ORF Name | NTID | AAID | NT Length | AA Length | Score | Probability |
|---|---|---|---|---|---|---|
| 33242938_f2_33 | 60 | 5282 | 456 | 1371 | 433 | 1.1e−40 |

| Protein name | Locus Name | Acc# |
|---|---|---|
| | sp:Y076_SYNY3 | Q55792 |

Description

HYPOTHETICAL 50.0 KD PROTEIN SLR0076

| ORF Name | NTID | AAID | NT Length | AA Length | Score | Probability |
|---|---|---|---|---|---|---|
| 33448342_f1_8 | 61 | 5283 | 253 | 762 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 35442313_f1_1 | 62 | 5284 | 292 | 879 | 864 | 2.4e−86 |

| Protein name | Locus Name | Acc# |
|---|---|---|
| | sp:FUCO_ECOLI | P11549 |

Description

LACTALDEHYDE REDUCTASE, (PROPANEDIOL OXIDOREDUCTASE)

| ORF Name | NTID | AAID | NT Length | AA Length | Score | Probability |
|---|---|---|---|---|---|---|
| 3942813_f3_47 | 63 | 5285 | 215 | 648 | 1026 | 1.7e−103 |

| Protein name | Locus Name | Acc# |
|---|---|---|
| L-fuculose-1-phosphate aldolase | gp:AF137263 | AF137263 |

Description

Bacteroides thetaiotaomicron 30S ribosomal protein S16-like protein, fucose gene cluster, and RNA polymerase sigma factor SigZ-like protein (sigZ) genes, complete cds.

| ORF Name | NTID | AAID | NT Length | AA Length | Score | Probability |
|---|---|---|---|---|---|---|
| 4001515_c1_60 | 64 | 5286 | 388 | 1167 | 135 | 3.7e−06 |

| Protein name | Locus Name | Acc# |
|---|---|---|
| transmemberane sensor | gp:AF051691 | AF051691 |

Description

*Pseudomonas aeruginosa* stress factor A (psfA), ECF sigma factor (fiuI), transmembrane sensor (fiuR), and hydroxamate-type ferrisiderophore receptor (fiuA) genes, complete cds.

| ORF Name | NTID | AAID | NT Length | AA Length | Score | Probability |
|---|---|---|---|---|---|---|
| 4196001_f2_26 | 65 | 5287 | 488 | 1467 | 1748 | 5.2e−180 |

| Protein name | Locus Name | Acc# |
|---|---|---|
| L-fuculose kinase | gp:AF137263 | AF137263 |

Description

Bacteroides thetaiotaomicron 30S ribosomal protein S16-like protein, fucose gene cluster, and RNA polymerase sigma factor SigZ-like protein (sigZ) genes, complete cds.

| ORF Name | NTID | AAID | NT Length | AA Length | Score | Probability |
|---|---|---|---|---|---|---|
| 5197137_f1_6 | 66 | 5288 | 1016 | 3051 | 1669 | 1.2e−171 |

| Protein name | Locus Name | Acc# |
|---|---|---|
| Initiation factor IF2-alpha | gp:ECAJ2540 | AJ002540 |

Description

*Escherichia coli* (strain EcoAU9307) infB gene encoding translational initiation factor IF2.

-continued

| ORF Name | NTID | AAID | NT Length | AA Length | Score | Probability |
|---|---|---|---|---|---|---|
| 5366453_f1_9 | 67 | 5289 | 416 | 1251 | 1106 | 5.5e−112 |

| Protein name | Locus Name | Acc# |
|---|---|---|
| nifS-like protein | gp:MLCB22 | Z98741 |

Description

Mycobacterium leprae cosmid B22.

| ORF Name | NTID | AAID | NT Length | AA Length | Score | Probability |
|---|---|---|---|---|---|---|
| 6252033_f2_27 | 68 | 5290 | 67 | 204 | 259 | 8.1e−22 |

| Protein name | Locus Name | Acc# |
|---|---|---|
| L-fucose permease | gp:AF137263 | AF137263 |

Description

Bacteroides thetaiotaomicron 30S ribosomal protein S16-like protein, fucose gene cluster, and RNA polymerase sigma factor SigZ-like protein (sigZ) genes, complete cds.

| ORF Name | NTID | AAID | NT Length | AA Length | Score | Probability |
|---|---|---|---|---|---|---|
| 10742010_c1_61 | 69 | 5291 | 695 | 2088 | 633 | 7.3e−62 |

| Protein name | Locus Name | Acc# |
|---|---|---|
| | sp:PFLD_ECOLI | P32674 |

Description

FORMATE ACETYLTRANSFERASE 2, (PYRUVATE FORMATE-LYASE 2)

| ORF Name | NTID | AAID | NT Length | AA Length | Score | Probability |
|---|---|---|---|---|---|---|
| 13913887_c2_82 | 70 | 5292 | 694 | 2085 | 564 | 2.7e−74 |

| Protein name | Locus Name | Acc# |
|---|---|---|
| hypothetical protein TM0280 | pir:F72395 | F72395 |

Description

| ORF Name | NTID | AAID | NT Length | AA Length | Score | Probability |
|---|---|---|---|---|---|---|
| 15660937_c3_108 | 71 | 5293 | 260 | 783 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 20734637_c2_80 | 72 | 5294 | 263 | 792 | 306 | 3.9e−45 |

| Protein name | Locus Name | Acc# |
|---|---|---|
| probable pyruvate formate-lyase activating enzyme, pflC homolog | pir:A69431 | A69431 |

Description

-continued

| ORF Name | NTID | AAID | NT Length | AA Length | Score | Probability |
|---|---|---|---|---|---|---|
| 21516933_f1_15 | 73 | 5295 | 76 | 231 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 22461007_f3_37 | 74 | 5296 | 235 | 708 | 241 | 2.5e−20 |

| Protein name | | | | Locus Name | | Acc# |
|---|---|---|---|---|---|---|
| probable competence protein ComF | | | | pir:F75402 | | F75402 |

Description

| ORF Name | NTID | AAID | NT Length | AA Length | Score | Probability |
|---|---|---|---|---|---|---|
| 23437627_f1_1 | 75 | 5297 | 88 | 267 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 29350677_c2_79 | 76 | 5298 | 1368 | 4107 | 468 | 1.7e−40 |

| Protein name | | | | Locus Name | | Acc# |
|---|---|---|---|---|---|---|
| bZIP histidine kinase | | | | gp:PPUY18245 | | Y18245 |

Description

*Pseudomonas putida* todX, todF, todC1, todC2, todB, todA, todD, todE, todG, todI, todH, todS, todT genes.

| ORF Name | NTID | AAID | NT Length | AA Length | Score | Probability |
|---|---|---|---|---|---|---|
| 30573761_f1_4 | 77 | 5299 | 69 | 210 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 36225337_f2_19 | 78 | 5300 | 382 | 1149 | | |

| Protein name | | | | Locus Name | | Acc# |
|---|---|---|---|---|---|---|

Description

NO-HIT

-continued

| ORF Name | NTID | AAID | NT Length | AA Length | Score | Probability |
|---|---|---|---|---|---|---|
| 36585962_f3_35 | 79 | 5301 | 418 | 1257 | 722 | 2.7e−71 |
| Protein name | | | Locus Name | | | Acc# |
| alpha galactosidase precursor | | | gp:AF061331 | | | AF061331 |

Description

Saccharopolyspora erythraea alpha galactosidase precursor (melA) gene, complete cds.

| ORF Name | NTID | AAID | NT Length | AA Length | Score | Probability |
|---|---|---|---|---|---|---|
| 3940877_c1_67 | 80 | 5302 | 96 | 291 | 163 | 4.7e−12 |
| Protein name | | | Locus Name | | | Acc# |
| | | | sp:YCNE_BACSU | | | P94425 |

Description

HYPOTHETICAL 10.9 KD PROTEIN IN PHRC-GDH INTERGENIC REGION

| ORF Name | NTID | AAID | NT Length | AA Length | Score | Probability |
|---|---|---|---|---|---|---|
| 4094627_f1_17 | 81 | 5303 | 1060 | 3183 | 879 | 6.3e−88 |
| Protein name | | | Locus Name | | | Acc# |
| 115K outer membrane protein precursor:SusC protein | | | pir:JC6027 | | | JC6027 |

Description

| ORF Name | NTID | AAID | NT Length | AA Length | Score | Probability |
|---|---|---|---|---|---|---|
| 4101507_c3_101 | 82 | 5304 | 382 | 1149 | 842 | 5.2e−84 |
| Protein name | | | Locus Name | | | Acc# |
| putative aldose 1-epimerase | | | gp:SC4A7 | | | AL133423 |

Description

*Streptomyces coelicolor* cosmid 4A7.

| ORF Name | NTID | AAID | NT Length | AA Length | Score | Probability |
|---|---|---|---|---|---|---|
| 4103812_f2_21 | 83 | 5305 | 271 | 816 | 360 | 6.2e−33 |
| Protein name | | | Locus Name | | | Acc# |
| | | | sp:SUHB_ECOLI | | | |

Description

EXTRAGENIC SUPPRESSOR PROTEIN SUHB

| ORF Name | NTID | AAID | NT Length | AA Length | Score | Probability |
|---|---|---|---|---|---|---|
| 4422768_f1_18 | 84 | 5306 | 95 | 288 | | |
| Protein name | | | Locus Name | | | Acc# |

Description

NO-HIT

-continued

| ORF Name | NTID | AAID | NT Length | AA Length | Score | Probability |
|---|---|---|---|---|---|---|
| 4534660_c1_62 | 85 | 5307 | 443 | 1332 | 620 | 5.5e−78 |

| Protein name | Locus Name | Acc# |
|---|---|---|
| | sp:XYLE_ECOLI | P09098 |

Description

D-XYLOSE-PROTON SYMPORTER (D-XYLOSE TRANSPORTER)

| ORF Name | NTID | AAID | NT Length | AA Length | Score | Probability |
|---|---|---|---|---|---|---|
| 4799033_f2_30 | 86 | 5308 | 65 | 198 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 10820130_c1_218 | 87 | 5309 | 68 | 207 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 11723437_c3_354 | 88 | 5310 | 79 | 240 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 1207152_c3_351 | 89 | 5311 | 162 | 489 | 217 | 8.9e−18 |

| Protein name | Locus Name | Acc# |
|---|---|---|
| unknown | gp:AF125164 | AF125164 |

Description

*Bacteroides fragilis* 638R polysaccharide B (PS B2) biosynthesis locus, complete sequence; and unknown genes.

| ORF Name | NTID | AAID | NT Length | AA Length | Score | Probability |
|---|---|---|---|---|---|---|
| 12754816_f2_114 | 90 | 5312 | 209 | 630 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 14296885_c1_248 | 91 | 5313 | 200 | 603 | 260 | 2.5e−22 |

| Protein name | Locus Name | Acc# |
|---|---|---|
| conserved hypothetical protein AF0781 | pir:E69347 | E69347 |

Description

| ORF Name | NTID | AAID | NT Length | AA Length | Score | Probability |
|---|---|---|---|---|---|---|
| 14626317_f1_52 | 92 | 5314 | 640 | 1923 | 736 | 1.0e−78 |

| Protein name | Locus Name | Acc# |
|---|---|---|
| | gp:ECU89166 | U89166 |

Description

Eikenella corrodens lysine decarboxylase (ECORLD) gene, complete cds.

| ORF Name | NTID | AAID | NT Length | AA Length | Score | Probability |
|---|---|---|---|---|---|---|
| 14648562_f2_116 | 93 | 5315 | 579 | 1740 | 889 | 5.5e−89 |

| Protein name | Locus Name | Acc# |
|---|---|---|
| single-strand DNA-specific exonnuclease homolog yrvE | pir:H69980 | H69980 |

Description

| ORF Name | NTID | AAID | NT Length | AA Length | Score | Probability |
|---|---|---|---|---|---|---|
| 15735882_c1_208 | 94 | 5316 | 400 | 1203 | 696 | 1.5e−68 |

| Protein name | Locus Name | Acc# |
|---|---|---|
| renin-binding protein-related protein:protein slr1975:protein slr1975 | pir:S75649 | S75649 |

Description

| ORF Name | NTID | AAID | NT Length | AA Length | Score | Probability |
|---|---|---|---|---|---|---|
| 16016075_c2_288 | 95 | 5317 | 85 | 258 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 16616302_f3_197 | 96 | 5318 | 439 | 1320 | 1138 | 2.3e−115 |

| Protein name | Locus Name | Acc# |
|---|---|---|
| coenzyme F390 synthetase (ftsA-3) homolog | pir:D69501 | D69501 |

Description

-continued

| ORF Name | NTID | AAID | NT Length | AA Length | Score | Probability |
|---|---|---|---|---|---|---|
| 16835312_f1_34 | 97 | 5319 | 279 | 840 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 192693_c2_289 | 98 | 5320 | 211 | 636 | 236 | 1.4e−19 |

| Protein name | | | | Locus Name | | Acc# |
|---|---|---|---|---|---|---|
| | | | | sp:YHCG_ECOLI | | P45423 |

Description

HYPOTHETICAL 43.3 KD PROTEIN IN GLTF-NANT INTERGENIC REGION (O375)

| ORF Name | NTID | AAID | NT Length | AA Length | Score | Probability |
|---|---|---|---|---|---|---|
| 19535652_c3_316 | 99 | 5321 | 640 | 1923 | 940 | 2.2e−94 |

| Protein name | | | | Locus Name | | Acc# |
|---|---|---|---|---|---|---|
| putative epimerase/dehydratase WbiI | | | | gp:AF064070 | | AF064070 |

Description

Burkholderia pseudomallei putative dihydroorotase (pyrC) gene, partial cds; putative 1-acyl-sn-glycerol-3-phosphateacyltransferase (plsC), putative diadenosine tetraphosphatase(apaH), complete cds; type II O-antigen biosynthesis gene cluster, complete sequence; putative undecaprenyl phosphate N-acetylglucosaminyl transferase, and putative

| ORF Name | NTID | AAID | NT Length | AA Length | Score | Probability |
|---|---|---|---|---|---|---|
| 2031552_c2_298 | 100 | 5322 | 101 | 306 | 74 | 0.013 |

| Protein name | | | | Locus Name | | Acc# |
|---|---|---|---|---|---|---|
| | | | | sp:NU3M_RAT | | P05506 |

Description

NADH-UBIQUINONE OXIDOREDUCTASE CHAIN 3,

| ORF Name | NTID | AAID | NT Length | AA Length | Score | Probability |
|---|---|---|---|---|---|---|
| 20516500_c2_304 | 101 | 5323 | 705 | 2118 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 211687_c2_299 | 102 | 5324 | 461 | 1386 | 309 | 2.0e−27 |

| Protein name | | | | Locus Name | | Acc# |
|---|---|---|---|---|---|---|
| Cap8K | | | | gp:SAU73374 | | U73374 |

Description

*Staphylococcus aureus* type B capsule genes, cap8A, cap8B, cap8C, cap8D, cap8E, cap8F, cap8G, cap8H, cap8I, cap8J, cap8K, cap8L, cap8M, cap8N, cap8O, cap8P, complete cds.

| ORF Name | NTID | AAID | NT Length | AA Length | Score | Probability |
|---|---|---|---|---|---|---|
| 2117305_c3_317 | 103 | 5325 | 856 | 2571 | 464 | 2.7e−56 |
| Protein name | | | | Locus Name | | Acc# |
| otnA protein | | | | pir:S70958 | | S70958 |
| Description | | | | | | |

| ORF Name | NTID | AAID | NT Length | AA Length | Score | Probability |
|---|---|---|---|---|---|---|
| 21485952_c1_244 | 104 | 5326 | 965 | 2898 | 821 | 1.0e−120 |
| Protein name | | | | Locus Name | | Acc# |
| | | | | sp:YDIJ_ECOLI | | P77748 |
| Description | | | | | | |
| HYPOTHETICAL 113.2 KD PROTEIN IN LPP-AROD INTERGENIC REGION | | | | | | |

| ORF Name | NTID | AAID | NT Length | AA Length | Score | Probability |
|---|---|---|---|---|---|---|
| 21500933_f1_41 | 105 | 5327 | 1084 | 3255 | | |
| Protein name | | | | Locus Name | | Acc# |
| Description | | | | | | |
| NO-HIT | | | | | | |

| ORF Name | NTID | AAID | NT Length | AA Length | Score | Probability |
|---|---|---|---|---|---|---|
| 22345000_f2_88 | 106 | 5328 | 88 | 267 | | |
| Protein name | | | | Locus Name | | Acc# |
| Description | | | | | | |
| NO-HIT | | | | | | |

| ORF Name | NTID | AAID | NT Length | AA Length | Score | Probability |
|---|---|---|---|---|---|---|
| 22551562_f1_48 | 107 | 5329 | 143 | 432 | | |
| Protein name | | | | Locus Name | | Acc# |
| Description | | | | | | |
| NO-HIT | | | | | | |

| ORF Name | NTID | AAID | NT Length | AA Length | Score | Probability |
|---|---|---|---|---|---|---|
| 23546952_f2_106 | 108 | 5330 | 291 | 876 | | |
| Protein name | | | | Locus Name | | Acc# |
| Description | | | | | | |
| NO-HIT | | | | | | |

| ORF Name | NTID | AAID | NT Length | AA Length | Score | Probability |
|---|---|---|---|---|---|---|
| 23567187_f2_102 | 109 | 5331 | 109 | 330 | | |
| Protein name | | | | Locus Name | | Acc# |
| Description | | | | | | |
| NO-HIT | | | | | | |

-continued

| ORF Name | NTID | AAID | NT Length | AA Length | Score | Probability |
|---|---|---|---|---|---|---|
| 23609457_f1_27 | 110 | 5332 | 64 | 195 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 23633592_c1_237 | 111 | 5333 | 64 | 195 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24103388_f1_71 | 112 | 5334 | 531 | 1596 | 831 | 7.7e−83 |

| Protein name | | | | Locus Name | | Acc# |
|---|---|---|---|---|---|---|
| indolepyruvate oxidoreductase, alpha subunit | | | | pir:G69114 | | G69114 |

Description

| ORF Name | NTID | AAID | NT Length | AA Length | Score | Probability |
|---|---|---|---|---|---|---|
| 24303127_f1_33 | 113 | 5335 | 142 | 429 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24318802_f3_187 | 114 | 5336 | 410 | 1233 | 490 | 1.0e−46 |

| Protein name | | | | Locus Name | | Acc# |
|---|---|---|---|---|---|---|
| | | | | sp:XYLR_ANATH | | Q44406 |

Description

XYLOSE REPRESSOR

| ORF Name | NTID | AAID | NT Length | AA Length | Score | Probability |
|---|---|---|---|---|---|---|
| 24402177_f2_103 | 115 | 5337 | 94 | 285 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 24415908_f1_72 | 116 | 5338 | 195 | 588 | 310 | 1.2e−27 |

| Protein name | Locus Name | Acc# |
|---|---|---|
| indolepyruvate ferredoxin oxidoreductase, subunit beta (iorB) homolog | pir:E69503 | E69503 |

Description

| ORF Name | NTID | AAID | NT Length | AA Length | Score | Probability |
|---|---|---|---|---|---|---|
| 24415930_c1_239 | 117 | 5339 | 322 | 969 | 937 | 4.5e−94 |

| Protein name | Locus Name | Acc# |
|---|---|---|
| WbpB | gp:PAU50396 | U50396 |

Description

*Pseudomonas aeruginosa* Wzz (Rol) (wzz (rol)) gene, partial cds, WbpA (wbpB), WbpB (wbpB), WbpC (wbpC), WbpD (wbpD), WbpE (wbpE), Wzy (Rfc) (wzy (rfc)), Wzx (wzx), HisH (hisH), HisF (hisF), WbpG (wbpG), WbpH (wbpH), WbpI (wbpI), WbpJ (wbpJ), WbpK (wbpK), WbpL (wbpL), WbpM (wbpM) and WbpN (wbpN) genes, complete cds, and UvrB (uvrB) gene, partial cds.

| ORF Name | NTID | AAID | NT Length | AA Length | Score | Probability |
|---|---|---|---|---|---|---|
| 24426337_c1_216 | 118 | 5340 | 89 | 270 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24640875_c1_245 | 119 | 5341 | 376 | 1131 | 1914 | 1.3e−197 |

| Protein name | Locus Name | Acc# |
|---|---|---|
| putative aminotransferase | gp:AF125164 | AF125164 |

Description

*Bacteroides fragilis* 638R polysaccharide B (PS B2) biosynthesislocus, complete sequence; and unknown genes.

| ORF Name | NTID | AAID | NT Length | AA Length | Score | Probability |
|---|---|---|---|---|---|---|
| 24651562_f1_68 | 120 | 5342 | 522 | 1569 | 318 | 3.1e−25 |

| Protein name | Locus Name | Acc# |
|---|---|---|
| surface antigen BspA | pir:T31094 | T31094 |

Description

| ORF Name | NTID | AAID | NT Length | AA Length | Score | Probability |
|---|---|---|---|---|---|---|
| 24806502_c1_249 | 121 | 5343 | 325 | 978 | 581 | 2.4e−56 |

| Protein name | Locus Name | Acc# |
|---|---|---|
| | sp:FMT_BACSU | |

Description

METHIONYL-TRNA FORMYLTRANSFERASE,

-continued

| ORF Name | NTID | AAID | NT Length | AA Length | Score | Probability |
|---|---|---|---|---|---|---|
| 25421942_c1_207 | 122 | 5344 | 181 | 546 | 152 | 6.9e−11 |
| Protein name | | | Locus Name | | | Acc# |
| unknown | | | gp:AF048749 | | | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 25429812_f3_171 | 123 | 5345 | 341 | 1026 | 111 | 0.0022 |
| Protein name | | | Locus Name | | | Acc# |
| | | | sp:Y973_METJA | | | Q58383 |

Description

HYPOTHETICAL PROTEIN MJ0973

| ORF Name | NTID | AAID | NT Length | AA Length | Score | Probability |
|---|---|---|---|---|---|---|
| 25583577_c3_356 | 124 | 5346 | 393 | 1182 | 172 | 3.4e−10 |
| Protein name | | | Locus Name | | | Acc# |
| Cap5I | | | gp:SAU81973 | | | U81973 |

Description

*Staphylococcus aureus* capsule gene cluster Cap5A through Cap5P genes, complete cds.

| ORF Name | NTID | AAID | NT Length | AA Length | Score | Probability |
|---|---|---|---|---|---|---|
| 25667592_c3_363 | 125 | 5347 | 606 | 1821 | 537 | 4.0e−55 |
| Protein name | | | Locus Name | | | Acc# |
| chloride channel, probable, homolog | | | pir:F69426 | | | F69426 |

Description

| ORF Name | NTID | AAID | NT Length | AA Length | Score | Probability |
|---|---|---|---|---|---|---|
| 25676387_c3_352 | 126 | 5348 | 83 | 252 | 118 | 2.8e−07 |
| Protein name | | | Locus Name | | | Acc# |
| tachylectin-3 | | | gp:AB017484 | | | AB017484 |

Description

*Tachypleus tridentatus* mRNA for tachylectin-3, complete cds.

| ORF Name | NTID | AAID | NT Length | AA Length | Score | Probability |
|---|---|---|---|---|---|---|
| 25976510_c2_263 | 127 | 5349 | 311 | 936 | 271 | 1.7e−23 |
| Protein name | | | Locus Name | | | Acc# |
| | | | gp:ECNPL | | | X03345 |

Description

*E. coli* npl gene or N-acetylneuraminate lyase subunit (EC4.1.3.3).

-continued

| ORF Name | NTID | AAID | NT Length | AA Length | Score | Probability |
|---|---|---|---|---|---|---|
| 26604635_c3_355 | 128 | 5350 | 370 | 1113 | 678 | 1.3e−66 |

| Protein name | Locus Name | Acc# |
|---|---|---|
| unknown | gp:AF144879 | AF144879 |

Description

*Leptospira interrogans* frb locus, complete sequence.

| ORF Name | NTID | AAID | NT Length | AA Length | Score | Probability |
|---|---|---|---|---|---|---|
| 29305313_c1_242 | 129 | 5351 | 490 | 1473 | 122 | 0.00028 |

| Protein name | Locus Name | Acc# |
|---|---|---|
| putative polysaccharide polymerase | gp:SPU09239 | U09239 |

Description

*Streptococcus pneumoniae* type 19F capsular polysaccharide biosynthesis operon, (cps19fABCDEFGHIJKLMNO) genes, complete cds, and aliA gene, partial cds.

| ORF Name | NTID | AAID | NT Length | AA Length | Score | Probability |
|---|---|---|---|---|---|---|
| 29317660_c1_204 | 130 | 5352 | 125 | 378 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 29509630_c1_217 | 131 | 5353 | 70 | 213 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 30355312_c1_246 | 132 | 5354 | 165 | 498 | 102 | 1.4e−05 |

| Protein name | Locus Name | Acc# |
|---|---|---|
| DNA-binding protein HB | pir:C75600 | C75600 |

Description

| ORF Name | NTID | AAID | NT Length | AA Length | Score | Probability |
|---|---|---|---|---|---|---|
| 31381_c1_209 | 133 | 5355 | 416 | 1251 | 289 | 6.5e−24 |

| Protein name | Locus Name | Acc# |
|---|---|---|
| | sp:YYBO_BACSU | P37489 |

Description

HYPOTHETICAL 48.2 KD PROTEIN IN COTF-TETB INTERGENIC REGION

-continued

| ORF Name | NTID | AAID | NT Length | AA Length | Score | Probability |
|---|---|---|---|---|---|---|
| 31414025_c2_290 | 134 | 5356 | 227 | 684 | 505 | 2.7e−48 |

| Protein name | Locus Name | Acc# |
|---|---|---|
| | sp:3MG1_ECOLI | P05100 |

Description

I)

| ORF Name | NTID | AAID | NT Length | AA Length | Score | Probability |
|---|---|---|---|---|---|---|
| 31882036_c2_271 | 135 | 5357 | 73 | 222 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 32064137_c2_294 | 136 | 5358 | 209 | 630 | 120 | 2.3e−07 |

| Protein name | Locus Name | Acc# |
|---|---|---|
| unknown | gp:AF048749 | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 32323912_f1_17 | 137 | 5359 | 411 | 1236 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 32429512_f2_113 | 138 | 5360 | 771 | 2316 | 163 | 1.1e−18 |

| Protein name | Locus Name | Acc# |
|---|---|---|
| DNA repair protein RAD25 homolog | pir:F69294 | F69294 |

Description

| ORF Name | NTID | AAID | NT Length | AA Length | Score | Probability |
|---|---|---|---|---|---|---|
| 32617177_f2_95 | 139 | 5361 | 92 | 279 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 337_c3_353 | 140 | 5362 | 198 | 597 | 532 | 3.7e−51 |
| Protein name | | | Locus Name | | | Acc# |
| acetyl tranferase homolog | | | pir:S70673 | | | S70673 |
| Description | | | | | | |

| ORF Name | NTID | AAID | NT Length | AA Length | Score | Probability |
|---|---|---|---|---|---|---|
| 34011402_f1_20 | 141 | 5363 | 74 | 225 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 34066312_c1_238 | 142 | 5364 | 177 | 534 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 34116277_f3_191 | 143 | 5365 | 60 | 183 | 115 | 5.7e−07 |
| Protein name | | | Locus Name | | | Acc# |
| hypothetical protein 3 | | | pir:S28487 | | | S28487 |
| Description | | | | | | |

| ORF Name | NTID | AAID | NT Length | AA Length | Score | Probability |
|---|---|---|---|---|---|---|
| 34167567_c2_297 | 144 | 5366 | 446 | 1341 | 1226 | 1.1e−124 |
| Protein name | | | Locus Name | | | Acc# |
| ORF1P | | | gp:AB025970 | | | AB025970 |
| Description | | | | | | |

*Plesiomonas shigelloides* gene for ORF1P, ORF2P, ORF3P, ORF4P, ORF5P, ORF6P, ORF7P, ORF8P, ORF9P, ORF10P, ORF11P.

| ORF Name | NTID | AAID | NT Length | AA Length | Score | Probability |
|---|---|---|---|---|---|---|
| 36361063_c2_300 | 145 | 5367 | 370 | 1113 | 610 | 2.0e−59 |
| Protein name | | | Locus Name | | | Acc# |
| WbpH | | | gp:PAU50396 | | | U50396 |
| Description | | | | | | |

*Pseudomonas aeruginosa* Wzz (Rol) (wzz (rol)) gene, partial cds, WbpA (wbpB), WbpB (wbpB), WbpC (wbpC), WbpD (wbpD), WbpE (wbpE), Wzy (Rfc) (wzy (rfc)), Wzx (wzx), HisH (hisH), HisF (hisF), WbpG (wbpG), WbpH (wbpH), WbpI (wbpI), WbpJ (wbpJ), WbpK (wbpK), WbpL (wbpL), WbpM (wbpM) and WbpN (wbpN) genes, complete cds, and UvrB (uvrB) gene, partial cds.

-continued

| ORF Name | NTID | AAID | NT Length | AA Length | Score | Probability |
|---|---|---|---|---|---|---|
| 3911015_c3_358 | 146 | 5368 | 180 | 543 | 153 | 5.4e−11 |
| Protein name | | | Locus Name | | | Acc# |
| serine O-acetyltransferase, | | | pir:E53402 | | | E53402 |

Description

| ORF Name | NTID | AAID | NT Length | AA Length | Score | Probability |
|---|---|---|---|---|---|---|
| 3948587_c2_296 | 147 | 5369 | 399 | 1200 | 1198 | 9.9e−122 |
| Protein name | | | Locus Name | | | Acc# |
| | | | gp:D64132 | | | D64132 |

Description

*Porphyromonas gingivalis* PorR and PorS genes, complete cds.

| ORF Name | NTID | AAID | NT Length | AA Length | Score | Probability |
|---|---|---|---|---|---|---|
| 4022178_c2_262 | 148 | 5370 | 373 | 1122 | 86 | 7.1e−07 |
| Protein name | | | Locus Name | | | Acc# |
| | | | sp:YCCC_ECOLI | | | |

Description

HYPOTHETICAL 81.2 KD PROTEIN IN APPA-CSPH INTERGENIC REGION

| ORF Name | NTID | AAID | NT Length | AA Length | Score | Probability |
|---|---|---|---|---|---|---|
| 4033125_c1_250 | 149 | 5371 | 226 | 681 | 546 | 1.2e−52 |
| Protein name | | | Locus Name | | | Acc# |
| ribulose-5-phosphate 3-epimerase homolog yloR | | | pir:B69879 | | | B69879 |

Description

| ORF Name | NTID | AAID | NT Length | AA Length | Score | Probability |
|---|---|---|---|---|---|---|
| 4065677_f2_133 | 150 | 5372 | 348 | 1047 | 283 | 9.0e−25 |
| Protein name | | | Locus Name | | | Acc# |
| conserved hypothetical protein BB0709 | | | pir:D70188 | | | D70188 |

Description

| ORF Name | NTID | AAID | NT Length | AA Length | Score | Probability |
|---|---|---|---|---|---|---|
| 4096877_f1_69 | 151 | 5373 | 296 | 891 | 348 | 1.2e−31 |
| Protein name | | | Locus Name | | | Acc# |
| | | | sp:NUC_BORBU | | | O51372 |

Description

PUTATIVE ENDONUCLEASE BB0411,

-continued

| ORF Name | NTID | AAID | NT Length | AA Length | Score | Probability |
|---|---|---|---|---|---|---|
| 4103375_c1_243 | 152 | 5374 | 410 | 1233 | 843 | 4.1e−84 |

| Protein name | Locus Name | Acc# |
|---|---|---|
| putative transferase | gp:BBR007747 | AJ007747 |

Description

*Bordetella bronchiseptica* cosmid BbLPS1.

| ORF Name | NTID | AAID | NT Length | AA Length | Score | Probability |
|---|---|---|---|---|---|---|
| 4457512_f3_184 | 153 | 5375 | 333 | 1002 | 221 | 2.6e−16 |

| Protein name | Locus Name | Acc# |
|---|---|---|
| conserved hypothetical protein MTH83 | pir:F69210 | F69210 |

Description

| ORF Name | NTID | AAID | NT Length | AA Length | Score | Probability |
|---|---|---|---|---|---|---|
| 4459660_c2_252 | 154 | 5376 | 269 | 810 | 109 | 9.0e−06 |

| Protein name | Locus Name | Acc# |
|---|---|---|
| probable NADH-plastoquinone oxidoreductase subunit | pir:C71018 | C71018 |

Description

| ORF Name | NTID | AAID | NT Length | AA Length | Score | Probability |
|---|---|---|---|---|---|---|
| 4728385_f3_173 | 155 | 5377 | 724 | 2175 | 208 | 6.3e−13 |

| Protein name | Locus Name | Acc# |
|---|---|---|
| probable purine NTPase PAB0812 | pir:F75103 | F75103 |

Description

| ORF Name | NTID | AAID | NT Length | AA Length | Score | Probability |
|---|---|---|---|---|---|---|
| 4786250_f2_83 | 156 | 5378 | 156 | 471 | 135 | 4.3e−09 |

| Protein name | Locus Name | Acc# |
|---|---|---|
| hypothetical protein MTH658 | pir:E69187 | E69187 |

Description

| ORF Name | NTID | AAID | NT Length | AA Length | Score | Probability |
|---|---|---|---|---|---|---|
| 4789066_f2_104 | 157 | 5379 | 71 | 216 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 5359842_c3_319 | 158 | 5380 | 174 | 525 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 5877042_c1_251 | 159 | 5381 | 325 | 975 | 131 | 3.0e−05 |

| Protein name | | | | Locus Name | | Acc# |
|---|---|---|---|---|---|---|
| | | | | sp:CME3_BACSU | | P39695 |

Description

COME OPERON PROTEIN 3

| ORF Name | NTID | AAID | NT Length | AA Length | Score | Probability |
|---|---|---|---|---|---|---|
| 5894001_f1_46 | 160 | 5382 | 83 | 252 | 65 | 0.020 |

| Protein name | | | | Locus Name | | Acc# |
|---|---|---|---|---|---|---|
| | | | | sp:UDG_STRPY | | Q07172 |

Description (UDP-GLCDH) (UDPGDH)

| ORF Name | NTID | AAID | NT Length | AA Length | Score | Probability |
|---|---|---|---|---|---|---|
| 6056562_c3_359 | 161 | 5383 | 204 | 615 | 406 | 8.3e−38 |

| Protein name | | | | Locus Name | | Acc# |
|---|---|---|---|---|---|---|
| putative transferase | | | | gp:BBR007747 | | AJ007747 |

Description

*Bordetella bronchiseptica* cosmid BbLPS1.

| ORF Name | NTID | AAID | NT Length | AA Length | Score | Probability |
|---|---|---|---|---|---|---|
| 6288313_f2_105 | 162 | 5384 | 308 | 927 | 407 | 6.5e−38 |

| Protein name | | | | Locus Name | | Acc# |
|---|---|---|---|---|---|---|
| transposase | | | | gp:AF038866 | | AF038866 |

Description

*Bacteroides fragilis* transposon Tn5520 transposase (bipH) and mobilization protein BmpH (bmpH) genes, complete cds.

| ORF Name | NTID | AAID | NT Length | AA Length | Score | Probability |
|---|---|---|---|---|---|---|
| 781512_f2_123 | 163 | 5385 | 82 | 249 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 962777_f1_73 | 164 | 5386 | 190 | 573 | 457 | 3.3e-43 |

| Protein name | Locus Name | Acc# |
|---|---|---|
| | sp:XPT_BACSU | P42085 |

Description

XANTHINE PHOSPHORIBOSYLTRANSFERASE,

| ORF Name | NTID | AAID | NT Length | AA Length | Score | Probability |
|---|---|---|---|---|---|---|
| 9765913_c1_232 | 165 | 5387 | 67 | 204 | 75 | 0.013 |

| Protein name | Locus Name | Acc# |
|---|---|---|
| | sp:HBB_PANPO | P04244 |

Description

HEMOGLOBIN BETA CHAIN

| ORF Name | NTID | AAID | NT Length | AA Length | Score | Probability |
|---|---|---|---|---|---|---|
| 10671885_c2_125 | 166 | 5388 | 123 | 372 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 10735927_c2_130 | 167 | 5389 | 335 | 1008 | 124 | 3.2e-07 |

| Protein name | Locus Name | Acc# |
|---|---|---|
| actinorhodin polyketide dimerase-related protein | pir:C72410 | C72410 |

Description

| ORF Name | NTID | AAID | NT Length | AA Length | Score | Probability |
|---|---|---|---|---|---|---|
| 10757837_c1_119 | 168 | 5390 | 415 | 1248 | 404 | 1.4e-37 |

| Protein name | Locus Name | Acc# |
|---|---|---|
| | sp:YRKO_BACSU | P54442 |

Description

HYPOTHETICAL 46.4 KD PROTEIN IN BLTR-SPOIIC INTERGENIC REGION

| ORF Name | NTID | AAID | NT Length | AA Length | Score | Probability |
|---|---|---|---|---|---|---|
| 11953533_f1_20 | 169 | 5391 | 75 | 228 | 69 | 0.0020 |

| Protein name | Locus Name | Acc# |
|---|---|---|
| | sp:HXD3_BRARE | O42370 |

Description

HOMEOBOX PROTEIN HOX-D3 (FRAGMENT)

-continued

| ORF Name | NTID | AAID | NT Length | AA Length | Score | Probability |
|---|---|---|---|---|---|---|
| 12541502_f2_51 | 170 | 5392 | 78 | 237 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 12693752_f2_64 | 171 | 5393 | 208 | 627 | 451 | 1.4e−42 |

| Protein name | | | | Locus Name | | Acc# |
|---|---|---|---|---|---|---|
| putative GTP-binding protein | | | | gp:ATAC004786 | | AC004786 |

Description

*Arabidopsas thaliana* chromosome II BAC T20K9 genomic sequence, complete sequence.

| ORF Name | NTID | AAID | NT Length | AA Length | Score | Probability |
|---|---|---|---|---|---|---|
| 14642187_f2_61 | 172 | 5394 | 175 | 528 | 511 | 6.2e−49 |

| Protein name | | | | Locus Name | | Acc# |
|---|---|---|---|---|---|---|
| | | | | sp:Y318_HAEIN | | P43984 |

Description

HYPOTHETICAL PROTEIN HI0318

| ORF Name | NTID | AAID | NT Length | AA Length | Score | Probability |
|---|---|---|---|---|---|---|
| 15125662_c3_164 | 173 | 5395 | 495 | 1488 | 367 | 1.6e−33 |

| Protein name | | | | Locus Name | | Acc# |
|---|---|---|---|---|---|---|
| | | | | gp:D90837 | | |

Description

*E. coli* genomic DNA, Kohara clone #347 (44.2–44.5 min.).

| ORF Name | NTID | AAID | NT Length | AA Length | Score | Probability |
|---|---|---|---|---|---|---|
| 16907762_c3_168 | 174 | 5396 | 360 | 1083 | 973 | 6.9e−98 |

| Protein name | | | | Locus Name | | Acc# |
|---|---|---|---|---|---|---|
| | | | | sp:YODE_PSEAE | | Q01609 |

Description

HYPOTHETICAL 40.7 KD PROTEIN IN OPDE 3'REGION (ORF2)

| ORF Name | NTID | AAID | NT Length | AA Length | Score | Probability |
|---|---|---|---|---|---|---|
| 20579675_c1_104 | 175 | 5397 | 213 | 642 | 496 | 2.4e−47 |

| Protein name | | | | Locus Name | | Acc# |
|---|---|---|---|---|---|---|
| recR protein | | | | pir:H75547 | | H75547 |

Description

| ORF Name | NTID | AAID | NT Length | AA Length | Score | Probability |
|---|---|---|---|---|---|---|
| 20587753_c3_165 | 176 | 5398 | 388 | 1167 | 882 | 3.0e−88 |

| Protein name | | | Locus Name | | | Acc# |
|---|---|---|---|---|---|---|
| | | | sp:PATB_BACSU | | | Q08432 |

Description

PUTATIVE AMINOTRANSFERASE B,

| ORF Name | NTID | AAID | NT Length | AA Length | Score | Probability |
|---|---|---|---|---|---|---|
| 20601437_f2_65 | 177 | 5399 | 204 | 615 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 21648312_f2_62 | 178 | 5400 | 109 | 330 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 22853452_c3_156 | 179 | 5401 | 179 | 540 | 158 | 1.6e−11 |

| Protein name | | | Locus Name | | | Acc# |
|---|---|---|---|---|---|---|
| | | | sp:YP20_BACLI | | | P05332 |

Description

HYPOTHETICAL P20 PROTEIN

| ORF Name | NTID | AAID | NT Length | AA Length | Score | Probability |
|---|---|---|---|---|---|---|
| 22867327_c3_155 | 180 | 5402 | 149 | 450 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 23492786_f3_67 | 181 | 5403 | 70 | 213 | | |

| Protein name | | | Locus Name | | | Acc# |
|---|---|---|---|---|---|---|

Description

NO-HIT

-continued

| ORF Name | NTID | AAID | NT Length | AA Length | Score | Probability |
|---|---|---|---|---|---|---|
| 23945302_c2_140 | 182 | 5404 | 230 | 693 | 163 | 4.7e−12 |
| Protein name | | | Locus Name | | | Acc# |
| | | | sp:RIBD_METJA | | | Q58085 |

Description

PUTATIVE RIBOFLAVIN BIOSYNTHESIS ENZYME

| ORF Name | NTID | AAID | NT Length | AA Length | Score | Probability |
|---|---|---|---|---|---|---|
| 24334637_c1_122 | 183 | 5405 | 406 | 1221 | 223 | 3.6e−16 |
| Protein name | | | Locus Name | | | Acc# |
| cation efflux system (czcB-like) | | | pir:E70342 | | | E70342 |

Description

| ORF Name | NTID | AAID | NT Length | AA Length | Score | Probability |
|---|---|---|---|---|---|---|
| 24416552_c1_118 | 184 | 5406 | 123 | 372 | 224 | 1.6e−18 |
| Protein name | | | Locus Name | | | Acc# |
| oxidoreductase, aldo/keto reductase family | | | pir:H72307 | | | H72307 |

Description

| ORF Name | NTID | AAID | NT Length | AA Length | Score | Probability |
|---|---|---|---|---|---|---|
| 26594087_c1_109 | 185 | 5407 | 379 | 1140 | 896 | 9.9e−90 |
| Protein name | | | Locus Name | | | Acc# |
| oxidoreductase, aldo/keto reductase family | | | pir:H72307 | | | H72307 |

Description

| ORF Name | NTID | AAID | NT Length | AA Length | Score | Probability |
|---|---|---|---|---|---|---|
| 3237755_c2_132 | 186 | 5408 | 225 | 678 | 376 | 1.3e−34 |
| Protein name | | | Locus Name | | | Acc# |
| plant-metabolite dehydrogenase homolog yvgN | | | pir:C70040 | | | C70040 |

Description

| ORF Name | NTID | AAID | NT Length | AA Length | Score | Probability |
|---|---|---|---|---|---|---|
| 33392187_c1_120 | 187 | 5409 | 342 | 1029 | 608 | 3.3e−59 |
| Protein name | | | Locus Name | | | Acc# |
| oxidoreductase, aldo/keto reductase family | | | pir:H72307 | | | H72307 |

Description

| ORF Name | NTID | AAID | NT Length | AA Length | Score | Probability |
|---|---|---|---|---|---|---|
| 34198387_c2_134 | 188 | 5410 | 292 | 879 | | |
| Protein name | | | Locus Name | | | Acc# |

Description

NO-HIT

-continued

| ORF Name | NTID | AAID | NT Length | AA Length | Score | Probability |
|---|---|---|---|---|---|---|
| 35313816_c1_111 | 189 | 5411 | 287 | 864 | 761 | 2.0e−75 |

| Protein name | Locus Name | Acc# |
|---|---|---|
| oxidoreductase, aldo/keto reductase family | pir:A72308 | A72308 |

Description

| ORF Name | NTID | AAID | NT Length | AA Length | Score | Probability |
|---|---|---|---|---|---|---|
| 3948575_c2_123 | 190 | 5412 | 227 | 684 | 584 | 1.1e−56 |

| Protein name | Locus Name | Acc# |
|---|---|---|
|  | sp:YF08_METJA | Q58903 |

Description

HYPOTHETICAL ABC TRANSPORTER ATP-BINDING PROTEIN MJ1508

| ORF Name | NTID | AAID | NT Length | AA Length | Score | Probability |
|---|---|---|---|---|---|---|
| 4064178_f1_25 | 191 | 5413 | 455 | 1368 | 197 | 8.2e−13 |

| Protein name | Locus Name | Acc# |
|---|---|---|
| aspartate aminotransferase | gp:AF035157 | AF035157 |

Description

*Lactococcus lactis* aspartate aminotransferase (aspC) gene, complete cds.

| ORF Name | NTID | AAID | NT Length | AA Length | Score | Probability |
|---|---|---|---|---|---|---|
| 4335425_f3_98 | 192 | 5414 | 498 | 1497 | 370 | 5.4e−34 |

| Protein name | Locus Name | Acc# |
|---|---|---|
| hypothetical protein | pir:S75887 | S75887 |

Description

| ORF Name | NTID | AAID | NT Length | AA Length | Score | Probability |
|---|---|---|---|---|---|---|
| 4410135_f2_56 | 193 | 5415 | 141 | 426 |  |  |

| Protein name | Locus Name | Acc# |
|---|---|---|
|  |  |  |

Description

NO-HIT

| ORF Name | NTID | AAID | NT Length | AA Length | Score | Probability |
|---|---|---|---|---|---|---|
| 4486261_c1_121 | 194 | 5416 | 164 | 495 |  |  |

| Protein name | Locus Name | Acc# |
|---|---|---|
|  |  |  |

Description

NO-HIT

-continued

| ORF Name | NTID | AAID | NT Length | AA Length | Score | Probability |
|---|---|---|---|---|---|---|
| 4589627_f3_93 | 195 | 5417 | 199 | 600 | 257 | 5.1e−22 |
| Protein name | | | Locus Name | | | Acc# |
| yqge hypothetical protein | | | pir:H72114 | | | H72114 |
| Description | | | | | | |

| ORF Name | NTID | AAID | NT Length | AA Length | Score | Probability |
|---|---|---|---|---|---|---|
| 47157165_c1_100 | 196 | 5418 | 75 | 228 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 632012_f1_22 | 197 | 5419 | 82 | 249 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 969687_f1_28 | 198 | 5420 | 140 | 423 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 10631882_c2_238 | 199 | 5421 | 61 | 186 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 11148453_f3_122 | 200 | 5422 | 127 | 384 | 126 | 3.9e−08 |
| Protein name | | | Locus Name | | | Acc# |
| hypothetical protein yngA | | | pir:F69892 | | | F69892 |
| Description | | | | | | |

| ORF Name | NTID | AAID | NT Length | AA Length | Score | Probability |
|---|---|---|---|---|---|---|
| 12381962_f3_134 | 201 | 5423 | 1058 | 3177 | 2370 | 6.3e−246 |
| Protein name | | | Locus Name | | | Acc# |
| hypothetical protein mexF | | | pir:T30830 | | | T30830 |
| Description | | | | | | |

-continued

| ORF Name | NTID | AAID | NT Length | AA Length | Score | Probability |
|---|---|---|---|---|---|---|
| 1256327_c3_274 | 202 | 5424 | 149 | 450 | 96 | 1.6e−06 |
| Protein name | | | Locus Name | | | Acc# |
| ct469 hypothetical protein | | | pir:D72060 | | | D72060 |
| Description | | | | | | |

| ORF Name | NTID | AAID | NT Length | AA Length | Score | Probability |
|---|---|---|---|---|---|---|
| 12690817_c2_225 | 203 | 5425 | 141 | 426 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 12712827_f3_120 | 204 | 5426 | 353 | 1062 | 276 | 5.0e−24 |
| Protein name | | | Locus Name | | | Acc# |
| conserved hypothetical protein | | | pir:F72386 | | | F72386 |
| Description | | | | | | |

| ORF Name | NTID | AAID | NT Length | AA Length | Score | Probability |
|---|---|---|---|---|---|---|
| 12922202_f3_116 | 205 | 5427 | 316 | 951 | 132 | 3.0e−06 |
| Protein name | | | Locus Name | | | Acc# |
| hypothetical protein aq_380 | | | pir:A70334 | | | A70334 |
| Description | | | | | | |

| ORF Name | NTID | AAID | NT Length | AA Length | Score | Probability |
|---|---|---|---|---|---|---|
| 13700468_f3_118 | 206 | 5428 | 93 | 282 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 13878425_f2_72 | 207 | 5429 | 134 | 405 | 368 | 8.9e−34 |
| Protein name | | | Locus Name | | | Acc# |
| | | | sp:YYAH_BACSU | | | P37516 |
| Description | | | | | | |

HYPOTHETICAL 14.4 KD PROTEIN IN TETB-EXOA INTERGENIC REGION (ORFF)

| ORF Name | NTID | AAID | NT Length | AA Length | Score | Probability |
|---|---|---|---|---|---|---|
| 14508425_c1_192 | 208 | 5430 | 236 | 711 | 166 | 2.3e−12 |
| Protein name | | | Locus Name | | | Acc# |
| hypothetical protein MTH939 | | | pir:G69225 | | | G69225 |
| Description | | | | | | |

-continued

| ORF Name | NTID | AAID | NT Length | AA Length | Score | Probability |
|---|---|---|---|---|---|---|
| 14646956_c2_261 | 209 | 5431 | 82 | 249 | 61 | 0.023 |

| Protein name | Locus Name | Acc# |
|---|---|---|
| mannanase | gp:U96771 | U96771 |

Description

*Prevotella bryantii* putative polygalacturonase,B-1,4-endoglucanase, and mannanase genes, complete cds; and unknown genes.

| ORF Name | NTID | AAID | NT Length | AA Length | Score | Probability |
|---|---|---|---|---|---|---|
| 14705261_f1_15 | 210 | 5432 | 501 | 1506 | 115 | 0.00082 |

| Protein name | Locus Name | Acc# |
|---|---|---|
| unknown protein | gp:BACCOMGA | |

Description

*Bacillus subtilis* (clone pED4) comG-(1,2,3,4,5,6, and 7) proteins incomG operon, complete cds.

| ORF Name | NTID | AAID | NT Length | AA Length | Score | Probability |
|---|---|---|---|---|---|---|
| 14744010_f3_129 | 211 | 5433 | 265 | 798 | 275 | 6.3e−24 |

| Protein name | Locus Name | Acc# |
|---|---|---|
| conserved hypothetical protein yjkA | pir:E69851 | E69851 |

Description

| ORF Name | NTID | AAID | NT Length | AA Length | Score | Probability |
|---|---|---|---|---|---|---|
| 14876313_f2_84 | 212 | 5434 | 667 | 2004 | 1443 | 1.1e−147 |

| Protein name | Locus Name | Acc# |
|---|---|---|
| DNA ligase | gp:BST011676 | AJ011676 |

Description

*Bacillus stearothermophilus* lig gene.

| ORF Name | NTID | AAID | NT Length | AA Length | Score | Probability |
|---|---|---|---|---|---|---|
| 15641902_c3_288 | 213 | 5435 | 202 | 609 | 345 | 2.4e−31 |

| Protein name | Locus Name | Acc# |
|---|---|---|
| conserved hypothetical protein AF2201 | pir:A69525 | A69525 |

Description

| ORF Name | NTID | AAID | NT Length | AA Length | Score | Probability |
|---|---|---|---|---|---|---|
| 16204662_f2_65 | 214 | 5436 | 604 | 1815 | 134 | 3.1e−06 |

| Protein name | Locus Name | Acc# |
|---|---|---|
| hypothetical protein AF1867 | pir:B69483 | B69483 |

Description

-continued

| ORF Name | NTID | AAID | NT Length | AA Length | Score | Probability |
|---|---|---|---|---|---|---|
| 16828382_f3_137 | 215 | 5437 | 305 | 918 | 801 | 1.2e−79 |

| Protein name | Locus Name | Acc# |
|---|---|---|
| | sp:PYRD_AQUAE | O66461 |

Description (DHODEHASE)

| ORF Name | NTID | AAID | NT Length | AA Length | Score | Probability |
|---|---|---|---|---|---|---|
| 16832885_c3_307 | 216 | 5438 | 431 | 1296 | 1724 | 1.8e−177 |

| Protein name | Locus Name | Acc# |
|---|---|---|
| hypothetical protein | pir:JQ1020 | JQ1020 |

Description

| ORF Name | NTID | AAID | NT Length | AA Length | Score | Probability |
|---|---|---|---|---|---|---|
| 188752_f1_20 | 217 | 5439 | 761 | 2286 | 380 | 3.5e−34 |

| Protein name | Locus Name | Acc# |
|---|---|---|
| conserved hypothetical protein AF1878 | pir:E69484 | E69484 |

Description

| ORF Name | NTID | AAID | NT Length | AA Length | Score | Probability |
|---|---|---|---|---|---|---|
| 188905_c1_179 | 218 | 5440 | 72 | 219 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 19645166_f3_136 | 219 | 5441 | 345 | 1038 | 244 | 8.2e−20 |

| Protein name | Locus Name | Acc# |
|---|---|---|
| | sp:YQEN_BACSU | P54459 |

Description

HYPOTHETICAL 40.5 KD PROTEIN IN COMEC-RPST INTERGENIC REGION

| ORF Name | NTID | AAID | NT Length | AA Length | Score | Probability |
|---|---|---|---|---|---|---|
| 2051500_c3_266 | 220 | 5442 | 777 | 2334 | 178 | 2.5e−23 |

| Protein name | Locus Name | Acc# |
|---|---|---|
| conserved hypothetical protein aq_1386 | pir:F70420 | F70420 |

Description

-continued

| ORF Name | NTID | AAID | NT Length | AA Length | Score | Probability |
|---|---|---|---|---|---|---|
| 20741703_f2_89 | 221 | 5443 | 74 | 225 | | |
| Protein name | | | Locus Name | | Acc# | |

Description

NO-HIT

| ORF Name | NTID | AAID | NT Length | AA Length | Score | Probability |
|---|---|---|---|---|---|---|
| 2151556_f1_27 | 222 | 5444 | 99 | 300 | | |
| Protein name | | | Locus Name | | Acc# | |

Description

NO-HIT

| ORF Name | NTID | AAID | NT Length | AA Length | Score | Probability |
|---|---|---|---|---|---|---|
| 21541425_c2_199 | 223 | 5445 | 61 | 186 | | |
| Protein name | | | Locus Name | | Acc# | |

Description

NO-HIT

| ORF Name | NTID | AAID | NT Length | AA Length | Score | Probability |
|---|---|---|---|---|---|---|
| 21679062_f1_18 | 224 | 5446 | 283 | 852 | 206 | 1.3e−16 |
| Protein name | | | Locus Name | | Acc# | |
| conserved hypothetical protein | | | pir:E72209 | | E72209 | |

Description

| ORF Name | NTID | AAID | NT Length | AA Length | Score | Probability |
|---|---|---|---|---|---|---|
| 235762_f1_22 | 225 | 5447 | 179 | 540 | | |
| Protein name | | | Locus Name | | Acc# | |

Description

NO-HIT

| ORF Name | NTID | AAID | NT Length | AA Length | Score | Probability |
|---|---|---|---|---|---|---|
| 23625693_f2_64 | 226 | 5448 | 265 | 798 | | |
| Protein name | | | Locus Name | | Acc# | |

Description

NO-HIT

| ORF Name | NTID | AAID | NT Length | AA Length | Score | Probability |
|---|---|---|---|---|---|---|
| 23633312_f1_7 | 227 | 5449 | 248 | 747 | 193 | 3.1e−15 |
| Protein name | | | Locus Name | | Acc# | |
| | | | gp:APU72238 | | U72238 | |

Description

*Anabaena* PCC7120 ORFR1, ORFR2, ORFR3, ORFR4, and ORFR5 genes, complete sequences.

-continued

| ORF Name | NTID | AAID | NT Length | AA Length | Score | Probability |
|---|---|---|---|---|---|---|
| 23635812_f1_9 | 228 | 5450 | 784 | 2355 | 148 | 2.0e−09 |
| Protein name | | | Locus Name | | | Acc# |
| conserved hypothetical protein AF1017 | | | pir:A69377 | | | A69377 |
| Description | | | | | | |

| ORF Name | NTID | AAID | NT Length | AA Length | Score | Probability |
|---|---|---|---|---|---|---|
| 23884561_f1_45 | 229 | 5451 | 131 | 396 | 136 | 4.1e−08 |
| Protein name | | | Locus Name | | | Acc# |
| 63 kDa protein | | | gp:MBU73653 | | | U73653 |
| Description | | | | | | |

*Mycobacterium bovis* 63 kDa protein, 47 kDa protein and clpB gene, complete cds.

| ORF Name | NTID | AAID | NT Length | AA Length | Score | Probability |
|---|---|---|---|---|---|---|
| 24256502_f3_115 | 230 | 5452 | 383 | 1152 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 24316061_f1_6 | 231 | 5453 | 60 | 183 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 24334393_c1_151 | 232 | 5454 | 98 | 297 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 24412502_c1_196 | 233 | 5455 | 94 | 285 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 24485926_f1_16 | 234 | 5456 | 476 | 1431 | | |
| Protein name | | | Locus Name | | | Acc# |
| Description | | | | | | |
| NO-HIT | | | | | | |

-continued

| ORF Name | NTID | AAID | NT Length | AA Length | Score | Probability |
|---|---|---|---|---|---|---|
| 24494017_c1_169 | 235 | 5457 | 295 | 888 | 887 | 8.9e−89 |

| Protein name | Locus Name | Acc# |
|---|---|---|
| hypothetical protein jhp0694 | pir:F71901 | F71901 |

Description

| ORF Name | NTID | AAID | NT Length | AA Length | Score | Probability |
|---|---|---|---|---|---|---|
| 24500032_f3_121 | 236 | 5458 | 612 | 1839 | 1501 | 7.7e−154 |

| Protein name | Locus Name | Acc# |
|---|---|---|
|  | sp:SYD_BACSU | O32038 |

Description (ASPRS)

| ORF Name | NTID | AAID | NT Length | AA Length | Score | Probability |
|---|---|---|---|---|---|---|
| 24642760_c3_311 | 237 | 5459 | 415 | 1245 | 1990 | 1.2e−205 |

| Protein name | Locus Name | Acc# |
|---|---|---|
| L-fucose isomerase | gp:AF137263 | AF137263 |

Description

*Bacteroides thetaiotaomicron* 30S ribosomal protein S16-like protein, fucose
gene cluster, and RNA polymerase sigma factor SigZ-like protein (sigZ) genes, complete cds.

| ORF Name | NTID | AAID | NT Length | AA Length | Score | Probability |
|---|---|---|---|---|---|---|
| 24726550_f2_61 | 238 | 5460 | 136 | 411 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24804712_f3_114 | 239 | 5461 | 164 | 495 | 88 | 0.013 |

| Protein name | Locus Name | Acc# |
|---|---|---|
| ATP synthase F0, subunit b' | pir:A64662 | A64662 |

Description

| ORF Name | NTID | AAID | NT Length | AA Length | Score | Probability |
|---|---|---|---|---|---|---|
| 24897943_f1_12 | 240 | 5462 | 61 | 186 |  |  |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 2531692_f1_21 | 241 | 5463 | 105 | 318 | 217 | 8.9e-18 |
| Protein name | | | | Locus Name | | Acc# |
| | | | | gp:AB024563 | | AB024563 |

Description

*Bacillus halodurans* gene for YFIL, YFIM, YFIN, YHDE, HMP and ARGE, complete cds.

| ORF Name | NTID | AAID | NT Length | AA Length | Score | Probability |
|---|---|---|---|---|---|---|
| 2617125_f1_40 | 242 | 5464 | 61 | 186 | | |
| Protein name | | | | Locus Name | | Acc# |

Description

NO-HIT

| ORF Name | NTID | AAID | NT Length | AA Length | Score | Probability |
|---|---|---|---|---|---|---|
| 26376540_c1_194 | 243 | 5465 | 255 | 768 | 106 | 0.0015 |
| Protein name | | | | Locus Name | | Acc# |
| sensory transduction system regulatory protein slr1837:protein slr1837:protein slr1837 | | | | pir:S77341 | | S77341 |

Description

| ORF Name | NTID | AAID | NT Length | AA Length | Score | Probability |
|---|---|---|---|---|---|---|
| 26578375_f3_100 | 244 | 5466 | 67 | 204 | | |
| Protein name | | | | Locus Name | | Acc# |

Description

NO-HIT

| ORF Name | NTID | AAID | NT Length | AA Length | Score | Probability |
|---|---|---|---|---|---|---|
| 2741543_f3_111 | 245 | 5467 | 608 | 1827 | 111 | 0.0053 |
| Protein name | | | | Locus Name | | Acc# |
| | | | | sp:SECY_ANTSP | | Q37143 |

Description

PREPROTEIN TRANSLOCASE SECY SUBUNIT

| ORF Name | NTID | AAID | NT Length | AA Length | Score | Probability |
|---|---|---|---|---|---|---|
| 2851577_f1_41 | 246 | 5468 | 297 | 894 | 296 | 3.8e-26 |
| Protein name | | | | Locus Name | | Acc# |
| XylR | | | | gp:BSU15985 | | U15985 |

Description

*Bacillus stearothermophilus* endo-beta-1,4-xylanase (xynA) gene, complete cds.

-continued

| ORF Name | NTID | AAID | NT Length | AA Length | Score | Probability |
|---|---|---|---|---|---|---|
| 29344652_f1_37 | 247 | 5469 | 279 | 840 | 433 | 1.1e−40 |

| Protein name | | | | Locus Name | | Acc# |
|---|---|---|---|---|---|---|
| | | | | sp:PYRZ_BACSU | | P25983 |

Description

DIHYDROOROTATE DEHYDROGENASE ELECTRON TRANSFER SUBUNIT

| ORF Name | NTID | AAID | NT Length | AA Length | Score | Probability |
|---|---|---|---|---|---|---|
| 29537532_f3_117 | 248 | 5470 | 101 | 306 | 113 | 9.3e−07 |

| Protein name | | | | Locus Name | | Acc# |
|---|---|---|---|---|---|---|
| hypothetical protein Rv2816c | | | | pir:C70691 | | C70691 |

Description

| ORF Name | NTID | AAID | NT Length | AA Length | Score | Probability |
|---|---|---|---|---|---|---|
| 33205013_c1_157 | 249 | 5471 | 247 | 744 | 605 | 6.8e−59 |

| Protein name | | | | Locus Name | | Acc# |
|---|---|---|---|---|---|---|
| | | | | sp:TRMD_BACSU | | O31741 |

Description (METHYLTRANSFERASE)

| ORF Name | NTID | AAID | NT Length | AA Length | Score | Probability |
|---|---|---|---|---|---|---|
| 34015677_f3_131 | 250 | 5472 | 279 | 840 | 218 | 7.0e−18 |

| Protein name | | | | Locus Name | | Acc# |
|---|---|---|---|---|---|---|
| hypothetical protein CT398 | | | | pir:A71519 | | A71519 |

Description

| ORF Name | NTID | AAID | NT Length | AA Length | Score | Probability |
|---|---|---|---|---|---|---|
| 34068760_f1_28 | 251 | 5473 | 452 | 1359 | 599 | 2.9e−58 |

| Protein name | | | | Locus Name | | Acc# |
|---|---|---|---|---|---|---|
| conserved hypothetical protein yqfO | | | | pir:A69954 | | A69954 |

Description

| ORF Name | NTID | AAID | NT Length | AA Length | Score | Probability |
|---|---|---|---|---|---|---|
| 35345057_c2_240 | 252 | 5474 | 63 | 192 | | |

| Protein name | | | | Locus Name | | Acc# |
|---|---|---|---|---|---|---|

Description

NO-HIT

-continued

| ORF Name | NTID | AAID | NT Length | AA Length | Score | Probability |
|---|---|---|---|---|---|---|
| 35432303_c2_228 | 253 | 5475 | 396 | 1191 | 778 | 3.2e−77 |

| Protein name | Locus Name | Acc# |
|---|---|---|
| hypothetical protein HP0049 | pir:A64526 | A64526 |

Description

| ORF Name | NTID | AAID | NT Length | AA Length | Score | Probability |
|---|---|---|---|---|---|---|
| 35832062_f3_108 | 254 | 5476 | 815 | 2448 | 173 | 2.9e−09 |

| Protein name | Locus Name | Acc# |
|---|---|---|
|  | sp:YBJZ_ECOLI | P75831 |

Description

HYPOTHETICAL ABC TRANSPORTER ATP-BINDING PROTEIN YBJZ

| ORF Name | NTID | AAID | NT Length | AA Length | Score | Probability |
|---|---|---|---|---|---|---|
| 36362551_c2_232 | 255 | 5477 | 396 | 1191 | 801 | 1.2e−79 |

| Protein name | Locus Name | Acc# |
|---|---|---|
|  | sp:BIOF_BACSH | P22806 |

Description (LIGASE)

| ORF Name | NTID | AAID | NT Length | AA Length | Score | Probability |
|---|---|---|---|---|---|---|
| 3906625_c3_309 | 256 | 5478 | 189 | 570 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 3923465_f3_135 | 257 | 5479 | 261 | 786 | 510 | 7.9e−49 |

| Protein name | Locus Name | Acc# |
|---|---|---|
| amp nucleosidase | pir:A72021 | A72021 |

Description

| ORF Name | NTID | AAID | NT Length | AA Length | Score | Probability |
|---|---|---|---|---|---|---|
| 3928336_c2_262 | 258 | 5480 | 464 | 1395 |  |  |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 3932756_f2_74 | 259 | 5481 | 471 | 1416 | 518 | 1.1e–49 |

| Protein name | Locus Name | Acc# |
|---|---|---|
| OprM | gp:AB011381 | AB011381 |

Description

*Pseudomonas aeruginosa* gene for OprM, complete cds.

| ORF Name | NTID | AAID | NT Length | AA Length | Score | Probability |
|---|---|---|---|---|---|---|
| 3942137_f2_54 | 260 | 5482 | 135 | 408 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 3946962_c1_163 | 261 | 5483 | 63 | 192 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 3985640_c2_260 | 262 | 5484 | 152 | 459 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4103383_c2_201 | 263 | 5485 | 125 | 378 | 164 | 3.7e–12 |

| Protein name | Locus Name | Acc# |
|---|---|---|
| | sp:YBDF_ECOLI | |

Description

HYPOTHETICAL 14.1 KD PROTEIN IN NFNB-ENTD INTERGENIC REGION

| ORF Name | NTID | AAID | NT Length | AA Length | Score | Probability |
|---|---|---|---|---|---|---|
| 41307_f1_14 | 264 | 5486 | 247 | 744 | 187 | 1.3e–14 |

| Protein name | Locus Name | Acc# |
|---|---|---|
| | sp:Y978_METJA | Q58388 |

Description

HYPOTHETICAL PROTEIN MJ0978

-continued

| ORF Name | NTID | AAID | NT Length | AA Length | Score | Probability |
|---|---|---|---|---|---|---|
| 4343942_f2_75 | 265 | 5487 | 383 | 1152 | 443 | 1.0e−41 |

| Protein name | Locus Name | Acc# |
|---|---|---|
| hypothetical protein mexE | pir:T30829 | T30829 |

Description

| ORF Name | NTID | AAID | NT Length | AA Length | Score | Probability |
|---|---|---|---|---|---|---|
| 4531536_f3_112 | 266 | 5488 | 412 | 1239 | 150 | 7.0e−10 |

| Protein name | Locus Name | Acc# |
|---|---|---|
|  | gp:YP102KB | AL031866 |

Description

*Yersinia pestis* 102 kbases unstable region: from 1 to 119443.

| ORF Name | NTID | AAID | NT Length | AA Length | Score | Probability |
|---|---|---|---|---|---|---|
| 4535677_c1_154 | 267 | 5489 | 211 | 636 | 241 | 2.5e−20 |

| Protein name | Locus Name | Acc# |
|---|---|---|
|  | sp:CAT3_*ECOLI* | P00484 |

Description

CHLORAMPHENICOL ACETYLTRANSFERASE III,

| ORF Name | NTID | AAID | NT Length | AA Length | Score | Probability |
|---|---|---|---|---|---|---|
| 4691032_c2_233 | 268 | 5490 | 143 | 432 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 4691061_c3_294 | 269 | 5491 | 94 | 285 | 72 | 0.020 |

| Protein name | Locus Name | Acc# |
|---|---|---|
| NADH dehydrogenase subunit 4L | gp:BMMITOCH01 | AF110610 |

Description

*Boophilus microplus* NADH dehydrogenase subunit 4 (ND4) gene, partial cds; NADH dehydrogenase subunit 4L (ND4L) gene, complete cds; tRNA-Thr and tRNA-Pro genes, complete sequence; and NADH dehydrogenase subunit 6 (ND6) gene, partial cds, mitochondrial genes for mitochondrial products.

| ORF Name | NTID | AAID | NT Length | AA Length | Score | Probability |
|---|---|---|---|---|---|---|
| 4897087_f1_19 | 270 | 5492 | 139 | 420 |  |  |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 4898537_f1_11 | 271 | 5493 | 749 | 2250 | 136 | 8.6e−06 |

| Protein name | Locus Name | Acc# |
|---|---|---|
| | sp:Y797_METJA | Q58207 |

Description

HYPOTHETICAL PROTEIN MJ0797

| ORF Name | NTID | AAID | NT Length | AA Length | Score | Probability |
|---|---|---|---|---|---|---|
| 4973765_f3_104 | 272 | 5494 | 141 | 426 | 128 | 1.6e−07 |

| Protein name | Locus Name | Acc# |
|---|---|---|
| conserved hypothetical protein yknZ | pir:E69858 | E69858 |

Description

| ORF Name | NTID | AAID | NT Length | AA Length | Score | Probability |
|---|---|---|---|---|---|---|
| 5084381_c3_310 | 273 | 5495 | 331 | 996 | 1166 | 2.4e−118 |

| Protein name | Locus Name | Acc# |
|---|---|---|
| FucR | gp:AF137263 | AF137263 |

Description

*Bacteroides thetaiotaomicron* 30S ribosomal protein S16-like protein, fucose gene cluster, and RNA polymerase sigma factor SigZ-like protein (sigZ) genes, complete cds.

| ORF Name | NTID | AAID | NT Length | AA Length | Score | Probability |
|---|---|---|---|---|---|---|
| 5187812_f1_13 | 274 | 5496 | 228 | 687 | 596 | 6.1e−58 |

| Protein name | Locus Name | Acc# |
|---|---|---|
| | sp:YF08_METJA | Q58903 |

Description

HYPOTHETICAL ABC TRANSPORTER ATP-BINDING PROTEIN MJ1508

| ORF Name | NTID | AAID | NT Length | AA Length | Score | Probability |
|---|---|---|---|---|---|---|
| 5191942_f3_128 | 275 | 5497 | 209 | 630 | 246 | 7.5e−21 |

| Protein name | Locus Name | Acc# |
|---|---|---|
| amino acid ABC transporter, ATP-binding protein | pir:H72356 | H72356 |

Description

| ORF Name | NTID | AAID | NT Length | AA Length | Score | Probability |
|---|---|---|---|---|---|---|
| 547082_f1_36 | 276 | 5498 | 170 | 513 | 93 | 0.00016 |

| Protein name | Locus Name | Acc# |
|---|---|---|
| gpC | gp:AF063097 | |

Description

Bacteriophage P2, complete genome.

-continued

| ORF Name | NTID | AAID | NT Length | AA Length | Score | Probability |
|---|---|---|---|---|---|---|
| 5859625_c3_299 | 277 | 5499 | 62 | 189 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 6412812_c2_198 | 278 | 5500 | 686 | 2061 | 2246 | 8.7e−233 |

| Protein name | Locus Name | Acc# |
|---|---|---|
| high temperature protein HtpG | gp:AF176245 | AF176245 |

Description

*Porphyromonas gingivalis* high temperature protein HtpG (htpG) gene, complete cds.

| ORF Name | NTID | AAID | NT Length | AA Length | Score | Probability |
|---|---|---|---|---|---|---|
| 6723262_f2_56 | 279 | 5501 | 133 | 402 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 787567_f3_139 | 280 | 5502 | 303 | 912 | 659 | 1.3e−64 |

| Protein name | Locus Name | Acc# |
|---|---|---|
| dihydrodipicolinate synthase | pir:B72246 | B72246 |

Description

| ORF Name | NTID | AAID | NT Length | AA Length | Score | Probability |
|---|---|---|---|---|---|---|
| 907974_c1_149 | 281 | 5503 | 745 | 2238 | 1877 | 1.1e−193 |

| Protein name | Locus Name | Acc# |
|---|---|---|
| | sp:MECB_BACSU | P37571 |

Description

NEGATIVE REGULATOR OF GENETIC COMPETENCE MECB

| ORF Name | NTID | AAID | NT Length | AA Length | Score | Probability |
|---|---|---|---|---|---|---|
| 9851505_f3_113 | 282 | 5504 | 238 | 717 | 106 | 1.5e−05 |

| Protein name | Locus Name | Acc# |
|---|---|---|
| hypothetical protein | gp:SEL243707 | AJ243707 |

Description

*Synechococcus elongatus* petB gene, petD gene and ORF1.

-continued

| ORF Name | NTID | AAID | NT Length | AA Length | Score | Probability |
|---|---|---|---|---|---|---|
| 10969062_f3_151 | 283 | 5505 | 256 | 771 | 747 | 6.1e−74 |

| Protein name | Locus Name | Acc# |
|---|---|---|
| ATP synthase F1, subunit alpha | pir:F72231 | F72231 |

Description

| ORF Name | NTID | AAID | NT Length | AA Length | Score | Probability |
|---|---|---|---|---|---|---|
| 133562_f3_116 | 284 | 5506 | 265 | 798 | 565 | 1.2e−54 |

| Protein name | Locus Name | Acc# |
|---|---|---|
| hypothetical protein | gp:STE242827 | AJ242827 |

Description

*Streptomyces tendae* afp gene and ORF2 (partial), strain Tue901/8c.

| ORF Name | NTID | AAID | NT Length | AA Length | Score | Probability |
|---|---|---|---|---|---|---|
| 13672255_f2_95 | 285 | 5507 | 146 | 441 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 14501312_c3_311 | 286 | 5508 | 461 | 1386 | 473 | 6.6e−45 |

| Protein name | Locus Name | Acc# |
|---|---|---|
| conserved hypothetical integral membrane protein HP1184 | pir:H64667 | H64667 |

Description

| ORF Name | NTID | AAID | NT Length | AA Length | Score | Probability |
|---|---|---|---|---|---|---|
| 14511007_f1_2 | 287 | 5509 | 330 | 993 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 14645437_f3_135 | 288 | 5510 | 768 | 2307 | 117 | 0.0015 |

| Protein name | Locus Name | Acc# |
|---|---|---|
| conserved hypothetical protein yknZ | pir:E69858 | E69858 |

Description

-continued

| ORF Name | NTID | AAID | NT Length | AA Length | Score | Probability |
|---|---|---|---|---|---|---|
| 14969692_f1_37 | 289 | 5511 | 404 | 1215 | 232 | 4.9e−17 |

| Protein name | Locus Name | Acc# |
|---|---|---|
| antibiotic resistance protein homolog ywoG | pir:B70065 | B70065 |

Description

| ORF Name | NTID | AAID | NT Length | AA Length | Score | Probability |
|---|---|---|---|---|---|---|
| 15104137_f1_1 | 290 | 5512 | 466 | 1401 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 15673443_c3_323 | 291 | 5513 | 464 | 1395 | 792 | 1.0e−78 |

| Protein name | Locus Name | Acc# |
|---|---|---|
| *Salmonella typhimurium* transcriptional | gp:STYSTMF1 | AF170176 |

Description

*Salmonella typhimurium* fragment STMF1.

| ORF Name | NTID | AAID | NT Length | AA Length | Score | Probability |
|---|---|---|---|---|---|---|
| 158187_f3_121 | 292 | 5514 | 409 | 1230 | 988 | 1.8e−99 |

| Protein name | Locus Name | Acc# |
|---|---|---|
| | sp:URAA_HAEIN | P45117 |

Description

PROBABLE URACIL PERMEASE (URACIL TRANSPORTER)

| ORF Name | NTID | AAID | NT Length | AA Length | Score | Probability |
|---|---|---|---|---|---|---|
| 16172682_f1_45 | 293 | 5515 | 310 | 933 | 532 | 3.4e−78 |

| Protein name | Locus Name | Acc# |
|---|---|---|
| | sp:ATPA_RICPR | O50288 |

Description

ATP SYNTHASE ALPHA CHAIN,

| ORF Name | NTID | AAID | NT Length | AA Length | Score | Probability |
|---|---|---|---|---|---|---|
| 16828462_f1_46 | 294 | 5516 | 292 | 879 | 470 | 1.4e−44 |

| Protein name | Locus Name | Acc# |
|---|---|---|
| | sp:ATPG_BACSU | P37810 |

Description

ATP SYNTHASE GAMMA CHAIN,

-continued

| ORF Name | NTID | AAID | NT Length | AA Length | Score | Probability |
|---|---|---|---|---|---|---|
| 19945317_c2_264 | 295 | 5517 | 285 | 858 | 120 | 2.0e−05 |

| Protein name | Locus Name | Acc# |
|---|---|---|
| 3',5'-cyclic-nucleotide phosphodiesterase, cpdA homolog MTH178:Icc related protein | pir:F69104 | F69104 |

Description

| ORF Name | NTID | AAID | NT Length | AA Length | Score | Probability |
|---|---|---|---|---|---|---|
| 21990930_c1_217 | 296 | 5518 | 326 | 981 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 22464182_c1_215 | 297 | 5519 | 328 | 987 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 2346936_f3_153 | 298 | 5520 | 463 | 1392 | 153 | 8.5e−08 |

| Protein name | Locus Name | Acc# |
|---|---|---|
| HelC | gp:LPU11704 | U11704 |

Description

*Legionella pneumophila* HelC (helC) gene, complete cds.

| ORF Name | NTID | AAID | NT Length | AA Length | Score | Probability |
|---|---|---|---|---|---|---|
| 23694686_f1_35 | 299 | 5521 | 225 | 678 | 179 | 9.5e−14 |

| Protein name | Locus Name | Acc# |
|---|---|---|
| | sp:GS1_HUMAN | Q08623 |

Description

GS1 PROTEIN

| ORF Name | NTID | AAID | NT Length | AA Length | Score | Probability |
|---|---|---|---|---|---|---|
| 23829510_c3_325 | 300 | 5522 | 228 | 687 | 283 | 9.0e−25 |

| Protein name | Locus Name | Acc# |
|---|---|---|
| transcription regulator, crp family | pir:F72285 | F72285 |

Description

-continued

| ORF Name | NTID | AAID | NT Length | AA Length | Score | Probability |
|---|---|---|---|---|---|---|
| 24009530_c1_182 | 301 | 5523 | 70 | 213 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24010962_f1_25 | 302 | 5524 | 131 | 396 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24111375_f3_110 | 303 | 5525 | 68 | 207 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24219032_f2_97 | 304 | 5526 | 92 | 279 | 172 | 5.2e−13 |

| Protein name | Locus Name | Acc# |
|---|---|---|
| | sp:ATPL_ANASP | P12409 |

Description

ATP SYNTHASE C CHAIN, (LIPID-BINDING PROTEIN)

| ORF Name | NTID | AAID | NT Length | AA Length | Score | Probability |
|---|---|---|---|---|---|---|
| 24254417_f2_53 | 305 | 5527 | 379 | 1140 | 480 | 1.2e−45 |

| Protein name | Locus Name | Acc# |
|---|---|---|
| sensory transduction system regulatory protein sll1229:protein sll1229:protein sll1229 | pir:S75524 | S75524 |

Description

| ORF Name | NTID | AAID | NT Length | AA Length | Score | Probability |
|---|---|---|---|---|---|---|
| 24333127_c3_332 | 306 | 5528 | 532 | 1599 | 748 | 1.3e−76 |

| Protein name | Locus Name | Acc# |
|---|---|---|
| | sp:YIEN_ECOLI | P31473 |

Description

HYPOTHETICAL 56.4 KD PROTEIN IN ASNA-KUP INTERGENIC REGION

-continued

| ORF Name | NTID | AAID | NT Length | AA Length | Score | Probability |
|---|---|---|---|---|---|---|
| 24398417_c2_280 | 307 | 5529 | 996 | 2991 | 108 | 3.4e−15 |

| Protein name | Locus Name | Acc# |
|---|---|---|
| hypothetical protein jhp0336 | pir:C71944 | C71944 |

Description

| ORF Name | NTID | AAID | NT Length | AA Length | Score | Probability |
|---|---|---|---|---|---|---|
| 24399035_c3_312 | 308 | 5530 | 60 | 183 | 44 | 0.049 |

| Protein name | Locus Name | Acc# |
|---|---|---|
| nonstructural protein | gp:AF012732 | AF012732 |

Description

Bovine viral diarrhea virus strain Yak nonstructural protein (p125) mRNA, partial cds.

| ORF Name | NTID | AAID | NT Length | AA Length | Score | Probability |
|---|---|---|---|---|---|---|
| 24408437_c2_228 | 309 | 5531 | 122 | 369 | 265 | 7.3e−23 |

| Protein name | Locus Name | Acc# |
|---|---|---|
|  | sp:THIO_BORBU | O51088 |

Description

THIOREDOXIN (TRX)

| ORF Name | NTID | AAID | NT Length | AA Length | Score | Probability |
|---|---|---|---|---|---|---|
| 24414153_f1_20 | 310 | 5532 | 448 | 1347 | 83 | 0.0040 |

| Protein name | Locus Name | Acc# |
|---|---|---|
| unknown | gp:U96771 | U96771 |

Description

*Prevotella bryantii* putative polygalacturonase, B-1,4-endoglucanase, and mannanase genes, complete cds; and unknown genes.

| ORF Name | NTID | AAID | NT Length | AA Length | Score | Probability |
|---|---|---|---|---|---|---|
| 24489452_c2_269 | 311 | 5533 | 560 | 1683 | 526 | 2.0e−58 |

| Protein name | Locus Name | Acc# |
|---|---|---|
| long-chain-fatty-acid CoA ligase | pir:D70386 | D70386 |

Description

| ORF Name | NTID | AAID | NT Length | AA Length | Score | Probability |
|---|---|---|---|---|---|---|
| 24644068_f2_94 | 312 | 5534 | 83 | 252 | 158 | 1.6e−11 |

| Protein name | Locus Name | Acc# |
|---|---|---|
|  | sp:ATPE_CHLLI | P35111 |

Description

ATP SYNTHASE EPSILON CHAIN,

-continued

| ORF Name | NTID | AAID | NT Length | AA Length | Score | Probability |
|---|---|---|---|---|---|---|
| 24808312_f1_49 | 313 | 5535 | 189 | 567 | 308 | 3.8e−26 |
| Protein name | | | Locus Name | | | Acc# |
| | | | sp:HELA_LEGPN | | | Q48815 |

Description

HELA PROTEIN

| ORF Name | NTID | AAID | NT Length | AA Length | Score | Probability |
|---|---|---|---|---|---|---|
| 24875042_f3_147 | 314 | 5536 | 76 | 231 | | |
| Protein name | | | Locus Name | | | Acc# |

Description

NO-HIT

| ORF Name | NTID | AAID | NT Length | AA Length | Score | Probability |
|---|---|---|---|---|---|---|
| 24881577_f2_85 | 315 | 5537 | 248 | 747 | 210 | 5.1e−16 |
| Protein name | | | Locus Name | | | Acc# |
| | | | sp:XYNB_BUTFI | | | P26223 |

Description (D-XYLAN XYLANOHYDROLASE B)

| ORF Name | NTID | AAID | NT Length | AA Length | Score | Probability |
|---|---|---|---|---|---|---|
| 25479842_c3_315 | 316 | 5538 | 67 | 204 | | |
| Protein name | | | Locus Name | | | Acc# |

Description

NO-HIT

| ORF Name | NTID | AAID | NT Length | AA Length | Score | Probability |
|---|---|---|---|---|---|---|
| 26446928_f3_113 | 317 | 5539 | 254 | 765 | 129 | 3.7e−05 |
| Protein name | | | Locus Name | | | Acc# |
| receptor antigen (RagA) | | | gp:PGI130872 | | | AJ130872 |

Description

*Porphyromonas gingivalis* W50 receptor antigen (rag) locus encoding a major immunodominant 55 kDa antigen.

| ORF Name | NTID | AAID | NT Length | AA Length | Score | Probability |
|---|---|---|---|---|---|---|
| 26831386_f3_139 | 318 | 5540 | 349 | 1050 | 507 | 1.7e−48 |
| Protein name | | | Locus Name | | | Acc# |
| | | | sp:PYRD_ECOLI | | | P05021 |

Description (DHODEHASE)

-continued

| ORF Name | NTID | AAID | NT Length | AA Length | Score | Probability |
|---|---|---|---|---|---|---|
| 2942827_c3_342 | 319 | 5541 | 1057 | 3174 | 214 | 3.5e−28 |
| Protein name | | | Locus Name | | | Acc# |
| probable ATP-dependent helicase | | | pir:A71805 | | | A71805 |

Description

| ORF Name | NTID | AAID | NT Length | AA Length | Score | Probability |
|---|---|---|---|---|---|---|
| 29494000_f1_48 | 320 | 5542 | 364 | 1095 | 309 | 4.8e−27 |
| Protein name | | | Locus Name | | | Acc# |
| | | | sp:CZCB_ALCSP | | | P94176 |

Description

CATION EFFLUX SYSTEM PROTEIN CZCB

| ORF Name | NTID | AAID | NT Length | AA Length | Score | Probability |
|---|---|---|---|---|---|---|
| 29572678_f2_63 | 321 | 5543 | 208 | 627 | 213 | 5.3e−16 |
| Protein name | | | Locus Name | | | Acc# |
| 115K outer membrane protein precursor:SusC protein | | | pir:JC6027 | | | JC6027 |

Description

| ORF Name | NTID | AAID | NT Length | AA Length | Score | Probability |
|---|---|---|---|---|---|---|
| 29973182_c2_246 | 322 | 5544 | 857 | 2574 | 1042 | 3.4e−105 |
| Protein name | | | Locus Name | | | Acc# |
| (p)ppGpp synthetase | | | gp:BSU86377 | | | U86377 |

Description

*Bacillus subtilis* (p)ppGpp synthetase (relA) and adeninephosphoribosyltransferase (apt) genes, complete cds.

| ORF Name | NTID | AAID | NT Length | AA Length | Score | Probability |
|---|---|---|---|---|---|---|
| 3131910_c2_268 | 323 | 5545 | 492 | 1479 | 832 | 6.0e−83 |
| Protein name | | | Locus Name | | | Acc# |
| | | | sp:YCGO_ECOLI | | | P76007 |

Description

PUTATIVE NA(+)/H(+) EXCHANGER YCGO

| ORF Name | NTID | AAID | NT Length | AA Length | Score | Probability |
|---|---|---|---|---|---|---|
| 3165800_c3_302 | 324 | 5546 | 103 | 312 | 134 | 5.5e−09 |
| Protein name | | | Locus Name | | | Acc# |
| ORF2 | | | gp:AB015879 | | | AB015879 |

Description

*Porphyromonas gingivalis* dnaK operon genes, complete cds.

-continued

| ORF Name | NTID | AAID | NT Length | AA Length | Score | Probability |
|---|---|---|---|---|---|---|
| 32660011_f3_150 | 325 | 5547 | 415 | 1248 | 276 | 5.8e−24 |

| Protein name | Locus Name | Acc# |
|---|---|---|
| | sp:ATP6_RHORU | P15012 |

Description

ATP SYNTHASE A CHAIN, (PROTEIN 6)

| ORF Name | NTID | AAID | NT Length | AA Length | Score | Probability |
|---|---|---|---|---|---|---|
| 33240828_f2_62 | 326 | 5548 | 885 | 2658 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 33788387_f2_78 | 327 | 5549 | 310 | 933 | 101 | 0.024 |

| Protein name | Locus Name | Acc# |
|---|---|---|
| conserved hypothetical protein | pir:G72385 | G72385 |

Description

| ORF Name | NTID | AAID | NT Length | AA Length | Score | Probability |
|---|---|---|---|---|---|---|
| 33992211_c1_181 | 328 | 5550 | 132 | 399 | 200 | 5.6e−16 |

| Protein name | Locus Name | Acc# |
|---|---|---|
| diacylglycerol kinase | gp:BSU29177 | U29177 |

Description

*Bacillus subtilis* PhoH (phoH) gene, partial cds, diacylglycerolkinase (dgk) gene, complete cds, and cytidine deaminase (cdd) gene, partial cds.

| ORF Name | NTID | AAID | NT Length | AA Length | Score | Probability |
|---|---|---|---|---|---|---|
| 34178385_f3_149 | 329 | 5551 | 511 | 1536 | 2540 | 6.1e−264 |

| Protein name | Locus Name | Acc# |
|---|---|---|
| | sp:ATPB_BACFR | P13356 |

Description

ATP SYNTHASE BETA CHAIN,

| ORF Name | NTID | AAID | NT Length | AA Length | Score | Probability |
|---|---|---|---|---|---|---|
| 34181561_f1_19 | 330 | 5552 | 602 | 1809 | 452 | 8.9e−52 |

| Protein name | Locus Name | Acc# |
|---|---|---|
| 115K outer membrane protein precursor:SusC protein | pir:JC6027 | JC6027 |

Description

-continued

| ORF Name | NTID | AAID | NT Length | AA Length | Score | Probability |
|---|---|---|---|---|---|---|
| 35625000_f2_92 | 331 | 5553 | 530 | 1593 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 3937751_f2_101 | 332 | 5554 | 864 | 2595 | 404 | 1.3e−36 |

| Protein name | | | | Locus Name | | Acc# |
|---|---|---|---|---|---|---|
| DNA helicase homolog | | | | gp:AF108138 | | AF108138 |

Description

*Homo sapiens* DNA helicase homolog (PIF1) mRNA, partial cds.

| ORF Name | NTID | AAID | NT Length | AA Length | Score | Probability |
|---|---|---|---|---|---|---|
| 4395252_c1_209 | 333 | 5555 | 528 | 1587 | 494 | 1.7e−62 |

| Protein name | | | | Locus Name | | Acc# |
|---|---|---|---|---|---|---|
| Beta-N-Acetylglucosaminidase | | | | gp:AB015350 | | AB015350 |

Description

*Streptomyces thermoviolaceus* nagB gene for Beta-N-Acetylglucosaminidase, complete cds.

| ORF Name | NTID | AAID | NT Length | AA Length | Score | Probability |
|---|---|---|---|---|---|---|
| 4454637_f1_5 | 334 | 5556 | 315 | 948 | 1058 | 6.8e−107 |

| Protein name | | | | Locus Name | | Acc# |
|---|---|---|---|---|---|---|
| dTDP-glucose 4-6-dehydratase:protein slr0809:protein slr0809 | | | | pir:S75550 | | S75550 |

Description

| ORF Name | NTID | AAID | NT Length | AA Length | Score | Probability |
|---|---|---|---|---|---|---|
| 4501875_f2_51 | 335 | 5557 | 124 | 375 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 4553376_c1_199 | 336 | 5558 | 459 | 1380 | 291 | 2.5e−25 |

| Protein name | | | | Locus Name | | Acc# |
|---|---|---|---|---|---|---|
| | | | | gp:ECOUW82 | | L10328 |

Description

*E. coli*; the region from 81.5 to 84.5 minutes.

-continued

| ORF Name | NTID | AAID | NT Length | AA Length | Score | Probability |
|---|---|---|---|---|---|---|
| 4881660_c2_266 | 337 | 5559 | 547 | 1644 | 1809 | 1.8e−186 |

| Protein name | Locus Name | Acc# |
|---|---|---|
| | sp:PRIS_DESVH | P31101 |

Description

PRISMANE PROTEIN

| ORF Name | NTID | AAID | NT Length | AA Length | Score | Probability |
|---|---|---|---|---|---|---|
| 5276557_f2_98 | 338 | 5560 | 169 | 510 | 197 | 1.2e−15 |

| Protein name | Locus Name | Acc# |
|---|---|---|
| ATP synthase F0, subunit b | pir:H72231 | H72231 |

Description

| ORF Name | NTID | AAID | NT Length | AA Length | Score | Probability |
|---|---|---|---|---|---|---|
| 5276586_f2_99 | 339 | 5561 | 189 | 570 | 215 | 1.4e−17 |

| Protein name | Locus Name | Acc# |
|---|---|---|
| F1F0-ATPase subunit delta | gp:AF098522 | AF098522 |

Description

*Lactobacillus acidophilus* uracil phosphoribosyltransferase (upp) gene, partial cds; and F1F0-ATPase operon, complete sequence.

| ORF Name | NTID | AAID | NT Length | AA Length | Score | Probability |
|---|---|---|---|---|---|---|
| 556557_f3_134 | 340 | 5562 | 478 | 1437 | 136 | 6.4e−06 |

| Protein name | Locus Name | Acc# |
|---|---|---|
| | sp:YF07_METJA | Q58902 |

Description

HYPOTHETICAL PROTEIN MJ1507

| ORF Name | NTID | AAID | NT Length | AA Length | Score | Probability |
|---|---|---|---|---|---|---|
| 5890667_c1_176 | 341 | 5563 | 95 | 288 | 213 | 2.4e−17 |

| Protein name | Locus Name | Acc# |
|---|---|---|
| RNA-binding protein | gp:ANARBPD2 | D49425 |

Description

*Anabaena variabilis* rbpD gene for RNA-binding protein, complete cds.

| ORF Name | NTID | AAID | NT Length | AA Length | Score | Probability |
|---|---|---|---|---|---|---|
| 6046881_f3_140 | 342 | 5564 | 306 | 921 | 655 | 3.4e−64 |

| Protein name | Locus Name | Acc# |
|---|---|---|
| 3-methyl-2-oxobutanoate | gp:CGPAN | X96580 |

Description

*C. glutamicum* panB, panC & xylB genes.

-continued

| ORF Name | NTID | AAID | NT Length | AA Length | Score | Probability |
|---|---|---|---|---|---|---|
| 6836013_c2_265 | 343 | 5565 | 443 | 1332 | 281 | 1.1e−21 |

| Protein name | Locus Name | Acc# |
|---|---|---|
|  | sp:NTRY_AZOCA | Q04850 |

Description

NITROGEN REGULATION PROTEIN NTRY,

| ORF Name | NTID | AAID | NT Length | AA Length | Score | Probability |
|---|---|---|---|---|---|---|
| 7072037_c3_322 | 344 | 5566 | 240 | 723 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 814126_f2_60 | 345 | 5567 | 84 | 255 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 9766325_f3_148 | 346 | 5568 | 422 | 1269 | 1070 | 3.6e−108 |

| Protein name | Locus Name | Acc# |
|---|---|---|
|  | sp:PURT_SYNY3 | Q55336 |

Description 2) (FORMATE-DEPENDENT GAR TRANSFORMYLASE)

| ORF Name | NTID | AAID | NT Length | AA Length | Score | Probability |
|---|---|---|---|---|---|---|
| 1057762_f2_175 | 347 | 5569 | 214 | 645 | 528 | 9.8e−51 |

| Protein name | Locus Name | Acc# |
|---|---|---|
| thio-specific antioxidant (tsa) peroxidase | pir:E72036 | E72036 |

Description

| ORF Name | NTID | AAID | NT Length | AA Length | Score | Probability |
|---|---|---|---|---|---|---|
| 1173263_c2_422 | 348 | 5570 | 77 | 234 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 11834382_c2_479 | 349 | 5571 | 299 | 900 | 79 | 0.021 |
| Protein name | | | Locus Name | | | Acc# |
| ATP binding protein | | | gp:BBATPBP | | | X91965 |

Description

*B. burgdorferi* abp gene.

| ORF Name | NTID | AAID | NT Length | AA Length | Score | Probability |
|---|---|---|---|---|---|---|
| 118906_c1_393 | 350 | 5572 | 165 | 498 | | |
| Protein name | | | Locus Name | | | Acc# |

Description

NO-HIT

| ORF Name | NTID | AAID | NT Length | AA Length | Score | Probability |
|---|---|---|---|---|---|---|
| 12204402_c2_483 | 351 | 5573 | 67 | 204 | 72 | 0.020 |
| Protein name | | | Locus Name | | | Acc# |
| pE66L | | | gp:ASU18466 | | | U18466 |

Description

African swine fever virus, complete genome.

| ORF Name | NTID | AAID | NT Length | AA Length | Score | Probability |
|---|---|---|---|---|---|---|
| 12677202_f3_307 | 352 | 5574 | 237 | 714 | 472 | 8.5e−45 |
| Protein name | | | Locus Name | | | Acc# |
| hypothetical protein | | | gp:AHAAMYG | | | X58627 |

Description

*A. haloplanktis* amy gene for alpha-amylase 1,4-alpha-D-glucanglucanohydrolase.

| ORF Name | NTID | AAID | NT Length | AA Length | Score | Probability |
|---|---|---|---|---|---|---|
| 13103938_c2_466 | 353 | 5575 | 159 | 480 | 227 | 5.6e−22 |
| Protein name | | | Locus Name | | | Acc# |
| single stranded DNA-binding protein | | | gp:SSU64095 | | | U64095 |

Description

*Shewanella* sp. PT99 single stranded DNA-binding protein (ssb) gene, complete cds.

| ORF Name | NTID | AAID | NT Length | AA Length | Score | Probability |
|---|---|---|---|---|---|---|
| 1367792_f3_258 | 354 | 5576 | 202 | 609 | 298 | 2.3e−26 |
| Protein name | | | Locus Name | | | Acc# |
| | | | sp:YB69_HAEIN | | | P44118 |

Description

HYPOTHETICAL PROTEIN HI1169

-continued

| ORF Name | NTID | AAID | NT Length | AA Length | Score | Probability |
|---|---|---|---|---|---|---|
| 1369082_c1_320 | 355 | 5577 | 419 | 1260 | 714 | 3.8e−75 |

| Protein name | Locus Name | Acc# |
|---|---|---|
| autoaggregation-mediating protein | gp:AF091502 | AF091502 |

Description

*Lactobacillus reuteri* autoaggregation-mediating protein (aggH) gene, complete cds.

| ORF Name | NTID | AAID | NT Length | AA Length | Score | Probability |
|---|---|---|---|---|---|---|
| 13787827_c2_468 | 356 | 5578 | 156 | 471 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 13876713_f2_124 | 357 | 5579 | 103 | 312 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 13914808_f2_181 | 358 | 5580 | 103 | 312 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 14304550_c2_490 | 359 | 5581 | 380 | 1143 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 1441937_c1_386 | 360 | 5582 | 322 | 969 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 14494037_c3_524 | 361 | 5583 | 262 | 789 | 256 | 1.5e−32 |

| Protein name | Locus Name | Acc# |
|---|---|---|
| | sp:CCSA_CYACA | P31564 |

Description

CYTOCHROME C BIOGENESIS PROTEIN CCSA

| ORF Name | NTID | AAID | NT Length | AA Length | Score | Probability |
|---|---|---|---|---|---|---|
| 14660927_c1_394 | 362 | 5584 | 1249 | 3750 | 259 | 7.8e−18 |

| Protein name | Locus Name | Acc# |
|---|---|---|
| | gp:SCYDL057W | |

Description

*S. cerevisiae* chromosome IV reading frame ORF YDL057w.

| ORF Name | NTID | AAID | NT Length | AA Length | Score | Probability |
|---|---|---|---|---|---|---|
| 14665882_c2_461 | 363 | 5585 | 153 | 462 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 14875191_c1_388 | 364 | 5586 | 365 | 1098 | 116 | 0.00061 |

| Protein name | Locus Name | Acc# |
|---|---|---|
| hypothetical protein | gp:YEN132945 | AJ132945 |

Description

*Yersinia enterocolitica* WA 314 right arm of the high-pathogenicityisland.

| ORF Name | NTID | AAID | NT Length | AA Length | Score | Probability |
|---|---|---|---|---|---|---|
| 156325_f2_176 | 365 | 5587 | 116 | 351 | 211 | 3.8e−17 |

| Protein name | Locus Name | Acc# |
|---|---|---|
| ss-DNA binding protein 12RNP2 precursor | gp:SYO12RNP2 | D17359 |

Description

*Synechococcus* 6301 gene for ss-DNA binding protein 12RNP2, complete cds.

| ORF Name | NTID | AAID | NT Length | AA Length | Score | Probability |
|---|---|---|---|---|---|---|
| 15660937_c1_345 | 366 | 5588 | 432 | 1299 | 617 | 3.6e−60 |

| Protein name | Locus Name | Acc# |
|---|---|---|
| hypothetical protein | pir:T33724 | T33724 |

Description

-continued

| ORF Name | NTID | AAID | NT Length | AA Length | Score | Probability |
|---|---|---|---|---|---|---|
| 162785_c3_565 | 367 | 5589 | 322 | 969 | 156 | 7.4e−09 |

| Protein name | Locus Name | Acc# |
|---|---|---|
| Mag44 | gp:DEPMAG44 | D17682 |

Description

*Dermatophagoides farinae* mRNA for Mag44, partial cds.

| ORF Name | NTID | AAID | NT Length | AA Length | Score | Probability |
|---|---|---|---|---|---|---|
| 16447875_c3_560 | 368 | 5590 | 63 | 192 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 16525318_c2_471 | 369 | 5591 | 574 | 1725 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 165882_c1_371 | 370 | 5592 | 1018 | 3057 | 179 | 7.8e−10 |

| Protein name | Locus Name | Acc# |
|---|---|---|
| | sp:PRIM_CLOAB | P33655 |

Description

DNA PRIMASE,

| ORF Name | NTID | AAID | NT Length | AA Length | Score | Probability |
|---|---|---|---|---|---|---|
| 16900087_c2_420 | 371 | 5593 | 279 | 840 | 414 | 1.2e−38 |

| Protein name | Locus Name | Acc# |
|---|---|---|
| hypothetical protein yycJ | pir:A70090 | A70090 |

Description

| ORF Name | NTID | AAID | NT Length | AA Length | Score | Probability |
|---|---|---|---|---|---|---|
| 17010890_c1_369 | 372 | 5594 | 113 | 342 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 180302_c3_559 | 373 | 5595 | 73 | 222 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 187930_c3_509 | 374 | 5596 | 359 | 1080 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 19035_f1_47 | 375 | 5597 | 674 | 2025 | 1563 | 2.1e−160 |

| Protein name | | | | Locus Name | | Acc# |
|---|---|---|---|---|---|---|
| branching enzyme | | | | gp:AB026630 | | AB026630 |

Description

*Emericella nidulans* gene for branching enzyme, complete cds.

| ORF Name | NTID | AAID | NT Length | AA Length | Score | Probability |
|---|---|---|---|---|---|---|
| 197191_f3_291 | 376 | 5598 | 381 | 1146 | 129 | 3.1e−05 |

| Protein name | | | | Locus Name | | Acc# |
|---|---|---|---|---|---|---|
| | | | | sp:PORP_PSEAE | | P05695 |

Description

PORIN P PRECURSOR (OUTER MEMBRANE PROTEIN D1)

| ORF Name | NTID | AAID | NT Length | AA Length | Score | Probability |
|---|---|---|---|---|---|---|
| 19729591_c1_380 | 377 | 5599 | 171 | 516 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 19734688_c2_423 | 378 | 5600 | 193 | 582 | 96 | 0.021 |

| Protein name | | | | Locus Name | | Acc# |
|---|---|---|---|---|---|---|
| two-component sensor histidine kinase homolog ybdK | | | | pir:F69747 | | F69747 |

Description

-continued

| ORF Name | NTID | AAID | NT Length | AA Length | Score | Probability |
|---|---|---|---|---|---|---|
| 19740893_c3_542 | 379 | 5601 | 408 | 1227 | 1169 | 1.2e−118 |

| Protein name | | | | Locus Name | | Acc# |
|---|---|---|---|---|---|---|
| | | | | sp:FSR_ECOLI | | P52067 |

Description

FOSMIDOMYCIN RESISTANCE PROTEIN

| ORF Name | NTID | AAID | NT Length | AA Length | Score | Probability |
|---|---|---|---|---|---|---|
| 1988388_f1_44 | 380 | 5602 | 64 | 195 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 20314007_c2_407 | 381 | 5603 | 827 | 2484 | 1786 | 4.8e−184 |

| Protein name | | | | Locus Name | | Acc# |
|---|---|---|---|---|---|---|
| | | | | sp:LON1_MYXXA | | P36773 |

Description

ATP-DEPENDENT PROTEASE LA 1,

| ORF Name | NTID | AAID | NT Length | AA Length | Score | Probability |
|---|---|---|---|---|---|---|
| 20344086_f2_157 | 382 | 5604 | 65 | 198 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 20350260_c2_405 | 383 | 5605 | 70 | 213 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 204437_f3_277 | 384 | 5606 | 231 | 696 | | |

| Protein name | | | | Locus Name | | Acc# |
|---|---|---|---|---|---|---|

Description

NO-HIT

-continued

| ORF Name | NTID | AAID | NT Length | AA Length | Score | Probability |
|---|---|---|---|---|---|---|
| 20501551_c1_325 | 385 | 5607 | 183 | 552 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 20980313_c1_392 | 386 | 5608 | 69 | 210 | 47 | 0.034 |

| Protein name | | | | Locus Name | | Acc# |
|---|---|---|---|---|---|---|
| | | | | sp:YOR5_TTV1 | | P19280 |

Description

HYPOTHETICAL 9.5 KD PROTEIN

| ORF Name | NTID | AAID | NT Length | AA Length | Score | Probability |
|---|---|---|---|---|---|---|
| 2126506_c1_314 | 387 | 5609 | 170 | 513 | 93 | 0.00016 |

| Protein name | | | | Locus Name | | Acc# |
|---|---|---|---|---|---|---|
| transcription regulator phage-related homolog ydcN | | | | pir:C69774 | | C69774 |

Description

| ORF Name | NTID | AAID | NT Length | AA Length | Score | Probability |
|---|---|---|---|---|---|---|
| 21485027_c2_481 | 388 | 5610 | 192 | 579 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 21490925_c1_365 | 389 | 5611 | 110 | 333 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 21664055_c3_585 | 390 | 5612 | 81 | 246 | 69 | 0.042 |

| Protein name | | | | Locus Name | | Acc# |
|---|---|---|---|---|---|---|
| ATP synthase gamma chain | | | | gp:AB027877 | | AB027877 |

Description

*Schizosaccharomyces pombe* gene for ATP synthase gamma chain, partial cds, clone:TA25.

-continued

| ORF Name | NTID | AAID | NT Length | AA Length | Score | Probability |
|---|---|---|---|---|---|---|
| 21677180_c3_566 | 391 | 5613 | 106 | 321 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 21688925_f1_40 | 392 | 5614 | 66 | 201 | 56 | 0.031 |

| Protein name | | | | Locus Name | | Acc# |
|---|---|---|---|---|---|---|
| estrogen receptor | | | | pir:S26595 | | S26595 |

Description

| ORF Name | NTID | AAID | NT Length | AA Length | Score | Probability |
|---|---|---|---|---|---|---|
| 21729812_c2_408 | 393 | 5615 | 374 | 1125 | 236 | 1.0e−17 |

| Protein name | | | | Locus Name | | Acc# |
|---|---|---|---|---|---|---|
| hypothetical protein slr0882 | | | | pir:S77272 | | S77272 |

Description

| ORF Name | NTID | AAID | NT Length | AA Length | Score | Probability |
|---|---|---|---|---|---|---|
| 21756268_c2_419 | 394 | 5616 | 81 | 246 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 22067162_f1_53 | 395 | 5617 | 506 | 1521 | 388 | 7.9e−41 |

| Protein name | | | | Locus Name | | Acc# |
|---|---|---|---|---|---|---|
| | | | | sp:GLNA_BACCE | | P19064 |

Description

GLUTAMINE SYNTHETASE, (GLUTAMATE--AMMONIA LIGASE)

| ORF Name | NTID | AAID | NT Length | AA Length | Score | Probability |
|---|---|---|---|---|---|---|
| 22087762_c3_496 | 396 | 5618 | 189 | 570 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 22132811_f2_180 | 397 | 5619 | 76 | 231 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 22459802_f2_159 | 398 | 5620 | 333 | 1002 | 759 | 3.3e−75 |

| Protein name | | | | Locus Name | | Acc# |
|---|---|---|---|---|---|---|
| p-aminobenzoate synthase component I homolog | | | | pir:F64187 | | F64187 |

Description

| ORF Name | NTID | AAID | NT Length | AA Length | Score | Probability |
|---|---|---|---|---|---|---|
| 22462807_c2_476 | 399 | 5621 | 178 | 537 | 93 | 0.042 |

| Protein name | | | | Locus Name | | Acc# |
|---|---|---|---|---|---|---|
| | | | | sp:TGN3_RAT | | P19814 |

Description

TRANS-GOLGI NETWORK INTEGRAL MEMBRANE PROTEIN TGN38 PRECURSOR

| ORF Name | NTID | AAID | NT Length | AA Length | Score | Probability |
|---|---|---|---|---|---|---|
| 22656553_f3_296 | 400 | 5622 | 275 | 828 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 23438887_c1_389 | 401 | 5623 | 126 | 381 | 87 | 0.013 |

| Protein name | | | | Locus Name | | Acc# |
|---|---|---|---|---|---|---|
| unknown | | | | gp:AF074396 | | AF074396 |

Description

*Desulfotomaculum thermocisternum*
UDP-acetylglucosamine1-carboxyvinyltransferase (murA) gene, partial cds;
yydA, ferredoxin (fdx), dissimilatory sulfite reductase subunit A
(dsrA), dissimilatory sulfite reductase subunit B (dsrB), and dsrD
genes, complete cds; and unknown gene.

| ORF Name | NTID | AAID | NT Length | AA Length | Score | Probability |
|---|---|---|---|---|---|---|
| 23472178_f3_271 | 402 | 5624 | 470 | 1413 | 1205 | 1.8e−122 |

| Protein name | | | | Locus Name | | Acc# |
|---|---|---|---|---|---|---|
| Xylose Isomerase | | | | gp:RFL132472 | | AJ132472 |

Description

*Ruminococcus flavefaciens* xylan utilization operon.

-continued

| ORF Name | NTID | AAID | NT Length | AA Length | Score | Probability |
|---|---|---|---|---|---|---|
| 23597202_c3_513 | 403 | 5625 | 198 | 597 | 48 | 0.039 |

| Protein name | Locus Name | Acc# |
|---|---|---|
| hypothetical protein F21D9.3 | pir:T21205 | T21205 |

Description

| ORF Name | NTID | AAID | NT Length | AA Length | Score | Probability |
|---|---|---|---|---|---|---|
| 23632132_f1_64 | 404 | 5626 | 510 | 1533 | 614 | 7.6e−60 |

| Protein name | Locus Name | Acc# |
|---|---|---|
| Xylulose kinase | gp:AF001974 | AF001974 |

Description

*Thermoanaerobacter ethanolicus* putative TrkG gene, partial cds, and putative TrkA, xylose isomerase (xylA) and xylulose kinase (xylB) genes, complete cds.

| ORF Name | NTID | AAID | NT Length | AA Length | Score | Probability |
|---|---|---|---|---|---|---|
| 23634708_c1_368 | 405 | 5627 | 84 | 255 | 69 | 0.042 |

| Protein name | Locus Name | Acc# |
|---|---|---|
|  | sp:YC13_METJA | Q58610 |

Description

HYPOTHETICAL PROTEIN MJ1213

| ORF Name | NTID | AAID | NT Length | AA Length | Score | Probability |
|---|---|---|---|---|---|---|
| 23651680_f2_191 | 406 | 5628 | 78 | 237 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 23690875_c1_318 | 407 | 5629 | 385 | 1158 | 931 | 1.9e−93 |

| Protein name | Locus Name | Acc# |
|---|---|---|
|  | sp:TGT_BACSU | O32053 |

Description

TRANSGLYCOSYLASE) (GUANINE INSERTION ENZYME)

| ORF Name | NTID | AAID | NT Length | AA Length | Score | Probability |
|---|---|---|---|---|---|---|
| 23710926_f2_184 | 408 | 5630 | 355 | 1068 | 82 | 0.013 |

| Protein name | Locus Name | Acc# |
|---|---|---|
| M protein precursor | pir:S61081 |  |

Description

-continued

| ORF Name | NTID | AAID | NT Length | AA Length | Score | Probability |
|---|---|---|---|---|---|---|
| 23865651_c1_327 | 409 | 5631 | 60 | 183 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 23922135_c3_495 | 410 | 5632 | 133 | 402 | 73 | 0.016 |
| Protein name | | | Locus Name | | | Acc# |
| MesF | | | gp:AF143443 | | | AF143443 |
| Description | | | | | | |

*Leuconostoc mesenteroides* plasmid pHY30 MesG (mesG) gene, partial cds; and mesentericin B105 (mesB), MesH (mesH), and MesF (mesF) genes, complete cds.

| ORF Name | NTID | AAID | NT Length | AA Length | Score | Probability |
|---|---|---|---|---|---|---|
| 24027213_c2_460 | 411 | 5633 | 206 | 621 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 24241261_f1_77 | 412 | 5634 | 229 | 690 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 24265886_c2_469 | 413 | 5635 | 158 | 477 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 24305437_c3_556 | 414 | 5636 | 80 | 243 | | |
| Protein name | | | Locus Name | | | Acc# |
| Description | | | | | | |

NO-HIT

-continued

| ORF Name | NTID | AAID | NT Length | AA Length | Score | Probability |
|---|---|---|---|---|---|---|
| 24322127_c3_567 | 415 | 5637 | 202 | 609 | | |

| Protein name | | | Locus Name | | Acc# | |
|---|---|---|---|---|---|---|
| | | | | | | |

Description

NO-HIT

| ORF Name | NTID | AAID | NT Length | AA Length | Score | Probability |
|---|---|---|---|---|---|---|
| 24344641_f3_233 | 416 | 5638 | 120 | 363 | | |

| Protein name | | | Locus Name | | Acc# | |
|---|---|---|---|---|---|---|
| | | | | | | |

Description

NO-HIT

| ORF Name | NTID | AAID | NT Length | AA Length | Score | Probability |
|---|---|---|---|---|---|---|
| 24397877_c1_374 | 417 | 5639 | 64 | 195 | 71 | 0.0075 |

| Protein name | | | Locus Name | | Acc# | |
|---|---|---|---|---|---|---|
| | | | sp:RAFR_ECOLI | | P21867 | |

Description

RAFFINOSE OPERON REPRESSOR

| ORF Name | NTID | AAID | NT Length | AA Length | Score | Probability |
|---|---|---|---|---|---|---|
| 24406557_f2_158 | 418 | 5640 | 252 | 759 | 151 | 4.2e−08 |

| Protein name | | | Locus Name | | Acc# | |
|---|---|---|---|---|---|---|
| protein antigen LmSTI1 | | | gp:LMU73845 | | U73845 | |

Description

Leishmania major protein antigen LmSTI1 mRNA, partial cds.

| ORF Name | NTID | AAID | NT Length | AA Length | Score | Probability |
|---|---|---|---|---|---|---|
| 24415912_f3_257 | 419 | 5641 | 122 | 369 | 80 | 0.0029 |

| Protein name | | | Locus Name | | Acc# | |
|---|---|---|---|---|---|---|
| putative repressor protein | | | gp: BA1242593 | | AJ242593 | |

Description

Bacteriophage A118 complete genome.

| ORF Name | NTID | AAID | NT Length | AA Length | Score | Probability |
|---|---|---|---|---|---|---|
| 24484682_c2_492 | 420 | 5642 | 359 | 1077 | | |

| Protein name | | | Locus Name | | Acc# | |
|---|---|---|---|---|---|---|
| | | | | | | |

Description

NO-HIT

| ORF Name | NTID | AAID | NT Length | AA Length | Score | Probability |
|---|---|---|---|---|---|---|
| 24503282_c3_538 | 421 | 5643 | 83 | 252 | 78 | 0.017 |

| Protein name | Locus Name | Acc# |
|---|---|---|
| hypothetical protein MJ1664 | pir:F64507 | F64507 |

Description

| ORF Name | NTID | AAID | NT Length | AA Length | Score | Probability |
|---|---|---|---|---|---|---|
| 24633387_c1_354 | 422 | 5644 | 331 | 996 | 635 | 4.5e−62 |

| Protein name | Locus Name | Acc# |
|---|---|---|
| hypothetical protein T27E13.6 | pir:T00580 | T00580 |

Description

| ORF Name | NTID | AAID | NT Length | AA Length | Score | Probability |
|---|---|---|---|---|---|---|
| 24640915_c2_480 | 423 | 5645 | 157 | 474 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24644636_c1_372 | 424 | 5646 | 111 | 336 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24645337_f3_295 | 425 | 5647 | 439 | 1320 | 1245 | 1.0e−126 |

| Protein name | Locus Name | Acc# |
|---|---|---|
| putative UDP-glucose dehydrogenase | gp:AF159428 | AF159428 |

Description

*Burkholderia pseudomallei* putative UDP-glucose dehydrogenase (udg), putative ADP-heptose synthase (waaE), and putative ADP-glycero-mannoheptose epimerase (gmhD) genes, complete cds.

| ORF Name | NTID | AAID | NT Length | AA Length | Score | Probability |
|---|---|---|---|---|---|---|
| 24648412_f1_23 | 426 | 5648 | 166 | 501 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 24648562_c3_555 | 427 | 5649 | 82 | 249 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24710926_f3_299 | 428 | 5650 | 174 | 525 | 121 | 1.8e−07 |

| Protein name | | | | Locus Name | | Acc# |
|---|---|---|---|---|---|---|
| thiol:disulfide interchange protein homolog yneN | | | | pir:E69891 | | E69891 |

Description

| ORF Name | NTID | AAID | NT Length | AA Length | Score | Probability |
|---|---|---|---|---|---|---|
| 24782635_f1_93 | 429 | 5651 | 187 | 564 | 544 | 2.0e−52 |

| Protein name | | | | Locus Name | | Acc# |
|---|---|---|---|---|---|---|
| dTDP-6-deoxy-D-glucose-3,5 epimerase | | | | gp:AF048749 | | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 24798568_f2_219 | 430 | 5652 | 206 | 621 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24804681_c1_370 | 431 | 5653 | 74 | 225 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24804807_f2_160 | 432 | 5654 | 228 | 687 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 24820925_f1_80 | 433 | 5655 | 113 | 342 | | |
| Protein name | | | Locus Name | | | Acc# |

Description

NO-HIT

| ORF Name | NTID | AAID | NT Length | AA Length | Score | Probability |
|---|---|---|---|---|---|---|
| 24882942_c3_544 | 434 | 5656 | 357 | 1074 | 666 | 2.3e−65 |
| Protein name | | | Locus Name | | | Acc# |
| | | | sp:YVAA_BACSU | | | O32223 |

Description

HYPOTHETICAL OXIDOREDUCTASE IN FHUD-OPUBD INTERGENIC REGION

| ORF Name | NTID | AAID | NT Length | AA Length | Score | Probability |
|---|---|---|---|---|---|---|
| 2537802_c2_404 | 435 | 5657 | 181 | 546 | 52 | 0.044 |
| Protein name | | | Locus Name | | | Acc# |
| envelope glycoprotein | | | gp:AF021739 | | | AF021739 |

Description

HIV-1 isolate slng clone 45 trom the Netherlands, envelopeglycoprotein (env) gene, partial cds.

| ORF Name | NTID | AAID | NT Length | AA Length | Score | Probability |
|---|---|---|---|---|---|---|
| 25428312_f3_285 | 436 | 5658 | 174 | 525 | | |
| Protein name | | | Locus Name | | | Acc# |

Description

NO-HIT

| ORF Name | NTID | AAID | NT Length | AA Length | Score | Probability |
|---|---|---|---|---|---|---|
| 25556532_c2_402 | 437 | 5659 | 145 | 438 | | |
| Protein name | | | Locus Name | | | Acc# |

Description

NO-HIT

| ORF Name | NTID | AAID | NT Length | AA Length | Score | Probability |
|---|---|---|---|---|---|---|
| 25572212_c1_315 | 438 | 5660 | 122 | 369 | 69 | 0.042 |
| Protein name | | | Locus Name | | | Acc# |
| hypothetical protein yopO | | | pir:T12849 | | | |

Description

-continued

| ORF Name | NTID | AAID | NT Length | AA Length | Score | Probability |
|---|---|---|---|---|---|---|
| 25664086_c1_390 | 439 | 5661 | 303 | 912 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 2595058_f2_127 | 440 | 5662 | 70 | 213 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 26433216_c3_499 | 441 | 5663 | 81 | 246 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 26517_c1_346 | 442 | 5664 | 69 | 210 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 26601510_c2_448 | 443 | 5665 | 71 | 216 | 101 | 1.7e−05 |

| Protein name | | | Locus Name | | | Acc# |
|---|---|---|---|---|---|---|
| hypothetical protein MJ1608 | | | pir:G64500 | | | G64500 |

Description

| ORF Name | NTID | AAID | NT Length | AA Length | Score | Probability |
|---|---|---|---|---|---|---|
| 26601577_c1_359 | 444 | 5666 | 268 | 807 | 425 | 8.1e−40 |

| Protein name | | | Locus Name | | | Acc# |
|---|---|---|---|---|---|---|
| conserved hypothetical protein aq_1386 | | | pir:F70420 | | | F70420 |

Description

| ORF Name | NTID | AAID | NT Length | AA Length | Score | Probability |
|---|---|---|---|---|---|---|
| 26692342_c2_446 | 445 | 5667 | 406 | 1221 | 856 | 1.7e−85 |

| Protein name | | | Locus Name | | | Acc# |
|---|---|---|---|---|---|---|
| succinate--CoA ligase (ADP-forming), beta chain | | | pir:H70439 | | | H70439 |

Description

-continued

| ORF Name | NTID | AAID | NT Length | AA Length | Score | Probability |
|---|---|---|---|---|---|---|
| 273261_c2_477 | 446 | 5668 | 480 | 1443 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 2770305_c3_580 | 447 | 5669 | 214 | 645 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 2822161_c1_395 | 448 | 5670 | 733 | 2202 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 2828211_f1_86 | 449 | 5671 | 73 | 222 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 2923187_c2_424 | 450 | 5672 | 149 | 450 | 138 | 2.1e−09 |
| Protein name | | | Locus Name | | | Acc# |
| | | | sp:YG02_HAEIN | | | P44270 |
| Description | | | | | | |
| HYPOTHETICAL PROTEIN HI1602 | | | | | | |

| ORF Name | NTID | AAID | NT Length | AA Length | Score | Probability |
|---|---|---|---|---|---|---|
| 29339125_f2_122 | 451 | 5673 | 79 | 240 | | |
| Protein name | | | Locus Name | | | Acc# |
| Description | | | | | | |
| NO-HIT | | | | | | |

-continued

| ORF Name | NTID | AAID | NT Length | AA Length | Score | Probability |
|---|---|---|---|---|---|---|
| 29412901_f1_79 | 452 | 5674 | 221 | 666 | 135 | 7.5e−14 |

| Protein name | Locus Name | Acc# |
|---|---|---|
| | sp:LSPA_STACA | Q59835 |

Description

PEPTIDASE) (SIGNAL PEPTIDASE II) (SPASE II)

| ORF Name | NTID | AAID | NT Length | AA Length | Score | Probability |
|---|---|---|---|---|---|---|
| 29470081_c1_376 | 453 | 5675 | 334 | 1005 | 102 | 0.0029 |

| Protein name | Locus Name | Acc# |
|---|---|---|
| hypothetical protein PH0283 | pir:D71453 | D71453 |

Description

| ORF Name | NTID | AAID | NT Length | AA Length | Score | Probability |
|---|---|---|---|---|---|---|
| 30289001_c3_525 | 454 | 5676 | 468 | 1407 | 1084 | 1.2e−109 |

| Protein name | Locus Name | Acc# |
|---|---|---|
| cytochrome c peroxidase | gp:AF200362 | AF200362 |

Description

*Haemophilus ducreyi* oxaloacetate decarboxylase gamma chain (oadG) gene, partial cds; oxaloacetate decarboxylase alpha chain (oadA), oxaloacetate decarboxylase beta chain (oadB), and alkylphosphonateuptake protein (phna) genes, complete cds; ccp gene, complete sequence; cytochrome c peroxidase gene, complete cds; and unknown gene.

| ORF Name | NTID | AAID | NT Length | AA Length | Score | Probability |
|---|---|---|---|---|---|---|
| 30588453_f1_1 | 455 | 5677 | 63 | 192 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 31672502_f1_24 | 456 | 5678 | 262 | 789 | 118 | 0.00032 |

| Protein name | Locus Name | Acc# |
|---|---|---|
| type I restriction enzyme hsdM:hypothetical protein H91_orf543:hypothetical protein H91_orf543 | pir:S73820 | S73820 |

Description

| ORF Name | NTID | AAID | NT Length | AA Length | Score | Probability |
|---|---|---|---|---|---|---|
| 32035967_c3_507 | 457 | 5679 | 121 | 366 | 161 | 7.6e−12 |

| Protein name | Locus Name | Acc# |
|---|---|---|
| hypothetical protein | gp:SSU18930 | Y18930 |

Description

*Sulfolobus solfataricus* 281 kb genomic DNA fragment, strain P2.

-continued

| ORF Name | NTID | AAID | NT Length | AA Length | Score | Probability |
|---|---|---|---|---|---|---|
| 33364762_c1_356 | 458 | 5680 | 300 | 903 | 890 | 4.3e−89 |

| Protein name | Locus Name | Acc# |
|---|---|---|
| succinate--CoA ligase (ADP-forming), alpha chain | pir:F69719 | F69719 |

Description

| ORF Name | NTID | AAID | NT Length | AA Length | Score | Probability |
|---|---|---|---|---|---|---|
| 3385955_c1_360 | 456 | 5681 | 586 | 1761 | 148 | 8.5e−16 |

| Protein name | Locus Name | Acc# |
|---|---|---|
| hypothetical protein TM1650 | pir:G72227 | G72227 |

Description

| ORF Name | NTID | AAID | NT Length | AA Length | Score | Probability |
|---|---|---|---|---|---|---|
| 34017140_c3_498 | 460 | 5682 | 64 | 195 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 34073250_f1_54 | 461 | 5683 | 258 | 777 | 234 | 1.4e−19 |

| Protein name | Locus Name | Acc# |
|---|---|---|
| | sp:YT29_MYCTU | P71564 |

Description

PUTATIVE OXIDOREDUCTASE RV0945,

| ORF Name | NTID | AAID | NT Length | AA Length | Score | Probability |
|---|---|---|---|---|---|---|
| 34176462_c2_418 | 462 | 5684 | 472 | 1419 | 1369 | 7.5e−140 |

| Protein name | Locus Name | Acc# |
|---|---|---|
| | sp:UXAC_ECOLI | |

Description

ISOMERASE)

| ORF Name | NTID | AAID | NT Length | AA Length | Score | Probability |
|---|---|---|---|---|---|---|
| 34277280_c1_378 | 463 | 5685 | 257 | 774 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 34406502_c2_403 | 464 | 5686 | 130 | 393 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 34407787_f1_55 | 465 | 5687 | 198 | 597 | 132 | 7.8e−07 |
| Protein name | | | Locus Name | | | Acc# |
| | | | sp:Y374_METJA | | | Q57819 |
| Description | | | | | | |

HYPOTHETICAL PROTEIN MJ0374

| ORF Name | NTID | AAID | NT Length | AA Length | Score | Probability |
|---|---|---|---|---|---|---|
| 35634587_f1_74 | 466 | 5688 | 532 | 1599 | 1249 | 3.9e−127 |
| Protein name | | | Locus Name | | | Acc# |
| | | | sp:YHCX_BACSU | | | P54608 |
| Description | | | | | | |

HYPOTHETICAL 60.2 KD PROTEIN IN CSPB-GLPP INTERGENIC REGION

| ORF Name | NTID | AAID | NT Length | AA Length | Score | Probability |
|---|---|---|---|---|---|---|
| 36337562_c3_553 | 467 | 5689 | 139 | 420 | 91 | 0.00020 |
| Protein name | | | Locus Name | | | Acc# |
| regulatory protein CsgD | | | gp:ECOCURLI2 | | | AF081826 |
| Description | | | | | | |

*Escherichia coli* csg cluster, partial sequence.

| ORF Name | NTID | AAID | NT Length | AA Length | Score | Probability |
|---|---|---|---|---|---|---|
| 36500003_c1_328 | 468 | 5690 | 430 | 1293 | 849 | 9.5e−85 |
| Protein name | | | Locus Name | | | Acc# |
| macrolide-efflux determinant | | | gp:SPU83667 | | | U83667 |
| Description | | | | | | |

*Streptococcus pneumoniae* macrolide-efflux determinant (mefE) gene, complete cds.

| ORF Name | NTID | AAID | NT Length | AA Length | Score | Probability |
|---|---|---|---|---|---|---|
| 3938838_c1_373 | 469 | 5691 | 131 | 396 | | |
| Protein name | | | Locus Name | | | Acc# |
| Description | | | | | | |

NO-HIT

-continued

| ORF Name | NTID | AAID | NT Length | AA Length | Score | Probability |
|---|---|---|---|---|---|---|
| 4021882_c3_563 | 470 | 5692 | 431 | 1296 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 4062628_c3_577 | 471 | 5693 | 115 | 348 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 4065760_f1_63 | 472 | 5694 | 255 | 768 | 239 | 4.1e−20 |

| Protein name | | | | Locus Name | | Acc# |
|---|---|---|---|---|---|---|
| hypothetical protein | | | | pir:S75926 | | S75926 |

Description

| ORF Name | NTID | AAID | NT Length | AA Length | Score | Probability |
|---|---|---|---|---|---|---|
| 4072687_f1_81 | 473 | 5695 | 773 | 2322 | 121 | 1.5e−05 |

| Protein name | | | | Locus Name | | Acc# |
|---|---|---|---|---|---|---|
| outer membrane protein | | | | gp:NGU81959 | | U81959 |

Description

*Neisseria gonorrhoeae* outer membrane protein (omp85) gene, complete cds.

| ORF Name | NTID | AAID | NT Length | AA Length | Score | Probability |
|---|---|---|---|---|---|---|
| 4157536_c3_576 | 474 | 5696 | 88 | 267 | 77 | 0.018 |

| Protein name | | | | Locus Name | | Acc# |
|---|---|---|---|---|---|---|
| hypothetical protein ZC47.1 | | | | pir:T27592 | | T27592 |

Description

| ORF Name | NTID | AAID | NT Length | AA Length | Score | Probability |
|---|---|---|---|---|---|---|
| 4318885_f2_174 | 475 | 5697 | 509 | 1530 | 1371 | 4.6e−140 |

| Protein name | | | | Locus Name | | Acc# |
|---|---|---|---|---|---|---|
| xylose transporter | | | | gp:AB009593 | | AB009593 |

Description

*Tetragenococcus halophilus* rbsC, rbsB, xylR, xylA, xylB and xylE genes, partial and complete cds.

-continued

| ORF Name | NTID | AAID | NT Length | AA Length | Score | Probability |
|---|---|---|---|---|---|---|
| 4345012_f2_166 | 476 | 5698 | 196 | 591 | 92 | 0.028 |

| Protein name | | | Locus Name | | | Acc# |
|---|---|---|---|---|---|---|
| | | | sp:CRP_ECOLI | | | P03020 |

Description

PROTEIN)

| ORF Name | NTID | AAID | NT Length | AA Length | Score | Probability |
|---|---|---|---|---|---|---|
| 4553288_f1_45 | 477 | 5699 | 67 | 204 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 4695285_c2_434 | 478 | 5700 | 319 | 960 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 4773400_c3_557 | 479 | 5701 | 119 | 360 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 4791400_f2_134 | 480 | 5702 | 71 | 216 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 4877135_f3_279 | 481 | 5703 | 1149 | 3450 | 991 | 1.7e−211 |

| Protein name | | | Locus Name | | | Acc# |
|---|---|---|---|---|---|---|
| isoleucine--tRNA ligase, ileS:isoleucyl-tRNA synthetase:isoleucyl-tRNA synthetase | | | pir:H70203 | | | H70203 |

Description

-continued

| ORF Name | NTID | AAID | NT Length | AA Length | Score | Probability |
|---|---|---|---|---|---|---|
| 4883592_c3_574 | 482 | 5704 | 181 | 546 | | |

| Protein name | | Locus Name | | Acc# |
|---|---|---|---|---|
| | | | | |

Description

NO-HIT

| ORF Name | NTID | AAID | NT Length | AA Length | Score | Probability |
|---|---|---|---|---|---|---|
| 4978302_c3_504 | 483 | 5705 | 424 | 1275 | 659 | 1.3e−64 |

| Protein name | | Locus Name | | Acc# |
|---|---|---|---|---|
| probable phosphoserine phosphatase | | pir:T36772 | | T36772 |

Description

| ORF Name | NTID | AAID | NT Length | AA Length | Score | Probability |
|---|---|---|---|---|---|---|
| 564077_c2_447 | 484 | 5706 | 78 | 237 | | |

| Protein name | | Locus Name | | Acc# |
|---|---|---|---|---|
| | | | | |

Description

NO-HIT

| ORF Name | NTID | AAID | NT Length | AA Length | Score | Probability |
|---|---|---|---|---|---|---|
| 6022037_c1_337 | 485 | 5707 | 353 | 1062 | 764 | 9.6e−76 |

| Protein name | | Locus Name | | Acc# |
|---|---|---|---|---|
| | | sp:YHIM_ECOLI | | |

Description

HYPOTHETICAL 39.2 KD PROTEIN IN RHSB-PIT INTERGENIC REGION

| ORF Name | NTID | AAID | NT Length | AA Length | Score | Probability |
|---|---|---|---|---|---|---|
| 6347188_c3_588 | 486 | 5708 | 1643 | 4932 | 161 | 1.3e−08 |

| Protein name | | Locus Name | | Acc# |
|---|---|---|---|---|
| | | gp:AB008550 | | AB008550 |

Description

*Pseudomonas aeruginosa* phage phi CTX, complete genome sequence.

| ORF Name | NTID | AAID | NT Length | AA Length | Score | Probability |
|---|---|---|---|---|---|---|
| 6834807_f1_78 | 487 | 5709 | 130 | 393 | 127 | 3.1e−08 |

| Protein name | | Locus Name | | Acc# |
|---|---|---|---|---|
| probable dnaK suppressor | | pir:D71366 | | D71366 |

Description

-continued

| ORF Name | NTID | AAID | NT Length | AA Length | Score | Probability |
|---|---|---|---|---|---|---|
| 817827_c3_515 | 488 | 5710 | 253 | 762 | 283 | 9.0e−25 |

| Protein name | | | Locus Name | | | Acc# |
|---|---|---|---|---|---|---|
| rRNA methylase homolog ysgA | | | pir:G69984 | | | G69984 |

Description

| ORF Name | NTID | AAID | NT Length | AA Length | Score | Probability |
|---|---|---|---|---|---|---|
| 829436_c3_535 | 489 | 5711 | 343 | 1032 | 600 | 2.3e−58 |

| Protein name | | | Locus Name | | | Acc# |
|---|---|---|---|---|---|---|
| protein kinase homolog Thi | | | gp: AF070520 | | | AF070520 |

Description

*Sinorhizobium meliloti* protein kinase homolog Thi (thi) and ExoP-like protein genes, complete cds; and unknown genes.

| ORF Name | NTID | AAID | NT Length | AA Length | Score | Probability |
|---|---|---|---|---|---|---|
| 84637_c1_366 | 490 | 5712 | 68 | 207 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 9884427_f3_287 | 491 | 5713 | 66 | 201 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 9957827_c1_326 | 492 | 5714 | 413 | 1242 | 110 | 3.3e−14 |

| Protein name | | | Locus Name | | | Acc# |
|---|---|---|---|---|---|---|
| | | | sp:YBGH_ECOLI | | | P75742 |

Description

HYPOTHETICAL 54.2 KD PROTEIN IN PHRB-NEI INTERGENIC REGION

| ORF Name | NTID | AAID | NT Length | AA Length | Score | Probability |
|---|---|---|---|---|---|---|
| 10320312_f2_49 | 493 | 5715 | 328 | 987 | | |

| Protein name | | | Locus Name | | | Acc# |
|---|---|---|---|---|---|---|

Description

NO-HIT

-continued

| ORF Name | NTID | AAID | NT Length | AA Length | Score | Probability |
|---|---|---|---|---|---|---|
| 10681577_c3_251 | 494 | 5716 | 103 | 312 | 114 | 7.3e−07 |

| Protein name | Locus Name | Acc# |
|---|---|---|
| hypothetical protein APE1165 | pir:H72586 | H72586 |

Description

| ORF Name | NTID | AAID | NT Length | AA Length | Score | Probability |
|---|---|---|---|---|---|---|
| 10828567_f3_89 | 495 | 5717 | 204 | 615 | 148 | 1.8e−10 |

| Protein name | Locus Name | Acc# |
|---|---|---|
| conserved hypothetical protein | pir:C72361 | C72361 |

Description

| ORF Name | NTID | AAID | NT Length | AA Length | Score | Probability |
|---|---|---|---|---|---|---|
| 13865887_c2_187 | 496 | 5718 | 64 | 195 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 1414187_f3_80 | 497 | 5719 | 316 | 951 | 357 | 1.3e−32 |

| Protein name | Locus Name | Acc# |
|---|---|---|
| | gp:AB012956 | AB012956 |

Description

*Vibrio cholerae* genes for O-antigen synthesis, strain MO45, complete cds.

| ORF Name | NTID | AAID | NT Length | AA Length | Score | Probability |
|---|---|---|---|---|---|---|
| 14485841_f3_95 | 498 | 5720 | 208 | 627 | 659 | 1.3e−64 |

| Protein name | Locus Name | Acc# |
|---|---|---|
| rubrerythrin | gp:AF202316 | AF202316 |

Description

*Moorella thermoacetica* rubrerythrin gene, complete cds.

| ORF Name | NTID | AAID | NT Length | AA Length | Score | Probability |
|---|---|---|---|---|---|---|
| 14491537_f1_22 | 499 | 5721 | 682 | 2049 | 101 | 0.012 |

| Protein name | Locus Name | Acc# |
|---|---|---|
| comEA protein-related protein | pir:F72301 | F72301 |

Description

-continued

| ORF Name | NTID | AAID | NT Length | AA Length | Score | Probability |
|---|---|---|---|---|---|---|
| 14569387_f3_81 | 500 | 5722 | 158 | 477 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 15105001_c2_156 | 501 | 5723 | 119 | 360 | 87 | 0.013 |
| Protein name | | | Locus Name | | | Acc# |
| hypothetical protein M70.1 | | | pir:T33032 | | | T33032 |
| Description | | | | | | |

| ORF Name | NTID | AAID | NT Length | AA Length | Score | Probability |
|---|---|---|---|---|---|---|
| 15751503_c3_228 | 502 | 5724 | 219 | 660 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 158136_f3_76 | 503 | 5725 | 308 | 927 | 399 | 4.6e−37 |
| Protein name | | | Locus Name | | | Acc# |
| conserved hypothetical protein | | | pir:G72409 | | | G72409 |
| Description | | | | | | |

| ORF Name | NTID | AAID | NT Length | AA Length | Score | Probability |
|---|---|---|---|---|---|---|
| 16056463_c3_236 | 504 | 5726 | 75 | 228 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 194025_f1_30 | 505 | 5727 | 145 | 438 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 20506875_f3_79 | 506 | 5728 | 211 | 636 | 202 | 3.5e−16 |
| Protein name | | | Locus Name | | | Acc# |
| | | | sp:Y516_BORBU | | | O51468 |
| Description | | | | | | |
| HYPOTHETICAL TRNA/RRNA METHYLTRANSFERASE BB0516, | | | | | | |

-continued

| ORF Name | NTID | AAID | NT Length | AA Length | Score | Probability |
|---|---|---|---|---|---|---|
| 20509632_f1_31 | 507 | 5729 | 448 | 1347 | 829 | 1.2e−82 |
| Protein name | | | Locus Name | | | Acc# |
| dihydrolipoamide dehydrogenase,:2-oxoglutarate dehydrogenase complex chain E3:acetoin dehydrogenase complex | | | pir:I40794 | | | I40794 |
| Description | | | | | | |

| ORF Name | NTID | AAID | NT Length | AA Length | Score | Probability |
|---|---|---|---|---|---|---|
| 20995143_c2_182 | 508 | 5730 | 83 | 252 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 2220010_c1_147 | 509 | 5731 | 82 | 249 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 22382311_f1_3 | 510 | 5732 | 318 | 957 | 287 | 3.4e−25 |
| Protein name | | | Locus Name | | | Acc# |
| putative oxidoreductase | | | gp:SCF76 | | | AL121600 |
| Description | | | | | | |
| *Streptomyces coelicolor* cosmid F76. | | | | | | |

| ORF Name | NTID | AAID | NT Length | AA Length | Score | Probability |
|---|---|---|---|---|---|---|
| 22679637_f1_11 | 511 | 5733 | 199 | 600 | 366 | 1.4e−33 |
| Protein name | | | Locus Name | | | Acc# |
| conserved hypothetical protein ysnA | | | pir:C69986 | | | C69986 |
| Description | | | | | | |

| ORF Name | NTID | AAID | NT Length | AA Length | Score | Probability |
|---|---|---|---|---|---|---|
| 23516942_f1_15 | 512 | 5734 | 493 | 1482 | 127 | 8.3e−05 |
| Protein name | | | Locus Name | | | Acc# |
| outer membrane protein tolc precursor (tolC) RP224 | | | pir:H71733 | | | H71733 |
| Description | | | | | | |

-continued

| ORF Name | NTID | AAID | NT Length | AA Length | Score | Probability |
|---|---|---|---|---|---|---|
| 23594000_f1_17 | 513 | 5735 | 192 | 579 | | |
| Protein name | | | | Locus Name | | Acc# |

Description

NO-HIT

| ORF Name | NTID | AAID | NT Length | AA Length | Score | Probability |
|---|---|---|---|---|---|---|
| 23632911_c2_157 | 514 | 5736 | 506 | 1521 | 1269 | 3.0e−129 |
| Protein name | | | | Locus Name | | Acc# |
| | | | | sp:YGFH_ECOLI | | P52043 |

Description

HYPOTHETICAL 53.8 KD PROTEIN IN SBM-FBA INTERGENIC REGION (O492)

| ORF Name | NTID | AAID | NT Length | AA Length | Score | Probability |
|---|---|---|---|---|---|---|
| 23986267_f1_19 | 515 | 5737 | 148 | 447 | | |
| Protein name | | | | Locus Name | | Acc# |

Description

NO-HIT

| ORF Name | NTID | AAID | NT Length | AA Length | Score | Probability |
|---|---|---|---|---|---|---|
| 24116567_f2_53 | 516 | 5738 | 457 | 1374 | 194 | 2.5e−12 |
| Protein name | | | | Locus Name | | Acc# |
| chromosomal hemolysin D | | | | gp:AF081284 | | AF081284 |

Description

*Escherichia coli* strain CFT073 chromosomal hemolysin D (hlyD) gene, partial cds; and Hp1 (hp1), Hp2 (hp2), Hp3 (hp3), and Hp4 (hp4) genes, complete cds.

| ORF Name | NTID | AAID | NT Length | AA Length | Score | Probability |
|---|---|---|---|---|---|---|
| 24225302_f1_16 | 517 | 5739 | 607 | 1824 | | |
| Protein name | | | | Locus Name | | Acc# |

Description

NO-HIT

| ORF Name | NTID | AAID | NT Length | AA Length | Score | Probability |
|---|---|---|---|---|---|---|
| 24260952_c3_221 | 518 | 5740 | 84 | 255 | | |
| Protein name | | | | Locus Name | | Acc# |

Description

NO-HIT

-continued

| ORF Name | NTID | AAID | NT Length | AA Length | Score | Probability |
|---|---|---|---|---|---|---|
| 24409662_c2_166 | 519 | 5741 | 104 | 315 | 107 | 6.8e-11 |

| Protein name | Locus Name | Acc# |
|---|---|---|
| iron-uptake factor | gp:AF051690 | AF051690 |

Description

*Pseudomonas aeruginosa* iron-uptake factor (piuC), hydroxamate-type ferrisiderophore receptor (piuA), and iron-uptake factor (piuB) genes, complete cds.

| ORF Name | NTID | AAID | NT Length | AA Length | Score | Probability |
|---|---|---|---|---|---|---|
| 24415875_f2_55 | 520 | 5742 | 538 | 1617 | 521 | 7.2e-68 |

| Protein name | Locus Name | Acc# |
|---|---|---|
| arylsulfatase | gp:PATTSAGN | Z48540 |

Description

*Pseudomonas aeruginosa* atsR, atsB, atsC & atsA genes.

| ORF Name | NTID | AAID | NT Length | AA Length | Score | Probability |
|---|---|---|---|---|---|---|
| 24495337_c2_190 | 521 | 5743 | 338 | 1017 | 962 | 1.0e-96 |

| Protein name | Locus Name | Acc# |
|---|---|---|
|  | sp:NADA_SYNY3 | P74578 |

Description

QUINOLINATE SYNTHETASE A

| ORF Name | NTID | AAID | NT Length | AA Length | Score | Probability |
|---|---|---|---|---|---|---|
| 24641537_f3_104 | 522 | 5744 | 474 | 1425 | 417 | 5.7e-39 |

| Protein name | Locus Name | Acc# |
|---|---|---|
|  | sp:FUCO_RAT | P17164 |

Description

I) (ALPHA-L-FUCOSIDE FUCOHYDROLASE)

| ORF Name | NTID | AAID | NT Length | AA Length | Score | Probability |
|---|---|---|---|---|---|---|
| 24713961_f2_37 | 523 | 5745 | 304 | 915 | 376 | 1.3E-34 |

| Protein name | Locus Name | Acc# |
|---|---|---|
| prolipoprotein diacylglyceryl transferase (lgt) RP046 | pir:F71712 | F71712 |

Description

| ORF Name | NTID | AAID | NT Length | AA Length | Score | Probability |
|---|---|---|---|---|---|---|
| 25505386_f1_4 | 524 | 5746 | 244 | 735 | 232 | 2.3e-19 |

| Protein name | Locus Name | Acc# |
|---|---|---|
| chloramphenicol acetyltransferase | gp:AF124757 | AF124757 |

Description

*Zymomonas mobilis* fosmid clone 43D2, complete sequence.

-continued

| ORF Name | NTID | AAID | NT Length | AA Length | Score | Probability |
|---|---|---|---|---|---|---|
| 25579383_f3_82 | 525 | 5747 | 627 | 1884 | 81 | 0.0020 |
| Protein name | | | Locus Name | | | Acc# |
| | | | sp:EREB_ECOLI | | | P05789 |

Description

ERYTHROMYCIN ESTERASE TYPE II

| ORF Name | NTID | AAID | NT Length | AA Length | Score | Probability |
|---|---|---|---|---|---|---|
| 26367135_f3_70 | 526 | 5748 | 374 | 1125 | 1148 | 2.0e−116 |
| Protein name | | | Locus Name | | | Acc# |
| | | | sp:YYAF_BACSU | | | P37518 |

Description

REGION

| ORF Name | NTID | AAID | NT Length | AA Length | Score | Probability |
|---|---|---|---|---|---|---|
| 26757637_f3_88 | 527 | 5749 | 735 | 2208 | 867 | 1.2e−86 |
| Protein name | | | Locus Name | | | Acc# |
| hemolysin secretion protein hlyB:protein sll1180:protein sll1180 | | | pir:S75806 | | | S75806 |

Description

| ORF Name | NTID | AAID | NT Length | AA Length | Score | Probability |
|---|---|---|---|---|---|---|
| 2741426_f3_98 | 528 | 5752 | 397 | 1194 | 355 | 2.1e−32 |
| Protein name | | | Locus Name | | | Acc# |
| | | | sp:PBP_BACSU | | | P39844 |

Description

PUTATIVE PENICILLIN BINDING PROTEIN PRECURSOR

| ORF Name | NTID | AAID | NT Length | AA Length | Score | Probability |
|---|---|---|---|---|---|---|
| 2928307_c3_215 | 529 | 5751 | 527 | 1584 | 1185 | 2.4e−120 |
| Protein name | | | Locus Name | | | Acc# |
| | | | sp:NADB_PSEAE | | | |

Description

L-ASPARTATE OXIDASE, (QUINOLINATE SYNTHETASE B)

| ORF Name | NTID | AAID | NT Length | AA Length | Score | Probability |
|---|---|---|---|---|---|---|
| 33992307_f1_23 | 530 | 5752 | 261 | 786 | 257 | 5.1e−22 |
| Protein name | | | Locus Name | | | Acc# |
| | | | sp:Y117_HELPY | | | P56080 |

Description

HYPOTHETICAL PROTEIN HP0117

-continued

| ORF Name | NTID | AAID | NT Length | AA Length | Score | Probability |
|---|---|---|---|---|---|---|
| 34376678_c1_141 | 531 | 5753 | 892 | 2679 | 1603 | 1.2e−164 |

| Protein name | Locus Name | Acc# |
|---|---|---|
| | sp:MUTS_HAEIN | P44834 |

Description

DNA MISMATCH REPAIR PROTEIN MUTS

| ORF Name | NTID | AAID | NT Length | AA Length | Score | Probability |
|---|---|---|---|---|---|---|
| 4094128_f2_51 | 532 | 5754 | 599 | 1800 | 83 | 0.026 |

| Protein name | Locus Name | Acc# |
|---|---|---|
| erythromycin esterase homolog ybfO | pir:A69750 | A69750 |

Description

| ORF Name | NTID | AAID | NT Length | AA Length | Score | Probability |
|---|---|---|---|---|---|---|
| 424042_f3_103 | 533 | 5755 | 470 | 1413 | 557 | 1.2e−101 |

| Protein name | Locus Name | Acc# |
|---|---|---|
| putative protein | gp:ATAP22 | Z99708 |

Description

*Arabidopsis thaliana* DNA chromosome 4, ESSA I AP2 contig fragment No. 2

| ORF Name | NTID | AAID | NT Length | AA Length | Score | Probability |
|---|---|---|---|---|---|---|
| 4332837_f3_86 | 534 | 5756 | 228 | 687 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4422762_f2_52 | 535 | 5757 | 238 | 717 | 172 | 8.4e−12 |

| Protein name | Locus Name | Acc# |
|---|---|---|
| putative glucosyl transferase | gp:AF105116 | AF105116 |

Description

*Streptococcus pneumoniae* type 19C Cps19CR (cps19CR) gene, partial cds; putative oligosaccharide repeat unit transporter (cps19CJ), UDP-N-acetyl glucosamine-2-epimerase (cps19CK), and putative glucosyl transferase (cps19CS) genes, complete cds; and glucose-1-phosphate thymidylyl transferase (cps19CL) gene, partial cds.

| ORF Name | NTID | AAID | NT Length | AA Length | Score | Probability |
|---|---|---|---|---|---|---|
| 4547063_c2_181 | 536 | 5758 | 94 | 285 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 4569126_f2_68 | 537 | 5759 | 88 | 267 | 87 | 0.0057 |

| Protein name | Locus Name | Acc# |
|---|---|---|
| | sp:PBP4_HAEIN | P45161 |

Description

| ORF Name | NTID | AAID | NT Length | AA Length | Score | Probability |
|---|---|---|---|---|---|---|
| 4901587_c1_114 | 538 | 5760 | 562 | 1689 | 1101 | 1.9e−111 |

| Protein name | Locus Name | Acc# |
|---|---|---|
| probable sulfate transporter | pir:A71463 | A71463 |

Description

| ORF Name | NTID | AAID | NT Length | AA Length | Score | Probability |
|---|---|---|---|---|---|---|
| 5985875_c3_220 | 539 | 5761 | 810 | 2433 | 615 | 5.9e−60 |

| Protein name | Locus Name | Acc# |
|---|---|---|
| ferrichrome-iron receptor 3:protein slr1490:protein slr1490 | pir:S74457 | S74457 |

Description

| ORF Name | NTID | AAID | NT Length | AA Length | Score | Probability |
|---|---|---|---|---|---|---|
| 6767057_f2_34 | 540 | 5762 | 372 | 1119 | 166 | 3.7e−09 |

| Protein name | Locus Name | Acc# |
|---|---|---|
| hypothetical protein PAB1767 | pir:B75136 | B75136 |

Description

| ORF Name | NTID | AAID | NT Length | AA Length | Score | Probability |
|---|---|---|---|---|---|---|
| 813302_f1_9 | 541 | 5763 | 373 | 1122 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 970680_f1_10 | 542 | 5764 | 965 | 2898 | 1588 | 5.1e−217 |

| Protein name | Locus Name | Acc# |
|---|---|---|
| putative leucyl tRNA synthetase | gp:AF069441 | AF069441 |

Description

*Arabidopsis thaliana* BAC T19B17 from chromosome IV, near 19.3 cM, complete sequence.

-continued

| ORF Name | NTID | AAID | NT Length | AA Length | Score | Probability |
|---|---|---|---|---|---|---|
| 10158452_c2_398 | 543 | 5765 | 250 | 753 | 587 | 5.5e−57 |

| Protein name | Locus Name | Acc# |
|---|---|---|
| putative glycosyl transferase | gp:AF048749 | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 1054637_f3_214 | 544 | 5766 | 211 | 636 | 1033 | 3.0e−104 |

| Protein name | Locus Name | Acc# |
|---|---|---|
| superoxide dismutase | gp:BNRSOD2 | D13756 |

Description

*Bacteroides fragilis* DNA for superoxide dismutase, complete cds.

| ORF Name | NTID | AAID | NT Length | AA Length | Score | Probability |
|---|---|---|---|---|---|---|
| 10750067_c2_445 | 545 | 5767 | 126 | 381 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 10803580_c2_394 | 546 | 5768 | 283 | 852 | 803 | 7.1e−80 |

| Protein name | Locus Name | Acc# |
|---|---|---|
| alpha-D-glucose−1-phosphate | gp:YEPASCA | L27130 |

Description

*Yersinia pseudotuberculosos* alpha-D-glucose−1-phosphatecytidylyltransferase (ascA) gene, complete cds.

| ORF Name | NTID | AAID | NT Length | AA Length | Score | Probability |
|---|---|---|---|---|---|---|
| 10837887_c1_303 | 547 | 5769 | 374 | 1125 | 1002 | 5.8e−101 |

| Protein name | Locus Name | Acc# |
|---|---|---|
| CDP-glucose-4,6-dehydratase | pir:D47070 | D47070 |

Description

| ORF Name | NTID | AAID | NT Length | AA Length | Score | Probability |
|---|---|---|---|---|---|---|
| 10978425_c3_473 | 548 | 5770 | 61 | 186 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 11214032_c2_377 | 549 | 5771 | 477 | 1434 | 837 | 1.8e−83 |

| Protein name | Locus Name | Acc# |
|---|---|---|
| | sp:ATOC_ECOLI | Q06065 |

Description

DECARBOXYLASE INHIBITOR) (ORNITHINE DECARBOXYLASE ANTIZYME)

| ORF Name | NTID | AAID | NT Length | AA Length | Score | Probability |
|---|---|---|---|---|---|---|
| 11932290_f2_88 | 550 | 5772 | 107 | 324 | 152 | 1.2e−10 |

| Protein name | Locus Name | Acc# |
|---|---|---|
| | sp:CBIK_SALTY | Q05592 |

Description

CBIK PROTEIN

| ORF Name | NTID | AAID | NT Length | AA Length | Score | Probability |
|---|---|---|---|---|---|---|
| 126376_f3_197 | 551 | 5773 | 500 | 1503 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 13785926_c2_372 | 552 | 5774 | 172 | 519 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 13834812_c3_485 | 553 | 5775 | 347 | 1044 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 14461567_f3_222 | 554 | 5776 | 386 | 1161 | 890 | 4.3e−89 |

| Protein name | Locus Name | Acc# |
|---|---|---|
| ThiH | gp:AF154064 | AF154064 |

Description

*Salmonella typhimurium* ThiH (thiH) gene, complete cds.

-continued

| ORF Name | NTID | AAID | NT Length | AA Length | Score | Probability |
|---|---|---|---|---|---|---|
| 14489050_f2_180 | 555 | 5777 | 555 | 1668 | 147 | 4.7e−07 |

| Protein name | Locus Name | Acc# |
|---|---|---|
| aspartate aminotransferase | pir:D75496 | D75496 |

Description

| ORF Name | NTID | AAID | NT Length | AA Length | Score | Probability |
|---|---|---|---|---|---|---|
| 14642207_f1_18 | 556 | 5778 | 595 | 1788 | 1878 | 8.6e−194 |

| Protein name | Locus Name | Acc# |
|---|---|---|
| | sp:THIC_BACSU | |

Description

THIAMINE BIOSYNTHESIS PROTEIN THIC

| ORF Name | NTID | AAID | NT Length | AA Length | Score | Probability |
|---|---|---|---|---|---|---|
| 14647206_f3_237 | 557 | 5779 | 257 | 774 | 96 | 0.021 |

| Protein name | Locus Name | Acc# |
|---|---|---|
| conserved hypothetical protein MTH469 | pir:D69161 | D69161 |

Description

| ORF Name | NTID | AAID | NT Length | AA Length | Score | Probability |
|---|---|---|---|---|---|---|
| 14729186_f2_148 | 558 | 5780 | 155 | 468 | 88 | 0.029 |

| Protein name | Locus Name | Acc# |
|---|---|---|
| | sp:GENK_ECOLI | P02988 |

Description

PROTEIN K

| ORF Name | NTID | AAID | NT Length | AA Length | Score | Probability |
|---|---|---|---|---|---|---|
| 14867327_f3_236 | 559 | 5781 | 408 | 1227 | 175 | 3.0e−10 |

| Protein name | Locus Name | Acc# |
|---|---|---|
| | sp:YIGN_ECOLI | P27850 |

Description

HYPOTHETICAL 54.7 KD PROTEIN IN UDP-UBIE INTERGENIC REGION PRECURSOR

| ORF Name | NTID | AAID | NT Length | AA Length | Score | Probability |
|---|---|---|---|---|---|---|
| 16064015_c2_385 | 560 | 5782 | 140 | 423 | 84 | 0.0060 |

| Protein name | Locus Name | Acc# |
|---|---|---|
| trbA protein | pir:A49852 | |

Description

-continued

| ORF Name | NTID | AAID | NT Length | AA Length | Score | Probability |
|---|---|---|---|---|---|---|
| 164043_c1_309 | 561 | 5783 | 251 | 756 | 493 | 5.0e−47 |

| Protein name | | | | Locus Name | | Acc# |
|---|---|---|---|---|---|---|
| conserved hypothetical protein HP0162 | | | | pir:B64540 | | B64540 |

Description

| ORF Name | NTID | AAID | NT Length | AA Length | Score | Probability |
|---|---|---|---|---|---|---|
| 194086_c3_520 | 562 | 5784 | 790 | 2373 | 1337 | 2.8e−144 |

| Protein name | | | | Locus Name | | Acc# |
|---|---|---|---|---|---|---|
| | | | | sp:PCRA_BACST | | P56255 |

Description

ATP-DEPENDENT HELICASE PCRA,

| ORF Name | NTID | AAID | NT Length | AA Length | Score | Probability |
|---|---|---|---|---|---|---|
| 1960876_c2_403 | 563 | 5785 | 72 | 219 | 81 | 0.0023 |

| Protein name | | | | Locus Name | | Acc# |
|---|---|---|---|---|---|---|
| hypothetical protein MJ1608 | | | | pir:G64500 | | G64500 |

Description

| ORF Name | NTID | AAID | NT Length | AA Length | Score | Probability |
|---|---|---|---|---|---|---|
| 19689678_c1_307 | 564 | 5786 | 442 | 1329 | 128 | 5.0e−05 |

| Protein name | | | | Locus Name | | Acc# |
|---|---|---|---|---|---|---|
| unknown | | | | gp:AF144879 | | AF144879 |

Description

*Leptospira interrogans* rfb locus, complete sequence.

| ORF Name | NTID | AAID | NT Length | AA Length | Score | Probability |
|---|---|---|---|---|---|---|
| 19709682_c1_302 | 565 | 5787 | 451 | 1356 | 1278 | 3.3e−130 |

| Protein name | | | | Locus Name | | Acc# |
|---|---|---|---|---|---|---|
| CDP-4-keto-6-deoxy-D-glucose-3-dehydratase | | | | gp:YPE251713 | | AJ251713 |

Description

*Yersinia pestis* strain EV76 hemH gene (partial) and O-antigen gene cluster for ddhD gene, ddhA gene, ddhB pseudogene, ddhC gene, prtgene, wbyH gene, wzx gene, wbyI pseudogene, wbyJ gene, wzy pseudogene, wbyK gene, gmd pseudogene, fcl pseudogene, manC gene, wbyL gene, manB gene, wzz gene and gsk gene (partial).

| ORF Name | NTID | AAID | NT Length | AA Length | Score | Probability |
|---|---|---|---|---|---|---|
| 19711067_c3_486 | 566 | 5788 | 300 | 903 | 374 | 2.1e−34 |

| Protein name | | | | Locus Name | | Acc# |
|---|---|---|---|---|---|---|
| hypothetical protein jhp0094 | | | | pir:E71975 | | E71975 |

Description

-continued

| ORF Name | NTID | AAID | NT Length | AA Length | Score | Probability |
|---|---|---|---|---|---|---|
| 20087751_c3_489 | 567 | 5789 | 318 | 957 | 1429 | 3.3e−146 |

| Protein name | Locus Name | Acc# |
|---|---|---|
| putative UDP-GlcNAc:undecaprenylphosphate | gp:AF048749 | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 20520302_c3_462 | 568 | 5790 | 495 | 1488 | 112 | 9.6e−06 |

| Protein name | Locus Name | Acc# |
|---|---|---|
| immunoreactive 50kD antigen PG53 | gp:AF175720 | AF175720 |

Description

*Porphyromonas gingivalis* strain W50 immunoreactive 50kD antigen PG53 gene, complete cds.

| ORF Name | NTID | AAID | NT Length | AA Length | Score | Probability |
|---|---|---|---|---|---|---|
| 20596012_f1_1 | 569 | 5791 | 801 | 2406 | 181 | 9.9e−33 |

| Protein name | Locus Name | Acc# |
|---|---|---|
| ferrichrome-iron receptor 3:protein slr1490:protein slr1490 | pir:S74457 | S74457 |

Description

| ORF Name | NTID | AAID | NT Length | AA Length | Score | Probability |
|---|---|---|---|---|---|---|
| 21495928_f1_23 | 570 | 5792 | 94 | 285 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 2150305_c1_308 | 571 | 5793 | 299 | 900 | 174 | 1.1e−20 |

| Protein name | Locus Name | Acc# |
|---|---|---|
| UDP-glucose-4-epismerase/dTDP-glucose-4,6 | gp:AF048749 | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 22114755_f1_7 | 572 | 5794 | 478 | 1437 | 384 | 1.8e−35 |

| Protein name | Locus Name | Acc# |
|---|---|---|
| precorrin-6Y methylase:protein sll0099:protein sll0099 | pir:S76697 | S76697 |

Description

-continued

| ORF Name | NTID | AAID | NT Length | AA Length | Score | Probability |
|---|---|---|---|---|---|---|
| 22129152__f2__112 | 573 | 5795 | 632 | 1899 | | |

| Protein name | | | Locus Name | | Acc# | |
|---|---|---|---|---|---|---|

Description

NO-HIT

| ORF Name | NTID | AAID | NT Length | AA Length | Score | Probability |
|---|---|---|---|---|---|---|
| 2349150__c1__344 | 574 | 5796 | 103 | 312 | | |

| Protein name | | | Locus Name | | Acc# | |
|---|---|---|---|---|---|---|

Description

NO-HIT

| ORF Name | NTID | AAID | NT Length | AA Length | Score | Probability |
|---|---|---|---|---|---|---|
| 2351432__f2__175 | 575 | 5797 | 68 | 207 | | |

| Protein name | | | Locus Name | | Acc# | |
|---|---|---|---|---|---|---|

Description

NO-HIT

| ORF Name | NTID | AAID | NT Length | AA Length | Score | Probability |
|---|---|---|---|---|---|---|
| 23562762__c3__488 | 576 | 5798 | 240 | 723 | 366 | 1.4e−33 |

| Protein name | | | Locus Name | | Acc# | |
|---|---|---|---|---|---|---|
| putative glycosyl transferase | | | gp:AF071085 | | AF071085 | |

Description

*Enterococcus faecalis* strain OG1RF polysaccharide biosynthetic gene cluster, partial sequence.

| ORF Name | NTID | AAID | NT Length | AA Length | Score | Probability |
|---|---|---|---|---|---|---|
| 23611383__f1__38 | 577 | 5799 | 68 | 207 | | |

| Protein name | | | Locus Name | | Acc# | |
|---|---|---|---|---|---|---|

Description

NO-HIT

| ORF Name | NTID | AAID | NT Length | AA Length | Score | Probability |
|---|---|---|---|---|---|---|
| 23615905__c3__523 | 578 | 5800 | 409 | 1230 | 327 | 6.3e−32 |

| Protein name | | | Locus Name | | Acc# | |
|---|---|---|---|---|---|---|
| | | | sp:HXK3_HUMAN | | P52790 | |

Description

HEXOKINASE TYPE III, (HK III)

-continued

| ORF Name | NTID | AAID | NT Length | AA Length | Score | Probability |
|---|---|---|---|---|---|---|
| 23617802_f2_160 | 579 | 5801 | 82 | 249 | 84 | 0.0054 |
| Protein name | | | Locus Name | | | Acc# |
| PP31 39K orf36 | | | pir:T41782 | | | T41782 |
| Description | | | | | | |

| ORF Name | NTID | AAID | NT Length | AA Length | Score | Probability |
|---|---|---|---|---|---|---|
| 23704688_c3_459 | 580 | 5802 | 439 | 1320 | 132 | 1.8e−11 |
| Protein name | | | Locus Name | | | Acc# |
| conserved hypothetical protein yknZ | | | pir:E69858 | | | E69858 |
| Description | | | | | | |

| ORF Name | NTID | AAID | NT Length | AA Length | Score | Probability |
|---|---|---|---|---|---|---|
| 23831325_f2_155 | 581 | 5803 | 95 | 288 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 23851567_f2_119 | 582 | 5804 | 192 | 579 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 23851637_f3_217 | 583 | 5805 | 266 | 801 | 824 | 4.2e−82 |
| Protein name | | | Locus Name | | | Acc# |
| | | | sp:THIG_ECOLI | | | |
| Description | | | | | | |

THIG PROTEIN

| ORF Name | NTID | AAID | NT Length | AA Length | Score | Probability |
|---|---|---|---|---|---|---|
| 23957812_f3_267 | 584 | 5806 | 109 | 330 | 91 | 0.0011 |
| Protein name | | | Locus Name | | | Acc# |
| chaperone GrpE type 2 | | | gp:AF098636 | | | AF098636 |
| Description | | | | | | |

*Nicotiana tabacum* chaperone GrpE type 2 (GrpE2) mRNA, nuclear gene coding mitochondrial protein, complete cds.

-continued

| ORF Name | NTID | AAID | NT Length | AA Length | Score | Probability |
|---|---|---|---|---|---|---|
| 24023462_c1_311 | 585 | 5807 | 426 | 1281 | 618 | 2.9e−60 |

| Protein name | Locus Name | Acc# |
|---|---|---|
| | sp:YDAR_BACSU | P96593 |

Description

HYPOTHETICAL 45.7 KD PROTEIN IN MUTT-GSIB INTERGENIC REGION

| ORF Name | NTID | AAID | NT Length | AA Length | Score | Probability |
|---|---|---|---|---|---|---|
| 24035952_f2_147 | 586 | 5808 | 95 | 288 | 82 | 0.0018 |

| Protein name | Locus Name | Acc# |
|---|---|---|
| unknown protein | gp:SCCXV106K | X95258 |

Description

*S. cerevisiae* 10.6 kbp fragment from chromosome XV.

| ORF Name | NTID | AAID | NT Length | AA Length | Score | Probability |
|---|---|---|---|---|---|---|
| 24223762_c1_318 | 587 | 5809 | 448 | 1347 | 503 | 1.6e−82 |

| Protein name | Locus Name | Acc# |
|---|---|---|
| Na+/H+-exchanging protein:Na+/H+ antiporter | pir:JX0360 | JX0360 |

Description

| ORF Name | NTID | AAID | NT Length | AA Length | Score | Probability |
|---|---|---|---|---|---|---|
| 24239006_f3_269 | 588 | 5810 | 337 | 1014 | 110 | 0.0058 |

| Protein name | Locus Name | Acc# |
|---|---|---|
| | gp:ECORHSEX | L19083 |

Description

*Escherichia coli* RhsE gentic element; defective RhsE core protein, complete cds; complete ORF-E2; H-rpt subelement; complete ORF-H.

| ORF Name | NTID | AAID | NT Length | AA Length | Score | Probability |
|---|---|---|---|---|---|---|
| 24303127_f2_173 | 589 | 5811 | 142 | 429 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24407687_c2_400 | 590 | 5812 | 827 | 2484 | 1188 | 1.1e−120 |

| Protein name | Locus Name | Acc# |
|---|---|---|
| | sp:SYFB_ECOLI | |

Description

TRNA LIGASE BETA CHAIN) (PHERS)

-continued

| ORF Name | NTID | AAID | NT Length | AA Length | Score | Probability |
|---|---|---|---|---|---|---|
| 24410780_f1_71 | 591 | 5813 | 63 | 192 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24412912_f2_94 | 592 | 5814 | 192 | 579 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24504713_f3_200 | 593 | 5815 | 240 | 723 | 291 | 1.3e–25 |

| Protein name | | | Locus Name | | | Acc# |
|---|---|---|---|---|---|---|
| hypothetical protein MTH671 | | | pir:D69189 | | | D69189 |

Description

| ORF Name | NTID | AAID | NT Length | AA Length | Score | Probability |
|---|---|---|---|---|---|---|
| 24614415_f1_33 | 594 | 5816 | 315 | 948 | 337 | 1.7e–30 |

| Protein name | | | Locus Name | | | Acc# |
|---|---|---|---|---|---|---|
| | | | sp:YLYB_BACSU | | | |

Description

HYPOTHETICAL 33.7 KD PROTEIN IN LSP-PYRR INTERGENIC REGION (ORF-X)

| ORF Name | NTID | AAID | NT Length | AA Length | Score | Probability |
|---|---|---|---|---|---|---|
| 24641937_f1_8 | 595 | 5817 | 601 | 1806 | 628 | 2.5e–61 |

| Protein name | | | Locus Name | | | Acc# |
|---|---|---|---|---|---|---|
| precorrin-3 methylase | | | pir:A64497 | | | A64497 |

Description

| ORF Name | NTID | AAID | NT Length | AA Length | Score | Probability |
|---|---|---|---|---|---|---|
| 24642311_c2_392 | 596 | 5818 | 162 | 489 | 223 | 2.1e–18 |

| Protein name | | | Locus Name | | | Acc# |
|---|---|---|---|---|---|---|
| unknown | | | gp:AF048749 | | | AF048749 |

Description

*Bacteroides fragilis* capsular polysaccharide biosynthesis operon, complete sequence.

-continued

| ORF Name | NTID | AAID | NT Length | AA Length | Score | Probability |
|---|---|---|---|---|---|---|
| 24648563_c1_322 | 597 | 5819 | 136 | 411 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24694013_f1_3 | 598 | 5820 | 1326 | 3981 | 659 | 1.8e−115 |

| Protein name | | | | Locus Name | | Acc# |
|---|---|---|---|---|---|---|
| cobalamin biosynthesis protein N | | | | pir:C69048 | | C69048 |

Description

| ORF Name | NTID | AAID | NT Length | AA Length | Score | Probability |
|---|---|---|---|---|---|---|
| 25906675_c3_492 | 599 | 5821 | 173 | 522 | 106 | 3.1e−05 |

| Protein name | | | | Locus Name | | Acc# |
|---|---|---|---|---|---|---|
| hypothetical protein AF0456 | | | | pir:H69306 | | H69306 |

Description

| ORF Name | NTID | AAID | NT Length | AA Length | Score | Probability |
|---|---|---|---|---|---|---|
| 25976708_f3_209 | 600 | 5822 | 95 | 288 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 26362791_f3_272 | 601 | 5823 | 603 | 1812 | 683 | 3.7e−67 |

| Protein name | | | | Locus Name | | Acc# |
|---|---|---|---|---|---|---|
| probably membrane protein b0847 | | | | pir:G64822 | | G64822 |

Description

| ORF Name | NTID | AAID | NT Length | AA Length | Score | Probability |
|---|---|---|---|---|---|---|
| 26604510_c1_314 | 602 | 5824 | 595 | 1788 | 1902 | 2.5e−196 |

| Protein name | | | | Locus Name | | Acc# |
|---|---|---|---|---|---|---|
| | | | | sp:LEPA_BACSU | | P37949 |

Description

GTP-BINDING PROTEIN LEPA

-continued

| ORF Name | NTID | AAID | NT Length | AA Length | Score | Probability |
|---|---|---|---|---|---|---|
| 26835887_f1_20 | 603 | 5825 | 238 | 717 | 518 | 1.1e−49 |

| Protein name | Locus Name | Acc# |
|---|---|---|
| MPT-synthase sylfurylase | gp:SYPCCMOEB | Y16560 |

Description

*Synechococus* PCC7942 moeB gene.

| ORF Name | NTID | AAID | NT Length | AA Length | Score | Probability |
|---|---|---|---|---|---|---|
| 2853436_c3_500 | 604 | 5826 | 148 | 447 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 29353952_c1_304 | 605 | 5827 | 592 | 1779 | 891 | 3.4e−89 |

| Protein name | Locus Name | Acc# |
|---|---|---|
| | gp:AF025396 | AF025396 |

Description

*Vibrio anguillarum* rfb region, partial sequence.

| ORF Name | NTID | AAID | NT Length | AA Length | Score | Probability |
|---|---|---|---|---|---|---|
| 30522966_f2_122 | 606 | 5828 | 262 | 789 | 132 | 5.9e−07 |

| Protein name | Locus Name | Acc# |
|---|---|---|
| | sp:TENI_BACSU | P25053 |

Description

REGULATORY PROTEIN TENI

| ORF Name | NTID | AAID | NT Length | AA Length | Score | Probability |
|---|---|---|---|---|---|---|
| 32165905_f1_5 | 607 | 5829 | 109 | 330 | 82 | 0.0018 |

| Protein name | Locus Name | Acc# |
|---|---|---|
| hypothetical protein MTH670 | pir:C69189 | C69189 |

Description

| ORF Name | NTID | AAID | NT Length | AA Length | Score | Probability |
|---|---|---|---|---|---|---|
| 33289500_c2_393 | 608 | 5830 | 307 | 924 | 1394 | 1.7e−142 |

| Protein name | Locus Name | Acc# |
|---|---|---|
| glucose-1-phosphate thymidyl transferase | gp:AF048749 | AF048749 |

Description

*Bacteroides fragilis* capsular polysaccharide biosynthesis operon, complete sequence.

-continued

| ORF Name | NTID | AAID | NT Length | AA Length | Score | Probability |
|---|---|---|---|---|---|---|
| 34064010_f3_232 | 609 | 5831 | 478 | 1437 | 707 | 1.1e−69 |

| Protein name | | | | Locus Name | | Acc# |
|---|---|---|---|---|---|---|
| RNA methyltransferase homolog yefA | | | | pir:E69793 | | E69793 |

Description

| ORF Name | NTID | AAID | NT Length | AA Length | Score | Probability |
|---|---|---|---|---|---|---|
| 34079635_f1_9 | 610 | 5832 | 168 | 507 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 34173556_c3_482 | 611 | 5833 | 314 | 945 | 223 | 4.7e−18 |

| Protein name | | | | Locus Name | | Acc# |
|---|---|---|---|---|---|---|
| ADP-L-glycero-D-manno-heptose-6-epimerase | | | | pir:G70330 | | G70330 |

Description

| ORF Name | NTID | AAID | NT Length | AA Length | Score | Probability |
|---|---|---|---|---|---|---|
| 34245941_c3_490 | 612 | 5834 | 86 | 261 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 34384631_f3_216 | 613 | 5835 | 205 | 618 | 319 | 1.4e−28 |

| Protein name | | | | Locus Name | | Acc# |
|---|---|---|---|---|---|---|
| | | | | sp:THIE_SYNY3 | | P72965 |

Description

PYROPHOSPHORYLASE) (TMP-PPASE) (THIAMINE-PHOSPHATE SYNTHASE)

| ORF Name | NTID | AAID | NT Length | AA Length | Score | Probability |
|---|---|---|---|---|---|---|
| 35214385_c2_397 | 614 | 5836 | 297 | 894 | 182 | 6.8e−13 |

| Protein name | | | | Locus Name | | Acc# |
|---|---|---|---|---|---|---|
| glucosyl transferase | | | | gp:SMU52844 | | U52844 |

Description

*Serratia marcescens* putative glycosyltransferase, putative glycosyltransferase, putative heptosylIII transferase (waaQ), 3-deoxy-manno-octulosonic acid transferase (waaA), glucosyl-tranferase (waaE), and KdtB (kdtB) genes, complete cds; and Fpg (fpg) gene, partial cds.

-continued

| ORF Name | NTID | AAID | NT Length | AA Length | Score | Probability |
|---|---|---|---|---|---|---|
| 35348458_c1_327 | 615 | 5837 | 119 | 360 | 93 | 0.00025 |

| Protein name | Locus Name | Acc# |
|---|---|---|
| unknown | gp:AF007381 | AF007381 |

Description

*Flavobacterium johnsoniae* gliding motility protein (gldA) gene, complete cds; and unknown genes.

| ORF Name | NTID | AAID | NT Length | AA Length | Score | Probability |
|---|---|---|---|---|---|---|
| 36330078_c3_518 | 616 | 5838 | 96 | 291 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 36601442_f3_215 | 617 | 5839 | 118 | 357 | 118 | 2.8e−07 |

| Protein name | Locus Name | Acc# |
|---|---|---|
| | gp:STYSTMF1 | AF170176 |

Description

*Salmonella typhimurium* fragment STMF1.

| ORF Name | NTID | AAID | NT Length | AA Length | Score | Probability |
|---|---|---|---|---|---|---|
| 3939512_c1_326 | 618 | 5840 | 909 | 2730 | 1830 | 4.0e−281 |

| Protein name | Locus Name | Acc# |
|---|---|---|
| | sp:PODK_CLOSY | P22983 |

Description

DIKINASE)

| ORF Name | NTID | AAID | NT Length | AA Length | Score | Probability |
|---|---|---|---|---|---|---|
| 3940877_f2_96 | 619 | 5841 | 472 | 1419 | 591 | 9.3e−60 |

| Protein name | Locus Name | Acc# |
|---|---|---|
| precorrin-3 methylase | gp:BMAJ758 | AJ000758 |

Description

*Bacillus megaterium* 16kb genomic sequence, cobalamin operon.

| ORF Name | NTID | AAID | NT Length | AA Length | Score | Probability |
|---|---|---|---|---|---|---|
| 39642_c3_480 | 620 | 5842 | 196 | 591 | 841 | 6.7e−84 |

| Protein name | Locus Name | Acc# |
|---|---|---|
| dTDP-6-deoxy-D-glucose−3,5 epimerase | gp:AF048749 | AF048749 |

Description

*Bacteroides fragilis* capsular polysaccharide biosynthesis operon, complete sequence.

-continued

| ORF Name | NTID | AAID | NT Length | AA Length | Score | Probability |
|---|---|---|---|---|---|---|
| 40930_f2_144 | 621 | 5843 | 140 | 423 | 391 | 3.2e−36 |

| Protein name | Locus Name | Acc# |
|---|---|---|
| conserved hypothetical protein | pir:C75256 | C75256 |

Description

| ORF Name | NTID | AAID | NT Length | AA Length | Score | Probability |
|---|---|---|---|---|---|---|
| 4196081_c2_391 | 622 | 5844 | 156 | 471 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 4334455_c3_463 | 623 | 5845 | 436 | 1311 | 227 | 3.5e−19 |

| Protein name | Locus Name | Acc# |
|---|---|---|
| | sp:NTRB_RHOCA | P09431 |

Description

NITROGEN REGULATION PROTEIN NTRB,

| ORF Name | NTID | AAID | NT Length | AA Length | Score | Probability |
|---|---|---|---|---|---|---|
| 4688828_c3_507 | 624 | 5846 | 96 | 291 | 87 | 0.0012 |

| Protein name | Locus Name | Acc# |
|---|---|---|
| unknown | gp:AF007381 | AF007381 |

Description

*Flavobacterium johnsoniae* gliding motility protein (gldA) gene, complete cds; and unknown genes.

| ORF Name | NTID | AAID | NT Length | AA Length | Score | Probability |
|---|---|---|---|---|---|---|
| 4881512_f1_72 | 625 | 5847 | 153 | 462 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 4881557_c2_404 | 626 | 5848 | 395 | 1188 | 105 | 0.016 |

| Protein name | Locus Name | Acc# |
|---|---|---|
| Na+/H+-exchanging protein sll0689:Na+/H+ antiporter:Na+/H+ antiporter | pir:S74414 | S74414 |

Description

-continued

| ORF Name | NTID | AAID | NT Length | AA Length | Score | Probability |
|---|---|---|---|---|---|---|
| 4882755_f3_268 | 627 | 5849 | 311 | 936 | 103 | 0.0030 |

| Protein name | Locus Name | Acc# |
|---|---|---|
| growth-associated protein | gp:ZEFGAP | L27645 |

Description

*Brachydanio rerio* growth-associated protein, complete cds.

| ORF Name | NTID | AAID | NT Length | AA Length | Score | Probability |
|---|---|---|---|---|---|---|
| 4884635_c3_487 | 628 | 5850 | 266 | 801 | 403 | 1.7e−37 |

| Protein name | Locus Name | Acc# |
|---|---|---|
| unknown | gp:AF144879 | AF144879 |

Description

*Leptospira interrogans* rfb locus, complete sequence.

| ORF Name | NTID | AAID | NT Length | AA Length | Score | Probability |
|---|---|---|---|---|---|---|
| 4884712_c2_401 | 629 | 5851 | 254 | 765 | 636 | 3.5e−62 |

| Protein name | Locus Name | Acc# |
|---|---|---|
| exodeoxyribonuclease | pir:B69126 | B69126 |

Description

| ORF Name | NTID | AAID | NT Length | AA Length | Score | Probability |
|---|---|---|---|---|---|---|
| 4957512_c3_506 | 630 | 5852 | 193 | 582 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 504757_c2_373 | 631 | 5853 | 956 | 2871 | 383 | 3.0e−34 |

| Protein name | Locus Name | Acc# |
|---|---|---|
| RcsC | gp:AF071215 | AF071215 |

Description

*Proteus mirabilis* regulator of swarming behavior precursor (rsbA) and RcsB (rcsB) genes, complete cds; and RcsC (rcsC) gene, partial cds.

| ORF Name | NTID | AAID | NT Length | AA Length | Score | Probability |
|---|---|---|---|---|---|---|
| 5110325_c3_521 | 632 | 5854 | 381 | 1146 | 1054 | 1.8e−106 |

| Protein name | Locus Name | Acc# |
|---|---|---|
| carboxynorspermidine decarboxylase:protein sll0873:protein sll0873 | pir:S77268 | S77268 |

Description

-continued

| ORF Name | NTID | AAID | NT Length | AA Length | Score | Probability |
|---|---|---|---|---|---|---|
| 5112802_f3_207 | 633 | 5855 | 644 | 1935 | 423 | 2.8e−39 |

| Protein name | | | Locus Name | | | Acc# |
|---|---|---|---|---|---|---|
| CbiD protein | | | gp:BMAJ758 | | | AF000758 |

Description

*Bacillus megaterium* 16kb genomic sequence, cobalamin operon.

| ORF Name | NTID | AAID | NT Length | AA Length | Score | Probability |
|---|---|---|---|---|---|---|
| 6025675_f2_162 | 634 | 5856 | 75 | 228 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 6913875_c1_305 | 635 | 5857 | 450 | 1353 | 602 | 1.4e−58 |

| Protein name | | | Locus Name | | | Acc# |
|---|---|---|---|---|---|---|
| hypothetical protein | | | pir:S22614 | | | S22614 |

Description

| ORF Name | NTID | AAID | NT Length | AA Length | Score | Probability |
|---|---|---|---|---|---|---|
| 7087642_c1_306 | 636 | 5858 | 61 | 186 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 910262_f3_235 | 637 | 5859 | 305 | 918 | 670 | 8.8e−66 |

| Protein name | | | Locus Name | | | Acc# |
|---|---|---|---|---|---|---|
| | | | sp:AMP1_SYNY3 | | | P53579 |

Description

M)

| ORF Name | NTID | AAID | NT Length | AA Length | Score | Probability |
|---|---|---|---|---|---|---|
| 969165_c1_297 | 638 | 5860 | 336 | 1011 | 182 | 1.1e−11 |

| Protein name | | | Locus Name | | | Acc# |
|---|---|---|---|---|---|---|
| conserved hypothetical protein MTH12661 | | | pir:F69035 | | | F69035 |

Description

-continued

| ORF Name | NTID | AAID | NT Length | AA Length | Score | Probability |
|---|---|---|---|---|---|---|
| 9885166_c3_460 | 639 | 5861 | 282 | 849 | 105 | 0.014 |
| Protein name | | | Locus Name | | | Acc# |
| | | | sp:YBJZ_ECOLI | | | P75831 |
| Description | | | | | | |

HYPOTHETICAL ABC TRANSPORTER ATP-BINDING PROTEIN YBJZ

| ORF Name | NTID | AAID | NT Length | AA Length | Score | Probability |
|---|---|---|---|---|---|---|
| 11757880_c2_81 | 640 | 5862 | 146 | 441 | 108 | 3.2e−06 |
| Protein name | | | Locus Name | | | Acc# |
| hypothetical protein PH1670 | | | pir:F71047 | | | F71047 |
| Description | | | | | | |

| ORF Name | NTID | AAID | NT Length | AA Length | Score | Probability |
|---|---|---|---|---|---|---|
| 14460957_f1_4 | 641 | 5863 | 363 | 1092 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 14728413_f1_8 | 642 | 5864 | 95 | 288 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 15878777_c3_95 | 643 | 5865 | 232 | 699 | 178 | 1.1e−12 |
| Protein name | | | Locus Name | | | Acc# |
| serine-rich protein | | | pir:T39903 | | | T39903 |
| Description | | | | | | |

| ORF Name | NTID | AAID | NT Length | AA Length | Score | Probability |
|---|---|---|---|---|---|---|
| 20741053_f2_25 | 644 | 5866 | 240 | 723 | 1219 | 5.9e−124 |
| Protein name | | | Locus Name | | | Acc# |
| BatC | | | gp:AF116251 | | | AF116251 |
| Description | | | | | | |

*Bacteroides fragilis* batI operon, complete sequence.

-continued

| ORF Name | NTID | AAID | NT Length | AA Length | Score | Probability |
|---|---|---|---|---|---|---|
| 209688_f3_38 | 645 | 5867 | 63 | 192 | | |
| Protein name | | | Locus Name | | | Acc# |
| | | | | | | |

Description

NO-HIT

| ORF Name | NTID | AAID | NT Length | AA Length | Score | Probability |
|---|---|---|---|---|---|---|
| 22027_f3_31 | 646 | 5868 | 355 | 1068 | 683 | 3.7e−67 |
| Protein name | | | Locus Name | | | Acc# |
| | | | sp:GCP_HAEIN | | | P43764 |

Description (GLYCOPROTEASE)

| ORF Name | NTID | AAID | NT Length | AA Length | Score | Probability |
|---|---|---|---|---|---|---|
| 22039692_f2_24 | 647 | 5869 | 216 | 651 | 1014 | 3.1e−102 |
| Protein name | | | Locus Name | | | Acc# |
| BatB | | | gp:AF116251 | | | AF116251 |

Description

*Bacteroides fragilis* batI operon, complete sequence.

| ORF Name | NTID | AAID | NT Length | AA Length | Score | Probability |
|---|---|---|---|---|---|---|
| 22297140_f1_3 | 648 | 5870 | 327 | 984 | 768 | 3.6e−76 |
| Protein name | | | Locus Name | | | Acc# |
| | | | sp:FTSY_HAEIN | | | P44870 |

Description

CELL DIVISION PROTIEN FTSY

| ORF Name | NTID | AAID | NT Length | AA Length | Score | Probability |
|---|---|---|---|---|---|---|
| 23649052_f1_9 | 649 | 5871 | 399 | 1200 | 166 | 1.2e−11 |
| Protein name | | | Locus Name | | | Acc# |
| | | | sp:Y531_METJA | | | Q57951 |

Description

HYPOTHETICAL PROTEIN MJ0531

| ORF Name | NTID | AAID | NT Length | AA Length | Score | Probability |
|---|---|---|---|---|---|---|
| 23834376_c2_84 | 650 | 5872 | 122 | 369 | 122 | 1.0e−07 |
| Protein name | | | Locus Name | | | Acc# |
| hypothetical protein APE1982 | | | pir:H72500 | | | H72500 |

Description

-continued

| ORF Name | NTID | AAID | NT Length | AA Length | Score | Probability |
|---|---|---|---|---|---|---|
| 24259700_f1_6 | 651 | 5873 | 615 | 1848 | 3076 | 0.0 |

| Protein name | | | Locus Name | | | Acc# |
|---|---|---|---|---|---|---|
| BatD | | | gp:AF116251 | | | AF116251 |

Description

*Bacteroides fragilis* batI operon, complete sequence.

| ORF Name | NTID | AAID | NT Length | AA Length | Score | Probability |
|---|---|---|---|---|---|---|
| 24407537_f2_21 | 652 | 5874 | 93 | 282 | 177 | 1.5e−13 |

| Protein name | | | Locus Name | | | Acc# |
|---|---|---|---|---|---|---|
| ribosomal protein L28 | | | pir:E64104 | | | E64104 |

Description

| ORF Name | NTID | AAID | NT Length | AA Length | Score | Probability |
|---|---|---|---|---|---|---|
| 24415903_f1_7 | 653 | 5875 | 279 | 840 | 1381 | 4.0e−141 |

| Protein name | | | Locus Name | | | Acc# |
|---|---|---|---|---|---|---|
| BatE | | | gp:AF116251 | | | AF116251 |

Description

*Bacteroides fragilis* batI operon, complete sequence.

| ORF Name | NTID | AAID | NT Length | AA Length | Score | Probability |
|---|---|---|---|---|---|---|
| 24823562_f1_2 | 654 | 5876 | 68 | 207 | 157 | 2.0e−11 |

| Protein name | | | Locus Name | | | Acc# |
|---|---|---|---|---|---|---|
| | | | sp:RK33_ODOSI | | | P49565 |

Description

CHLOROPLAST 50S RIBOSOMAL PROTEIN L33

| ORF Name | NTID | AAID | NT Length | AA Length | Score | Probability |
|---|---|---|---|---|---|---|
| 25975010_c1_63 | 655 | 5877 | 1129 | 3390 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 272212_f3_33 | 656 | 5878 | 492 | 1479 | 201 | 1.6e−12 |

| Protein name | | | Locus Name | | | Acc# |
|---|---|---|---|---|---|---|
| antigen 332 | | | pir:JN0292 | | | JN0292 |

Description

-continued

| ORF Name | NTID | AAID | NT Length | AA Length | Score | Probability |
|---|---|---|---|---|---|---|
| 3149069_c1_40 | 657 | 5879 | 847 | 2544 | 4304 | 0.0 |

| Protein name | Locus Name | Acc# |
|---|---|---|
| DNA gyrase A subunit | gp:AB017712 | AB017712 |

Description

*Bacteroides fragilis* gyrA gene for DNA gyrase A subunit, complete cds.

| ORF Name | NTID | AAID | NT Length | AA Length | Score | Probability |
|---|---|---|---|---|---|---|
| 33397127_f1_5 | 658 | 5880 | 331 | 996 | 1656 | 2.9e−170 |

| Protein name | Locus Name | Acc# |
|---|---|---|
| BatA | gp:AF116251 | AF116251 |

Description

*Bacteroides fragilis* batI operon, complete sequence.

| ORF Name | NTID | AAID | NT Length | AA Length | Score | Probability |
|---|---|---|---|---|---|---|
| 34101702_f2_23 | 659 | 5881 | 289 | 870 | 388 | 6.7e−36 |

| Protein name | Locus Name | Acc# |
|---|---|---|
| conserved hypothetical protein BB0175 | pir:G70121 | G70121 |

Description

| ORF Name | NTID | AAID | NT Length | AA Length | Score | Probability |
|---|---|---|---|---|---|---|
| 34266968_f3_32 | 660 | 5882 | 454 | 1365 | 942 | 1.3e−94 |

| Protein name | Locus Name | Acc# |
|---|---|---|
| conserved hypothetical protein aq_849 | pir:E70373 | E70373 |

Description

| ORF Name | NTID | AAID | NT Length | AA Length | Score | Probability |
|---|---|---|---|---|---|---|
| 34564376_f1_1 | 661 | 5883 | 415 | 1248 | 603 | 1.1e−58 |

| Protein name | Locus Name | Acc# |
|---|---|---|
| hypothetical protein | pir:S76561 | S76561 |

Description

| ORF Name | NTID | AAID | NT Length | AA Length | Score | Probability |
|---|---|---|---|---|---|---|
| 3912925_f3_34 | 662 | 5884 | 334 | 1005 | 821 | 8.8e−82 |

| Protein name | Locus Name | Acc# |
|---|---|---|
| probable moxR protein | pir:B70874 | B70874 |

Description

-continued

| ORF Name | NTID | AAID | NT Length | AA Length | Score | Probability |
|---|---|---|---|---|---|---|
| 4961537_c3_87 | 663 | 5885 | 418 | 1257 | 164 | 6.9e−09 |

| Protein name | Locus Name | Acc# |
|---|---|---|
| conserved hypothetical protein aq_854 | pir:B70374 | B70374 |

Description

| ORF Name | NTID | AAID | NT Length | AA Length | Score | Probability |
|---|---|---|---|---|---|---|
| 5345637_f2_22 | 664 | 5886 | 100 | 303 | 154 | 4.2e−11 |

| Protein name | Locus Name | Acc# |
|---|---|---|
|  | sp:DBH_THEMA | P36206 |

Description

DNA-BINDING PROTEIN HU

| ORF Name | NTID | AAID | NT Length | AA Length | Score | Probability |
|---|---|---|---|---|---|---|
| 7072675_f3_36 | 665 | 5887 | 146 | 441 | 687 | 1.4e−67 |

| Protein name | Locus Name | Acc# |
|---|---|---|
| BatB | gp:AF116251 | AF116251 |

Description

*Bacteroides fragilis* batI operon, complete sequence.

| ORF Name | NTID | AAID | NT Length | AA Length | Score | Probability |
|---|---|---|---|---|---|---|
| 10562517_f3_78 | 666 | 5888 | 71 | 216 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 12129682_f2_67 | 667 | 5889 | 516 | 1551 | 319 | 2.6e−26 |

| Protein name | Locus Name | Acc# |
|---|---|---|
| lipase-like protein | pir:A64706 | A64706 |

Description

| ORF Name | NTID | AAID | NT Length | AA Length | Score | Probability |
|---|---|---|---|---|---|---|
| 12679062_f3_97 | 668 | 5890 | 66 | 201 |  |  |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 13834500_c3_196 | 669 | 5891 | 144 | 435 | 203 | 2.7e−16 |

| Protein name | Locus Name | Acc# |
|---|---|---|
| hypothetical protein BB0530 | pir:A70166 | A70166 |

Description

| ORF Name | NTID | AAID | NT Length | AA Length | Score | Probability |
|---|---|---|---|---|---|---|
| 17086686_f3_95 | 670 | 5892 | 268 | 807 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 20585963_f1_19 | 671 | 5893 | 413 | 1242 | 226 | 1.8e−16 |

| Protein name | Locus Name | Acc# |
|---|---|---|
| hypothetical protein jhp1380 | pir:G71815 | G71815 |

Description

| ORF Name | NTID | AAID | NT Length | AA Length | Score | Probability |
|---|---|---|---|---|---|---|
| 2151552_c2_146 | 672 | 5894 | 250 | 753 | 104 | 2.7e−05 |

| Protein name | Locus Name | Acc# |
|---|---|---|
| cytochrome b | gp:AF017516 | AF017516 |

Description

*Bombus pascuorum* cytochrome b (cytb) gene, mitochondrial gene encoding mitochondrial protein, partial cds.

| ORF Name | NTID | AAID | NT Length | AA Length | Score | Probability |
|---|---|---|---|---|---|---|
| 22473516_c3_186 | 673 | 5895 | 500 | 1503 | 1054 | 1.8e−106 |

| Protein name | Locus Name | Acc# |
|---|---|---|
| | sp:CBIP_SALTY | Q05597 |

Description

COBYRIC ACID SYNTHASE

| ORF Name | NTID | AAID | NT Length | AA Length | Score | Probability |
|---|---|---|---|---|---|---|
| 24269180_f2_71 | 674 | 5896 | 400 | 1203 | 263 | 2.9e−21 |

| Protein name | Locus Name | Acc# |
|---|---|---|
| hypothetical protein jhp1379 | pir:F71815 | F71815 |

Description

| ORF Name | NTID | AAID | NT Length | AA Length | Score | Probability |
|---|---|---|---|---|---|---|
| 24317806__f2__53 | 675 | 5897 | 321 | 966 | 436 | 5.5e−41 |

| Protein name | Locus Name | Acc# |
|---|---|---|
| nicotinate–nucleotide––dimethylbenzimidazole phosphoribosyltransferase | pir:A75577 | A75577 |

Description

| ORF Name | NTID | AAID | NT Length | AA Length | Score | Probability |
|---|---|---|---|---|---|---|
| 24345167__f1__4 | 676 | 5898 | 206 | 621 | 310 | 1.2e−27 |

| Protein name | Locus Name | Acc# |
|---|---|---|
| cobinamide kinase/cobinamide phosphate guanylyltransferase | pir:S52220 | |

Description

| ORF Name | NTID | AAID | NT Length | AA Length | Score | Probability |
|---|---|---|---|---|---|---|
| 24417212__c3__197 | 677 | 5899 | 502 | 1509 | 1238 | 5.7e−126 |

| Protein name | Locus Name | Acc# |
|---|---|---|
| proline––tRNA ligase, porS:prolyl-tRNA synthetase:prolyl-tRNA synthetase | pir:A70150 | A70150 |

Description

| ORF Name | NTID | AAID | NT Length | AA Length | Score | Probability |
|---|---|---|---|---|---|---|
| 24641903__c2__166 | 678 | 5900 | 168 | 507 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24666005__c2__156 | 679 | 5901 | 114 | 345 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24822213__f2__68 | 680 | 5902 | 333 | 1002 | 664 | 3.8e−65 |

| Protein name | Locus Name | Acc# |
|---|---|---|
| immunoreactive 36 kDa antigen PG14 | gp:AF145798 | AF145798 |

Description

*Porphyromonas gingivalis* strain W50 immunoreactive 36 kDa antigen PG14 gene, complete cds.

| ORF Name | NTID | AAID | NT Length | AA Length | Score | Probability |
|---|---|---|---|---|---|---|
| 24822688_f2_66 | 681 | 5903 | 136 | 411 | 114 | 7.3e−07 |

| Protein name | Locus Name | Acc# |
|---|---|---|
| hypothetical protein | pir:S76776 | S76776 |

Description

| ORF Name | NTID | AAID | NT Length | AA Length | Score | Probability |
|---|---|---|---|---|---|---|
| 25401437_c1_115 | 682 | 5904 | 165 | 498 | 178 | 2.0e−13 |

| Protein name | Locus Name | Acc# |
|---|---|---|
|  | sp:YJJP_HAEIN | P44520 |

Description

HYPOTHETICAL PROTEIN HI0108

| ORF Name | NTID | AAID | NT Length | AA Length | Score | Probability |
|---|---|---|---|---|---|---|
| 30082887_c2_145 | 683 | 5905 | 279 | 840 | 238 | 5.3e−20 |

| Protein name | Locus Name | Acc# |
|---|---|---|
|  | sp:YJJP_ECOLI | P39402 |

Description

HYPOTHETICAL 30.5 KD PROTEIN IN DNAT-BGLJ INTERGENIC REGION (F277)

| ORF Name | NTID | AAID | NT Length | AA Length | Score | Probability |
|---|---|---|---|---|---|---|
| 31657080_c2_144 | 684 | 5906 | 580 | 1743 | 1106 | 5.5e−112 |

| Protein name | Locus Name | Acc# |
|---|---|---|
|  | sp:YIDE_ECOLI |  |

Description

HYPOTHETICAL 58.9 KD PROTEIN IN GLVC-IBPB INTERGENIC REGION (ORFA)

| ORF Name | NTID | AAID | NT Length | AA Length | Score | Probability |
|---|---|---|---|---|---|---|
| 32228452_c3_172 | 685 | 5907 | 191 | 576 | 282 | 1.2e−24 |

| Protein name | Locus Name | Acc# |
|---|---|---|
| conserved hypothetical protein yvqK | pir:D70046 | D70046 |

Description

| ORF Name | NTID | AAID | NT Length | AA Length | Score | Probability |
|---|---|---|---|---|---|---|
| 33642211_f1_9 | 686 | 5908 | 260 | 783 | 156 | 3.7e−11 |

| Protein name | Locus Name | Acc# |
|---|---|---|
| probable phosphoglycerate mutase | pir:B75539 | B75539 |

Description

-continued

| ORF Name | NTID | AAID | NT Length | AA Length | Score | Probability |
|---|---|---|---|---|---|---|
| 34195888_c3_190 | 687 | 5909 | 325 | 978 | 489 | 1.3e−46 |

| Protein name | Locus Name | Acc# |
|---|---|---|
| | sp:COBD_PSEDE | P21634 |

Description

COBD PROTEIN

| ORF Name | NTID | AAID | NT Length | AA Length | Score | Probability |
|---|---|---|---|---|---|---|
| 422125_f1_16 | 688 | 5910 | 132 | 399 | 93 | 0.0029 |

| Protein name | Locus Name | Acc# |
|---|---|---|
| beta-tropomyosin | pir:S23470 | S23470 |

Description

| ORF Name | NTID | AAID | NT Length | AA Length | Score | Probability |
|---|---|---|---|---|---|---|
| 4689027_c3_195 | 689 | 5911 | 1084 | 3255 | 895 | 1.3e−89 |

| Protein name | Locus Name | Acc# |
|---|---|---|
| tricorn protease | gp:TAU72850 | U72850 |

Description

*Thermoplasma acidophilum* GTP-binding protein and tricorn protease (TRI) genes, complete cds.

| ORF Name | NTID | AAID | NT Length | AA Length | Score | Probability |
|---|---|---|---|---|---|---|
| 4807062_c1_116 | 690 | 5912 | 448 | 1347 | 657 | 2.1e−64 |

| Protein name | Locus Name | Acc# |
|---|---|---|
| cobyrinic acid a,c-diamide synthase | pir:A75619 | A75619 |

Description

| ORF Name | NTID | AAID | NT Length | AA Length | Score | Probability |
|---|---|---|---|---|---|---|
| 484451_c2_149 | 691 | 5913 | 821 | 2466 | 436 | 1.3e−37 |

| Protein name | Locus Name | Acc# |
|---|---|---|
| two component sensor | gp:AF030352 | AF030352 |

Description

*Pseudomonas aeruginosa* two component sensor (lemA) gene, partial cds.

| ORF Name | NTID | AAID | NT Length | AA Length | Score | Probability |
|---|---|---|---|---|---|---|
| 5116586_c1_131 | 692 | 5914 | 289 | 870 | 296 | 3.8e−26 |

| Protein name | Locus Name | Acc# |
|---|---|---|
| CobD | gp:STU90625 | U90625 |

Description

*Salmonella typhimurium* alpha-ribazole-5'-phosphate phospatase CobC (cobC) gene, partial cds and putative aminotransferase CobD (cobD) gene, complete cds.

| ORF Name | NTID | AAID | NT Length | AA Length | Score | Probability |
|---|---|---|---|---|---|---|
| 5172508_f1_34 | 693 | 5915 | 103 | 312 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 5181263_f2_54 | 694 | 5916 | 250 | 753 | 268 | 3.5e−23 |

| Protein name | | | Locus Name | | | Acc# |
|---|---|---|---|---|---|---|
| cobalamin synthase | | | pir:H75576 | | | H75576 |

Description

| ORF Name | NTID | AAID | NT Length | AA Length | Score | Probability |
|---|---|---|---|---|---|---|
| 812510_c2_164 | 695 | 5917 | 66 | 201 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 10042126_f3_172 | 696 | 5918 | 176 | 531 | 135 | 4.3e−09 |

| Protein name | | | Locus Name | | | Acc# |
|---|---|---|---|---|---|---|
| hypothetical protein | | | gp:SSU18930 | | | Y18930 |

Description

*Sulfolobus solfataricus* 281 kb genomic DNA fragment, strain P2.

| ORF Name | NTID | AAID | NT Length | AA Length | Score | Probability |
|---|---|---|---|---|---|---|
| 11799076_c2_266 | 697 | 5919 | 103 | 312 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 1199075_c2_263 | 698 | 5920 | 64 | 195 | | |

| Protein name | | | Locus Name | | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 1359507_c2_282 | 699 | 5921 | 434 | 1305 | 1073 | 1.7e−108 |

| Protein name | | | | Locus Name | | Acc# |
|---|---|---|---|---|---|---|
| | | | | sp:HISX_ECOLI | | |

Description

HISTIDINOL DEHYDROGENASE, (HDH)

| ORF Name | NTID | AAID | NT Length | AA Length | Score | Probability |
|---|---|---|---|---|---|---|
| 1370937_c3_383 | 700 | 5922 | 119 | 360 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 13756515_f2_119 | 701 | 5923 | 68 | 207 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 13786251_f1_58 | 702 | 5924 | 636 | 1911 | 386 | 1.8e−33 |

| Protein name | | | | Locus Name | | Acc# |
|---|---|---|---|---|---|---|
| histidine kinase | | | | gp:AF114442 | | AF114442 |

Description

*Nostoc punctiforme* histidine kinase (hepK) gene, complete cds.

| ORF Name | NTID | AAID | NT Length | AA Length | Score | Probability |
|---|---|---|---|---|---|---|
| 14630063_c3_356 | 703 | 5925 | 389 | 1170 | 880 | 4.9e−88 |

| Protein name | | | | Locus Name | | Acc# |
|---|---|---|---|---|---|---|
| | | | | sp:HIS7_P44327 | | P44327 |

Description

| ORF Name | NTID | AAID | NT Length | AA Length | Score | Probability |
|---|---|---|---|---|---|---|
| 15039087_c2_272 | 704 | 5926 | 938 | 2817 | 2717 | 1.1e−282 |

| Protein name | | | | Locus Name | | Acc# |
|---|---|---|---|---|---|---|
| B12-dependent | | | | gp:ECOUW89 | | U00006 |

Description

*E. coli* chromosomal region from 89.2 to 92.8 minutes.

-continued

| ORF Name | NTID | AAID | NT Length | AA Length | Score | Probability |
|---|---|---|---|---|---|---|
| 15085902_f2_125 | 705 | 5927 | 788 | 2367 | 1213 | 2.8e−129 |

| Protein name | Locus Name | Acc# |
|---|---|---|
| | sp:RHO_PSEFL | P52155 |

Description

TRANSCRIPTION TERMINATION FACTOR RHO

| ORF Name | NTID | AAID | NT Length | AA Length | Score | Probability |
|---|---|---|---|---|---|---|
| 15629642_f2_79 | 706 | 5928 | 380 | 1143 | 113 | 0.0067 |

| Protein name | Locus Name | Acc# |
|---|---|---|
| | gp:PFMAL3P2 | |

Description

*Plasmodium falciparum* MAL3Ps, complete sequence.

| ORF Name | NTID | AAID | NT Length | AA Length | Score | Probability |
|---|---|---|---|---|---|---|
| 1995452_c3_340 | 707 | 5929 | 133 | 402 | 88 | 0.0023 |

| Protein name | Locus Name | Acc# |
|---|---|---|
| | gp:SYCPURT | L36958 |

Description

*Synechocystis* sp. (clone pSYN411) glycinamide ribonucleotide transformylase (purT), Orf134 and dnaA genes, complete cds, photosystem II reaction center protein D2 (psbD) gene, 5' end.

| ORF Name | NTID | AAID | NT Length | AA Length | Score | Probability |
|---|---|---|---|---|---|---|
| 20119062_f3_159 | 708 | 5930 | 642 | 1929 | 1069 | 1.1e−123 |

| Protein name | Locus Name | Acc# |
|---|---|---|
| hypothetical protein Rv2438c | pir:D70680 | D70680 |

Description

| ORF Name | NTID | AAID | NT Length | AA Length | Score | Probability |
|---|---|---|---|---|---|---|
| 21520006_c2_301 | 709 | 5931 | 289 | 870 | 101 | 0.0091 |

| Protein name | Locus Name | Acc# |
|---|---|---|
| hypothetical protein | gp:AF021091 | AF021091 |

Description

*Helicobacter pylori* hypothetical protein (HP0395), hypothetical protein (HP0394), chemotaxis protein CheV (cheV), bifunctional chemotaxis protein CheF (cheF), chemotaxis protein CheW (cheW), and adhesin-thiol peroxidase TagD (tagD) genes, complete cds; and superoxide dismutase SodB (sodB) gene, partial cds.

| ORF Name | NTID | AAID | NT Length | AA Length | Score | Probability |
|---|---|---|---|---|---|---|
| 2161286_f3_160 | 710 | 5932 | 192 | 579 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 21641562_c2_271 | 711 | 5933 | 198 | 597 | | |
| Protein name | | | Locus Name | | Acc# | |
| Description | | | | | | |

NO-HIT

| ORF Name | NTID | AAID | NT Length | AA Length | Score | Probability |
|---|---|---|---|---|---|---|
| 22289781_f3_195 | 712 | 5934 | 676 | 2031 | 213 | 1.5e−13 |
| Protein name | | | Locus Name | | Acc# | |
| | | | sp:PLEC_CAUCR | | P37894 | |
| Description | | | | | | |

NON-MOTILE AND PHAGE-RESISTANCE PROTEIN,

| ORF Name | NTID | AAID | NT Length | AA Length | Score | Probability |
|---|---|---|---|---|---|---|
| 22902267_c2_318 | 713 | 5935 | 252 | 759 | | |
| Protein name | | | Locus Name | | Acc# | |
| Description | | | | | | |

NO-HIT

| ORF Name | NTID | AAID | NT Length | AA Length | Score | Probability |
|---|---|---|---|---|---|---|
| 23477187_f1_54 | 714 | 5936 | 315 | 948 | 398 | 5.9e−37 |
| Protein name | | | Locus Name | | Acc# | |
| BrkB | | | pir:I40328 | | I40328 | |
| Description | | | | | | |

| ORF Name | NTID | AAID | NT Length | AA Length | Score | Probability |
|---|---|---|---|---|---|---|
| 23522812_f2_70 | 715 | 5937 | 63 | 192 | | |
| Protein name | | | Locus Name | | Acc# | |
| Description | | | | | | |

NO-HIT

| ORF Name | NTID | AAID | NT Length | AA Length | Score | Probability |
|---|---|---|---|---|---|---|
| 23593750_f2_84 | 716 | 5938 | 726 | 2181 | | |
| Protein name | | | Locus Name | | Acc# | |
| Description | | | | | | |

NO-HIT

| ORF Name | NTID | AAID | NT Length | AA Length | Score | Probability |
|---|---|---|---|---|---|---|
| 2381338_c2_316 | 717 | 5939 | 347 | 1044 | 87 | 0.025 |
| Protein name | | | Locus Name | | Acc# | |
| hypothetical protein PH0161 | | | pir:G71237 | | G71237 | |
| Description | | | | | | |

-continued

| ORF Name | NTID | AAID | NT Length | AA Length | Score | Probability |
|---|---|---|---|---|---|---|
| 24259427_c3_381 | 718 | 5940 | 265 | 798 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24335943_c1_236 | 719 | 5941 | 385 | 1158 | 190 | 8.0e−12 |

| Protein Name | | | | Locus Name | | Acc# |
|---|---|---|---|---|---|---|
| conserved hypothetical protein MTH884 | | | | pir:B69218 | | B69218 |

Description

| ORF Name | NTID | AAID | NT Length | AA Length | Score | Probability |
|---|---|---|---|---|---|---|
| 24408517_c3_384 | 720 | 5942 | 93 | 282 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24640677_c2_317 | 721 | 5943 | 290 | 873 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24641080_c1_214 | 722 | 5944 | 136 | 411 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24643887_c2_314 | 723 | 5945 | 355 | 1068 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24648538_c1_233 | 724 | 5946 | 187 | 564 | 331 | 7.4e−30 |

| Protein name | | | | Locus Name | | Acc# |
|---|---|---|---|---|---|---|
| | | | | sp:Y746_METJA | | Q58156 |

Description

HYPOTHETICAL PROTEIN MJ0746

-continued

| ORF Name | NTID | AAID | NT Length | AA Length | Score | Probability |
|---|---|---|---|---|---|---|
| 24650302_f1_16 | 725 | 5947 | 723 | 2172 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24650912_c3_349 | 726 | 5948 | 519 | 1560 | 1415 | 1.0e−144 |

| Protein name | | | | Locus Name | | Acc# |
|---|---|---|---|---|---|---|
| sodium/proline symporter (proline permease) | | | | pir:C69115 | | C69115 |

Description

| ORF Name | NTID | AAID | NT Length | AA Length | Score | Probability |
|---|---|---|---|---|---|---|
| 24798457_f3_162 | 727 | 5949 | 500 | 1503 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24806567_c1_221 | 728 | 5950 | 670 | 2013 | 233 | 1.2e−21 |

| Protein name | | | | Locus Name | | Acc# |
|---|---|---|---|---|---|---|
| | | | | sp:DSBD_HAEIN | | P44919 |

Description

BIOGENESIS PROTEIN CYCZ)

| ORF Name | NTID | AAID | NT Length | AA Length | Score | Probability |
|---|---|---|---|---|---|---|
| 24853385_c2_321 | 729 | 5951 | 343 | 1032 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 2504787_f3_189 | 730 | 5952 | 258 | 777 | 89 | 0.0093 |

| Protein name | | | | Locus Name | | Acc# |
|---|---|---|---|---|---|---|
| ORF128 hypothetical protein | | | | gp:AF008210 | | AF008210 |

Description

*Buchnera aphidicola* genomic fragment containing (chaperone Hsp60) groEL, DNA biosynthesis initiating protein (dnaA), ATP operon (atpCDGAHFEB), and putative chromosome replication protein (gidA) genes, complete cds; and termination factor Rho (rho) gene, partial cds.

-continued

| ORF Name | NTID | AAID | NT Length | AA Length | Score | Probability |
|---|---|---|---|---|---|---|
| 25859425_c3_373 | 731 | 5953 | 84 | 195 | 92 | 0.00016 |

| Protein name | Locus Name | Acc# |
|---|---|---|
| hypothetical protein ssr1765 | pir:S74779 | S74779 |

Description

| ORF Name | NTID | AAID | NT Length | AA Length | Score | Probability |
|---|---|---|---|---|---|---|
| 26220277_c1_252 | 732 | 5954 | 193 | 582 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 26367943_f2_120 | 733 | 5955 | 341 | 1026 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 26369087_c2_299 | 734 | 5956 | 116 | 351 | 263 | 1.2e−22 |

| Protein name | Locus Name | Acc# |
|---|---|---|
| | sp:YHAI_ECOLI | P42622 |

Description

HYPOTHETICAL 13.5 KD PROTEIN IN EXUR-TDCC INTERGENIC REGION

| ORF Name | NTID | AAID | NT Length | AA Length | Score | Probability |
|---|---|---|---|---|---|---|
| 26461627_c1_223 | 735 | 5957 | 351 | 1056 | 500 | 4.0e−57 |

| Protein name | Locus Name | Acc# |
|---|---|---|
| | sp:HIS8_CANMA | P56099 |

Description

PHOSPHATE TRANSMAMINASE)

| ORF Name | NTID | AAID | NT Length | AA Length | Score | Probability |
|---|---|---|---|---|---|---|
| 2928387_c1_215 | 736 | 5958 | 197 | 594 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 29314080_c1_231 | 737 | 5959 | 724 | 2175 | 1417 | 6.1e−145 |

| Protein name | Locus Name | Acc# |
|---|---|---|
| | sp:DCP_ECOLI | |

Description

PEPTIDYL-DIPEPTIDASE DCP, (DIPEPTIDYL CARBOXY PEPTIDASE)

| ORF Name | NTID | AAID | NT Length | AA Length | Score | Probability |
|---|---|---|---|---|---|---|
| 30256552_f1_40 | 738 | 5960 | 245 | 738 | 571 | 2.7e−55 |

| Protein name | Locus Name | Acc# |
|---|---|---|
| uridine kinase udk | pir:G69728 | G69728 |

Description

| ORF Name | NTID | AAID | NT Length | AA Length | Score | Probability |
|---|---|---|---|---|---|---|
| 32228408_f3_176 | 739 | 5961 | 464 | 1395 | 473 | 6.6e−45 |

| Protein name | Locus Name | Acc# |
|---|---|---|
| unknown | gp:AF086638 | AF086638 |

Description

*Psuedomonas putida* CumA precursor (cumA) and CumB (cumB) genes, complete cds; and unknown genes.

| ORF Name | NTID | AAID | NT Length | AA Length | Score | Probability |
|---|---|---|---|---|---|---|
| 33235905_c3_385 | 740 | 5962 | 476 | 1431 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 34183438_f1_35 | 741 | 5963 | 239 | 720 | 430 | 2.4e−40 |

| Protein name | Locus Name | Acc# |
|---|---|---|
| | sp:YHHW_ECOLI | P46852 |

Description

HYPOTHETICAL 26.3 KD PROTEIN IN GNTR-GGT INTERGENIC REGION (F231)

| ORF Name | NTID | AAID | NT Length | AA Length | Score | Probability |
|---|---|---|---|---|---|---|
| 34625053_f2_129 | 742 | 5964 | 493 | 1482 | 352 | 1.6e−34 |

| Protein name | Locus Name | Acc# |
|---|---|---|
| damage-inducible protein PAB0243 | pir:A75151 | A75151 |

Description

-continued

| ORF Name | NTID | AAID | NT Length | AA Length | Score | Probability |
|---|---|---|---|---|---|---|
| 36056510_c1_251 | 743 | 5965 | 422 | 1269 | | |

| Protein name | | Locus Name | Acc# |
|---|---|---|---|
| | | | |

Description

NO-HIT

| ORF Name | NTID | AAID | NT Length | AA Length | Score | Probability |
|---|---|---|---|---|---|---|
| 36132912_c2_281 | 744 | 5966 | 167 | 504 | 106 | 0.00018 |

| Protein name | | Locus Name | Acc# |
|---|---|---|---|
| hypothetical protein SC2E9.08 SC2E9.08 | | pir:T34819 | T34819 |

Description

| ORF Name | NTID | AAID | NT Length | AA Length | Score | Probability |
|---|---|---|---|---|---|---|
| 3912781_f2_98 | 745 | 5967 | 338 | 1017 | 317 | 1.8e−37 |

| Protein name | | Locus Name | Acc# |
|---|---|---|---|
| hypothetical protein F19D11.16:hypothetical protein F14M4.29:hypothetical protein F14M4.29 | | pir:T02689 | |

Description

| ORF Name | NTID | AAID | NT Length | AA Length | Score | Probability |
|---|---|---|---|---|---|---|
| 3928550_f3_161 | 746 | 5968 | 1054 | 3165 | 325 | 4.3e−45 |

| Protein name | | Locus Name | Acc# |
|---|---|---|---|
| 115K outer membrane protein precursor:SusC protein | | pir:JC6027 | JC6027 |

Description

| ORF Name | NTID | AAID | NT Length | AA Length | Score | Probability |
|---|---|---|---|---|---|---|
| 3938831_f3_147 | 747 | 5969 | 416 | 1251 | 1961 | 1.4e−202 |

| Protein name | | Locus Name | Acc# |
|---|---|---|---|
| | | sp:CHUR_BACTN | Q02550 |

Description

CHONDRO-6-SULFATASE REGULATORY PROTEIN

| ORF Name | NTID | AAID | NT Length | AA Length | Score | Probability |
|---|---|---|---|---|---|---|
| 3948562_c1_217 | 748 | 5970 | 204 | 615 | 373 | 2.6e−34 |

| Protein name | | Locus Name | Acc# |
|---|---|---|---|
| | | sp:Y120_METTH | O26223 |

Description

PUTATIVE NADH DEHYDROGENASE/NAD(P)H NITROREDUCTASE,

-continued

| ORF Name | NTID | AAID | NT Length | AA Length | Score | Probability |
|---|---|---|---|---|---|---|
| 4022312_c1_209 | 749 | 5971 | 282 | 849 | 141 | 2.7e−09 |

| Protein name | Locus Name | Acc# |
|---|---|---|
| ferredoxin (fdx-3) homolog | pir:C69294 | C69294 |

Description

| ORF Name | NTID | AAID | NT Length | AA Length | Score | Probability |
|---|---|---|---|---|---|---|
| 4069137_c3_387 | 750 | 5972 | 301 | 906 | 127 | 1.9e−14 |

| Protein name | Locus Name | Acc# |
|---|---|---|
| leader peptidase Lep | gp:AF188620 | AF188620 |

Description

*Bordetella pertussis* lep operon, complete sequence.

| ORF Name | NTID | AAID | NT Length | AA Length | Score | Probability |
|---|---|---|---|---|---|---|
| 4117150_f3_197 | 751 | 5973 | 426 | 1278 | 1151 | 9.4e−117 |

| Protein name | Locus Name | Acc# |
|---|---|---|
|  | sp:SR54_BACSU | P37105 |

Description

SIGNAL RECOGNITION PARTICLE PROTEIN (FIFTY-FOUR HOMOLOG)

| ORF Name | NTID | AAID | NT Length | AA Length | Score | Probability |
|---|---|---|---|---|---|---|
| 4461562_c3_370 | 752 | 5974 | 216 | 651 | 216 | 1.1e−17 |

| Protein name | Locus Name | Acc# |
|---|---|---|
| hypothetical protein PAB1763 | pir:D75137 | D75137 |

Description

| ORF Name | NTID | AAID | NT Length | AA Length | Score | Probability |
|---|---|---|---|---|---|---|
| 4689092_c1_232 | 753 | 5975 | 199 | 600 | 244 | 1.2e−20 |

| Protein name | Locus Name | Acc# |
|---|---|---|
| ferric uptake regulator homolog | gp:AF095596 | AF095596 |

Description

*Staphylococcus aureus* strain ISP3 ferric uptake regulator homolog (furB) gene, complete cds.

| ORF Name | NTID | AAID | NT Length | AA Length | Score | Probability |
|---|---|---|---|---|---|---|
| 4698432_f2_121 | 754 | 5976 | 340 | 1023 | 687 | 1.4e−67 |

| Protein name | Locus Name | Acc# |
|---|---|---|
| synthase III | pir:F70394 | F70394 |

Description

| ORF Name | NTID | AAID | NT Length | AA Length | Score | Probability |
|---|---|---|---|---|---|---|
| 4734638_c3_354 | 755 | 5977 | 287 | 864 | 639 | 1.7e−62 |

| Protein name | Locus Name | Acc# |
|---|---|---|
| | sp:HIS1_SALTY | P00499 |

Description

ATP PHOSPHORIBOSYLTRANSFERASE,

| ORF Name | NTID | AAID | NT Length | AA Length | Score | Probability |
|---|---|---|---|---|---|---|
| 4876563_c1_216 | 756 | 5978 | 153 | 462 | 361 | 4.9e−33 |

| Protein name | Locus Name | Acc# |
|---|---|---|
| | sp:SMPB_BACSU | O32230 |

Description

SMALL PROTEIN B HOMOLOG

| ORF Name | NTID | AAID | NT Length | AA Length | Score | Probability |
|---|---|---|---|---|---|---|
| 4960812_f3_153 | 757 | 5979 | 158 | 477 | 299 | 1.8e−26 |

| Protein name | Locus Name | Acc# |
|---|---|---|
| | sp:THIO_BORBU | O51088 |

Description

THIOREDOXIN (TRX)

| ORF Name | NTID | AAID | NT Length | AA Length | Score | Probability |
|---|---|---|---|---|---|---|
| 5175875_c2_320 | 758 | 5980 | 192 | 579 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 5313952_f3_190 | 759 | 5981 | 485 | 1458 | 1360 | 6.7e−139 |

| Protein name | Locus Name | Acc# |
|---|---|---|
| raw starch digesting amylase precursor | gp:AF067653 | AF067653 |

Description

*Cytophaga* sp. raw starch digesting amylase precursor, gene, complete cds.

| ORF Name | NTID | AAID | NT Length | AA Length | Score | Probability |
|---|---|---|---|---|---|---|
| 579577_f3_152 | 760 | 5982 | 158 | 477 | 242 | 2.0e−20 |

| Protein name | Locus Name | Acc# |
|---|---|---|
| thioredoxin-like protein | gp:ATAC010718 | AC010718 |

Description

*Arabidopsis thaliana* chromosome I BAC F28O16 genomic sequence, complete sequence.

-continued

| ORF Name | NTID | AAID | NT Length | AA Length | Score | Probability |
|---|---|---|---|---|---|---|
| 6056552_c3_386 | 761 | 5983 | 337 | 1014 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 6102312_c1_250 | 762 | 5984 | 349 | 1050 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 6250003_c1_247 | 763 | 5985 | 598 | 1797 | 129 | 4.9e−05 |

| Protein name | | | | Locus Name | | Acc# |
|---|---|---|---|---|---|---|
| conserved hyothetical protein BB0195 | | | | pir:C70124 | | C70124 |

Description

| ORF Name | NTID | AAID | NT Length | AA Length | Score | Probability |
|---|---|---|---|---|---|---|
| 6442137_c3_352 | 764 | 5986 | 103 | 312 | 120 | 1.7e−07 |

| Protein name | | | | Locus Name | | Acc# |
|---|---|---|---|---|---|---|
| | | | | sp:YRPX_STRCO | | P37977 |

Description

HYPOTHETICAL 11.1 KD PROTEIN IN RPOX 5' REGION

| ORF Name | NTID | AAID | NT Length | AA Length | Score | Probability |
|---|---|---|---|---|---|---|
| 829692_c2_303 | 765 | 5987 | 70 | 213 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 906903_c3_346 | 766 | 5988 | 287 | 8764 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 978387_c1_248 | 767 | 5989 | 130 | 393 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 9900327_c3_324 | 768 | 5990 | 237 | 714 | 149 | 1.5e–10 |

| Protein name | Locus Name | Acc# |
|---|---|---|
| hypothetical protein PH1670 | pir:F71047 | F71047 |

Description

| ORF Name | NTID | AAID | NT Length | AA Length | Score | Probability |
|---|---|---|---|---|---|---|
| 11721040_f1_42 | 769 | 5991 | 78 | 237 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 1256885_f3_133 | 770 | 5992 | 382 | 1149 | 510 | 7.6e–48 |

| Protein name | Locus Name | Acc# |
|---|---|---|
| Man26A | gp:AF126471 | AF126471 |

Description

*Cellulomonas fimi* Man26A (man26A) gene, complete cds.

| ORF Name | NTID | AAID | NT Length | AA Length | Score | Probability |
|---|---|---|---|---|---|---|
| 12773255_c2_289 | 771 | 5993 | 519 | 1560 | 417 | 5.7e–39 |

| Protein name | Locus Name | Acc# |
|---|---|---|
| conserved hypothetical protein | pir:B72391 | B72391 |

Description

| ORF Name | NTID | AAID | NT Length | AA Length | Score | Probability |
|---|---|---|---|---|---|---|
| 13709635_c1_211 | 772 | 5994 | 522 | 1569 | 319 | 6.8e–36 |

| Protein name | Locus Name | Acc# |
|---|---|---|
| Arylsulfatase precursor (EC 3.1.6.1) | gp:D90791 | |

Description

*E. coli* genomic DNA, Kohara clone #280 (33.7–34.1 min.).

| ORF Name | NTID | AAID | NT Length | AA Length | Score | Probability |
|---|---|---|---|---|---|---|
| 13711437_c1_215 | 773 | 5995 | 106 | 321 | 148 | 1.4e–09 |

| Protein name | Locus Name | Acc# |
|---|---|---|
| TRK system potassium uptake protein (trkA) | gp:U32745 | |

Description

*Haemophilus influenzae* Rd section 60 of 163 of the complete genome.

-continued

| ORF Name | NTID | AAID | NT Length | AA Length | Score | Probability |
|---|---|---|---|---|---|---|
| 14651512_f1_5 | 774 | 5996 | 469 | 1410 | 782 | 1.2e−77 |

| Protein name | Locus Name | Acc# |
|---|---|---|
| | sp:YAGG_ECOLI | |

Description

HYPOTHETICAL SYMPORTER IN PERR-ARGF INTERGENIC REGION

| ORF Name | NTID | AAID | NT Length | AA Length | Score | Probability |
|---|---|---|---|---|---|---|
| 14726062_c1_203 | 775 | 5997 | 664 | 1995 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 16600327_f3_130 | 776 | 5998 | 216 | 651 | 442 | 1.3e−41 |

| Protein name | Locus Name | Acc# |
|---|---|---|
| dimethylamine corrinoid protein MtbC | gp:AF102623 | AF102623 |

Description

*Methanosarcina barkeri* dimethylamine corrinoid protein MtbC (mtbC), trimethylamine methyltransferase MttB (mttB), trimethylaminecorrinoid protein MttC (mttC), putative transmembrane protein MttP (mttP), and dimethylamine methyltransferase MtbB1 (mtbB1) genes, complete cds.

| ORF Name | NTID | AAID | NT Length | AA Length | Score | Probability |
|---|---|---|---|---|---|---|
| 20525252_c2_307 | 777 | 5999 | 637 | 1914 | 1050 | 9.7e−125 |

| Protein name | Locus Name | Acc# |
|---|---|---|
| | sp:NU5C_SYNP2 | P31971 |

Description

NADH-PLASTOQUINONE OXIDOREDUCTASE CHAIN 5,

| ORF Name | NTID | AAID | NT Length | AA Length | Score | Probability |
|---|---|---|---|---|---|---|
| 2117177_f2_71 | 778 | 6000 | 439 | 1320 | 354 | 1.5e−31 |

| Protein name | Locus Name | Acc# |
|---|---|---|
| endo-1,4-beta-mannosidase | pir:D72278 | D72278 |

Description

| ORF Name | NTID | AAID | NT Length | AA Length | Score | Probability |
|---|---|---|---|---|---|---|
| 21664650_f1_6 | 779 | 6001 | 396 | 1191 | 239 | 6.0e−18 |

| Protein name | Locus Name | Acc# |
|---|---|---|
| renin-binding protein-related protein:protein slr1975:protein slr1975 | Pir:S75649 | S75649 |

Description

-continued

| ORF Name | NTID | AAID | NT Length | AA Length | Score | Probability |
|---|---|---|---|---|---|---|
| 21875377_f1_7 | 780 | 6002 | 602 | 1809 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 22270002_f2_70 | 781 | 6003 | 258 | 777 | 475 | 4.5e−44 |

| Protein name | | | | Locus Name | | Acc# |
|---|---|---|---|---|---|---|
| Man26A | | | | gp:AF126471 | | AF126471 |

Description

*Cellulomonas fimi* Man26A (man26A) gene, complete cds.

| ORF Name | NTID | AAID | NT Length | AA Length | Score | Probability |
|---|---|---|---|---|---|---|
| 22550917_c2_317 | 782 | 6004 | 398 | 1197 | 99 | 0.036 |

| Protein name | | | | Locus Name | | Acc# |
|---|---|---|---|---|---|---|
| endo-beta-1,3-glucanase precursor | | | | gp:AF013169 | | |

Description

*Pyrococcus furiosus* beta-glucosidase (celB) gene, complete cds; adh-lam operon, complete sequence; biotin ligase BirA homolog (birA) gene, complete cds; and 2-phosphoglycerate kinase (pgk) gene, partial cds.

| ORF Name | NTID | AAID | NT Length | AA Length | Score | Probability |
|---|---|---|---|---|---|---|
| 23712837_f2_81 | 783 | 6005 | 377 | 1134 | 169 | 4.8e−12 |

| Protein name | | | | Locus Name | | Acc# |
|---|---|---|---|---|---|---|
| conserved hypothetical protein SC9C7.14c | | | | pir:T35965 | | T35965 |

Description

| ORF Name | NTID | AAID | NT Length | AA Length | Score | Probability |
|---|---|---|---|---|---|---|
| 24260302_f3_134 | 784 | 6006 | 398 | 1197 | 283 | 9.0e−25 |

| Protein name | | | | Locus Name | | Acc# |
|---|---|---|---|---|---|---|
| conserved hypothetical protein | | | | pir:B72278 | | B72278 |

Description

| ORF Name | NTID | AAID | NT Length | AA Length | Score | Probability |
|---|---|---|---|---|---|---|
| 24409668_f3_124 | 785 | 6007 | 140 | 423 | | |

| Protein name | | | | Locus Name | | Acc# |
|---|---|---|---|---|---|---|

Description

NO-HIT

-continued

| ORF Name | NTID | AAID | NT Length | AA Length | Score | Probability |
|---|---|---|---|---|---|---|
| 24415962_c2_304 | 786 | 6008 | 160 | 483 | 231 | 2.9e−19 |

| Protein name | Locus Name | Acc# |
|---|---|---|
| NADH dehydrogenase (ubiquinone), I chain I RP795 | pir:E71640 | E71640 |

Description

| ORF Name | NTID | AAID | NT Length | AA Length | Score | Probability |
|---|---|---|---|---|---|---|
| 24492137_f1_2 | 787 | 6009 | 1075 | 3228 | 163 | 1.4e−07 |

| Protein name | Locus Name | Acc# |
|---|---|---|
| probable secreted glucosidase | pir:T35164 | T35164 |

Description

| ORF Name | NTID | AAID | NT Length | AA Length | Score | Probability |
|---|---|---|---|---|---|---|
| 24642787_c2_316 | 788 | 6010 | 426 | 1281 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24644052_c1_205 | 789 | 6011 | 405 | 1218 | 197 | 2.4e−26 |

| Protein name | Locus Name | Acc# |
|---|---|---|
| alpha-1,3/4-fucosidase precursor | gp:SSU39394 | U39394 |

Description

*Streptomyces* sp. alpha-1,3/4-fucosidase precursor gene, complete cds.

| ORF Name | NTID | AAID | NT Length | AA Length | Score | Probability |
|---|---|---|---|---|---|---|
| 24645437_c3_384 | 790 | 6012 | 901 | 2706 | 176 | 3.8e−08 |

| Protein name | Locus Name | Acc# |
|---|---|---|
| 115K outer membrane protein precursor:SusC protein | pir:JC6027 | JC6027 |

Description

| ORF Name | NTID | AAID | NT Length | AA Length | Score | Probability |
|---|---|---|---|---|---|---|
| 24648388_f3_198 | 791 | 6013 | 239 | 717 | 518 | 1.1e−49 |

| Protein name | Locus Name | Acc# |
|---|---|---|
| probable glycosyl hydrolase | pir:T36467 | T36467 |

Description

-continued

| ORF Name | NTID | AAID | NT Length | AA Length | Score | Probability |
|---|---|---|---|---|---|---|
| 25400260_c1_220 | 792 | 6014 | 279 | 840 | 568 | 5.7e−55 |

| Protein name | Locus Name | Acc# |
|---|---|---|
| | sp:NUOH_ECOLI | |

Description

OXIDOREDUCTASE CHAIN 8) (NUO8)

| ORF Name | NTID | AAID | NT Length | AA Length | Score | Probability |
|---|---|---|---|---|---|---|
| 25817656_c3_368 | 793 | 6015 | 836 | 2511 | 871 | 4.4e−87 |

| Protein name | Locus Name | Acc# |
|---|---|---|
| | sp:TRKH_ECOLI | |

Description

TRK SYSTEM POTASSIUM UPTAKE PROTEIN TRKH

| ORF Name | NTID | AAID | NT Length | AA Length | Score | Probability |
|---|---|---|---|---|---|---|
| 26230265_f2_67 | 794 | 6016 | 625 | 1878 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 26360717_f3_183 | 795 | 6017 | 219 | 660 | 346 | 1.9e−31 |

| Protein name | Locus Name | Acc# |
|---|---|---|
| phosphoglycolate phosphatase (gph) homolog | pir:C70184 | C70184 |

Description

| ORF Name | NTID | AAID | NT Length | AA Length | Score | Probability |
|---|---|---|---|---|---|---|
| 26366542_c2_308 | 796 | 6018 | 498 | 1497 | 719 | 1.9e−73 |

| Protein name | Locus Name | Acc# |
|---|---|---|
| NADH dehydrogenase (ubiquinone), chain 4.2:protein slr1291:protein slr1291 | pir:S74687 | S74687 |

Description

| ORF Name | NTID | AAID | NT Length | AA Length | Score | Probability |
|---|---|---|---|---|---|---|
| 26384637_c3_372 | 797 | 6019 | 531 | 1596 | 738 | 4.7e−85 |

| Protein name | Locus Name | Acc# |
|---|---|---|
| NADH dehydrogenase (ubiquinone), I chain nuoD2 | pir:D70413 | D70413 |

Description

-continued

| ORF Name | NTID | AAID | NT Length | AA Length | Score | Probability |
|---|---|---|---|---|---|---|
| 26587708_f2_65 | 798 | 6020 | 536 | 1611 | 204 | 3.8e−13 |

| Protein name | | | | Locus Name | | Acc# |
|---|---|---|---|---|---|---|
| unknown | | | | gp:U96771 | | U96771 |

Description

*Prevotella bryantii* putative polygalacturonase, B-1,4-endoglucanase, and mannanase genes, complete cds; and unknown genes.

| ORF Name | NTID | AAID | NT Length | AA Length | Score | Probability |
|---|---|---|---|---|---|---|
| 26594137_f2_75 | 799 | 6021 | 336 | 1011 | 293 | 7.9e−26 |

| Protein name | | | | Locus Name | | Acc# |
|---|---|---|---|---|---|---|
| methylcobamide:CoM methyltransferase isozyme A | | | | gp:AF013713 | | AF013713 |

Description

*Methanosarcina barkeri* methylcobamide:CoM methyltransferase isozyme A (mtbA), monomethylamine corrinoid protein (mtmC), monomethylaminemethyltransferase (mtmB), putative monomethylamine permease (mtmP), and unknown genes, complete cds.

| ORF Name | NTID | AAID | NT Length | AA Length | Score | Probability |
|---|---|---|---|---|---|---|
| 26604712_c2_309 | 800 | 6022 | 485 | 1458 | 725 | 1.3e−71 |

| Protein name | | | | Locus Name | | Acc# |
|---|---|---|---|---|---|---|
| | | | | sp:NU2C_SYNY3 | | P72714 |

Description

NADH-PLASTOQUINONE OXIDOREDUCTASE CHAIN 2,

| ORF Name | NTID | AAID | NT Length | AA Length | Score | Probability |
|---|---|---|---|---|---|---|
| 29457557_c2_300 | 801 | 6023 | 126 | 381 | 225 | 1.3e−18 |

| Protein name | | | | Locus Name | | Acc# |
|---|---|---|---|---|---|---|
| | | | | sp:NU3C_ANTFO | | Q31792 |

Description

NADH-PLASTOQUINONE OXIDOREDUCTASE CHAIN 3, CHLOROPLAST,

| ORF Name | NTID | AAID | NT Length | AA Length | Score | Probability |
|---|---|---|---|---|---|---|
| 31776708_c3_371 | 802 | 6024 | 65 | 198 | 163 | 4.7e−12 |

| Protein name | | | | Locus Name | | Acc# |
|---|---|---|---|---|---|---|
| NADH dehydrogenase (ubiquinone), I chain nuoB | | | | pir:C70413 | | C70413 |

Description

| ORF Name | NTID | AAID | NT Length | AA Length | Score | Probability |
|---|---|---|---|---|---|---|
| 32532838_f2_80 | 803 | 6025 | 518 | 1557 | | |

| Protein name | | | | Locus Name | | Acc# |
|---|---|---|---|---|---|---|

Description

NO-HIT

-continued

| ORF Name | NTID | AAID | NT Length | AA Length | Score | Probability |
|---|---|---|---|---|---|---|
| 33835790_f2_74 | 804 | 6026 | 251 | 756 | 92 | 0.045 |

| Protein name | Locus Name | Acc# |
|---|---|---|
| hypothetical protein | pir:C72397 | C72397 |

Description

| ORF Name | NTID | AAID | NT Length | AA Length | Score | Probability |
|---|---|---|---|---|---|---|
| 36132686_c3_364 | 805 | 6027 | 114 | 345 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 36360962_c2_305 | 806 | 6028 | 172 | 519 | 204 | 2.1e−16 |

| Protein name | Locus Name | Acc# |
|---|---|---|
| NADH dehydrogenase (ubiquinone), I chain J | pir:C71839 | C71839 |

Description

| ORF Name | NTID | AAID | NT Length | AA Length | Score | Probability |
|---|---|---|---|---|---|---|
| 3907132_f2_90 | 807 | 6029 | 932 | 2799 | 470 | 7.6e−41 |

| Protein name | Locus Name | Acc# |
|---|---|---|
| sensory transduction histidine kinase slr2098:protein slr2098:protein slr2098 | pir:S75130 | S75130 |

Description

| ORF Name | NTID | AAID | NT Length | AA Length | Score | Probability |
|---|---|---|---|---|---|---|
| 3995302_c2_301 | 808 | 6030 | 185 | 558 | 319 | 1.4e−28 |

| Protein name | Locus Name | Acc# |
|---|---|---|
| NADH dehydrogenase I, subunit nuoB | gp:ECNUOO | X68301 |

Description

*E. coli* DNA sequence of nuo operon.

| ORF Name | NTID | AAID | NT Length | AA Length | Score | Probability |
|---|---|---|---|---|---|---|
| 4146907_c1_202 | 809 | 6031 | 1071 | 3216 | 714 | 2.4e−81 |

| Protein name | Locus Name | Acc# |
|---|---|---|
| receptor antigen (RagA) | gp:PGI130872 | AJ130872 |

Description

*Porphyromonas gingivalis* W50 receptor antigen (rag) locus encoding a major immunodominant 55 kDa antigen.

-continued

| ORF Name | NTID | AAID | NT Length | AA Length | Score | Probability |
|---|---|---|---|---|---|---|
| 4553400_c2_287 | 810 | 6032 | 694 | 2085 | 173 | 6.3–18 |

| Protein name | | | Locus Name | | | Acc# |
|---|---|---|---|---|---|---|
| Sip1 protein | | | pir:S27762 | | | S27762 |

Description

| ORF Name | NTID | AAID | NT Length | AA Length | Score | Probability |
|---|---|---|---|---|---|---|
| 4566876_c2_285 | 811 | 6033 | 487 | 1464 | 411 | 2.5e–38 |

| Protein name | | | Locus Name | | | Acc# |
|---|---|---|---|---|---|---|
| | | | sp:YIDJ_ECOLI | | | P31447 |

Description

HYPOTHETICAL 57.3 KD PROTEIN IN EMRD-GLVG INTERGENIC REGION

| ORF Name | NTID | AAID | NT Length | AA Length | Score | Probability |
|---|---|---|---|---|---|---|
| 4975313_c3_369 | 812 | 6034 | 128 | 387 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 5111038_c2_306 | 813 | 6035 | 105 | 318 | 231 | 2.9e–19 |

| Protein name | | | Locus Name | | | Acc# |
|---|---|---|---|---|---|---|
| | | | sp:NULC_PLEBO | | | Q00244 |

Description

NADH-PLASTOQUINONE OXIDOREDUCTASE CHAIN 4L,

| ORF Name | NTID | AAID | NT Length | AA Length | Score | Probability |
|---|---|---|---|---|---|---|
| 5860027_f3_196 | 814 | 6036 | 1380 | 4143 | 519 | 4.9e–46 |

| Protein name | | | Locus Name | | | Acc# |
|---|---|---|---|---|---|---|
| utilizing regulatory protein tutC | | | gp:TTU57900 | | | U57900 |

Description

*Thauera aromatica* utilizing regulatory protein tutC (tutC), utilizing regulatory protein tutB (tutB), putative DNA binding protein TutB1 (tutB1), and putative protein kinase TutC1 (tutC1) genes, complete cds.

| ORF Name | NTID | AAID | NT Length | AA Length | Score | Probability |
|---|---|---|---|---|---|---|
| 6444137_f3_129 | 815 | 6037 | 421 | 1266 | 138 | 2.8e–06 |

| Protein name | | | Locus Name | | | Acc# |
|---|---|---|---|---|---|---|
| CmuC protein | | | gp:MSP011317 | | | AJ011317 |

Description

*Methylbacterium* sp. CM4, cobD, metF, cmuB, omuC, partial cobC and cobQ, genes and genes encoding Orf219 and Orf361.

-continued

| ORF Name | NTID | AAID | NT Length | AA Length | Score | Probability |
|---|---|---|---|---|---|---|
| 7074155_f1_1 | 816 | 6038 | 384 | 1155 | 211 | 1.4e−14 |

| Protein name | Locus Name | Acc# |
|---|---|---|
| unknown | gp:U96771 | U96771 |

Description

*Prevotella bryantii* putative polygalacturonase, B-1,4-endoglucanase, and mannanase genes, complete cds; and unknown genes.

| ORF Name | NTID | AAID | NT Length | AA Length | Score | Probability |
|---|---|---|---|---|---|---|
| 7220153_c2_291 | 817 | 6039 | 686 | 2061 | 1366 | 1.6e−139 |

| Protein name | Locus Name | Acc# |
|---|---|---|
| | sp:DXS_HAEIN | P45205 |

Description

1-DEOXYXYLULOSE-5-PHOSPHATE SYNTHASE (DXP SYNTHASE)

| ORF Name | NTID | AAID | NT Length | AA Length | Score | Probability |
|---|---|---|---|---|---|---|
| 972167_c1_199 | 818 | 6040 | 512 | 1539 | 359 | 3.0e−43 |

| Protein name | Locus Name | Acc# |
|---|---|---|
| | sp:EXUT_ECOLI | P42609 |

Description

HEXURONATE TRANSPORTER

| ORF Name | NTID | AAID | NT Length | AA Length | Score | Probability |
|---|---|---|---|---|---|---|
| 9954806_f1_3 | 819 | 6041 | 820 | 2463 | 1419 | 3.8e−145 |

| Protein name | Locus Name | Acc# |
|---|---|---|
| beta-xylo-glucosidase | gp:TBZ56279 | Z56279 |

Description

*T. brockii* cglF, cglG, xglS and cglT genes.

| ORF Name | NTID | AAID | NT Length | AA Length | Score | Probability |
|---|---|---|---|---|---|---|
| 33212528_c3_11 | 820 | 6042 | 554 | 1662 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 7119532_f3_6 | 821 | 6043 | 71 | 216 | 53 | 0.017 |

| Protein name | Locus Name | Acc# |
|---|---|---|
| | sp:GP38_CANFA | Q95152 |

Description

GLYCOPROTEIN 38 PRECURSOR (GP38) (MUCIN-TYPE MEMBRANE PROTEIN GP40)

-continued

| ORF Name | NTID | AAID | NT Length | AA Length | Score | Probability |
|---|---|---|---|---|---|---|
| 10007303_f1_21 | 822 | 6044 | 177 | 534 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 10189501_f3_191 | 823 | 6045 | 81 | 246 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 10314088_f1_46 | 824 | 6046 | 384 | 1155 | 631 | 1.2e−61 |

| Protein name | | | Locus Name | | | Acc# |
|---|---|---|---|---|---|---|
| | | | sp:DINP_ECOLI | | | |

Description

DNA-DAMAGE-INDUCIBLE PROTEIN P

| ORF Name | NTID | AAID | NT Length | AA Length | Score | Probability |
|---|---|---|---|---|---|---|
| 10548816_f1_86 | 825 | 6047 | 62 | 189 | 102 | 1.4e−05 |

| Protein name | | | Locus Name | | | Acc# |
|---|---|---|---|---|---|---|
| hypothetical protein APE2457 | | | pir:H72476 | | | H72476 |

Description

| ORF Name | NTID | AAID | NT Length | AA Length | Score | Probability |
|---|---|---|---|---|---|---|
| 1072177_c2_422 | 826 | 6048 | 1110 | 3333 | 671 | 3.2e−184 |

| Protein name | | | Locus Name | | | Acc# |
|---|---|---|---|---|---|---|
| | | | sp:SECA_RHOCA | | | P52966 |

Description

PREPROTEIN TRANSLOCASE SECA SUBUNIT

| ORF Name | NTID | AAID | NT Length | AA Length | Score | Probability |
|---|---|---|---|---|---|---|
| 11147938_f2_90 | 827 | 6049 | 401 | 1206 | 295 | 9.2e−25 |

| Protein name | | | Locus Name | | | Acc# |
|---|---|---|---|---|---|---|
| 115K outer membrane protein precursor:SusC protein | | | pir:JC6027 | | | JC6027 |

Description

-continued

| ORF Name | NTID | AAID | NT Length | AA Length | Score | Probability |
|---|---|---|---|---|---|---|
| 1173557_c1_261 | 828 | 6050 | 349 | 1050 | 483 | 5.8e−46 |

| Protein name | Locus Name | Acc# |
|---|---|---|
| | sp:APBE_HAEIN | P44550 |

Description

THIAMINE BIOSYNTHESIS LIPOPROTEIN APBE PRECURSOR

| ORF Name | NTID | AAID | NT Length | AA Length | Score | Probability |
|---|---|---|---|---|---|---|
| 1180302_f2_93 | 829 | 6051 | 542 | 1629 | 256 | 1.3e−40 |

| Protein name | Locus Name | Acc# |
|---|---|---|
| | sp:STS_RAT | P15589 |

Description

SULFATE SULFOHYDROLASE) (ARYLSULFATASE C) (ASC)

| ORF Name | NTID | AAID | NT Length | AA Length | Score | Probability |
|---|---|---|---|---|---|---|
| 1208392_c2_362 | 830 | 6052 | 541 | 1626 | 396 | 9.6e−37 |

| Protein name | Locus Name | Acc# |
|---|---|---|
| | sp:RLUA_ECOLI | P39219 |

Description (PSEUDOURIDYLATE SYNTHASE) (URACIL HYDROLYASE)

| ORF Name | NTID | AAID | NT Length | AA Length | Score | Probability |
|---|---|---|---|---|---|---|
| 128775_f1_51 | 831 | 6053 | 166 | 501 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 12897563_c3_443 | 832 | 6054 | 307 | 924 | 488 | 1.7e−46 |

| Protein name | Locus Name | Acc# |
|---|---|---|
| oxidoreductase, short chain dehydrogenase/reductase family | pir:E72427 | E72427 |

Description

| ORF Name | NTID | AAID | NT Length | AA Length | Score | Probability |
|---|---|---|---|---|---|---|
| 130001_c3_460 | 833 | 6055 | 540 | 1623 | 383 | 2.1e−72 |

| Protein name | Locus Name | Acc# |
|---|---|---|
| | sp:YFCC_ECOLI | |

Description

HYPOTHETICAL 54.8 KD PROTEIN IN PTA-FOLX INTERGENIC REGION

-continued

| ORF Name | NTID | AAID | NT Length | AA Length | Score | Probability |
|---|---|---|---|---|---|---|
| 13881262_f2_105 | 834 | 6056 | 445 | 1338 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 14331502_f3_177 | 835 | 6057 | 166 | 501 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 14703962_c1_334 | 836 | 6058 | 396 | 1191 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 14723751_c2_360 | 837 | 6059 | 673 | 2022 | 778 | 1.1e−79 |

| Protein name | | | | Locus Name | | Acc# |
|---|---|---|---|---|---|---|
| type III DNA modification enzyme (methyltransferase) | | | | pir:F71810 | | F71810 |

Description

| ORF Name | NTID | AAID | NT Length | AA Length | Score | Probability |
|---|---|---|---|---|---|---|
| 14876578_f1_37 | 838 | 6060 | 296 | 891 | 310 | 1.2e−27 |

| Protein name | | | | Locus Name | | Acc# |
|---|---|---|---|---|---|---|
| probable beta-glycosyltransferase trsC | | | | pir:S51262 | | |

Description

| ORF Name | NTID | AAID | NT Length | AA Length | Score | Probability |
|---|---|---|---|---|---|---|
| 15054691_c1_330 | 839 | 6061 | 430 | 1293 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 156642_c3_469 | 840 | 6062 | 133 | 402 | | |

| Protein name | | | | Locus Name | | Acc# |
|---|---|---|---|---|---|---|

Description

NO-HIT

-continued

| ORF Name | NTID | AAID | NT Length | AA Length | Score | Probability |
|---|---|---|---|---|---|---|
| 15902_f2_153 | 841 | 6063 | 264 | 795 | 316 | 2.9e−28 |

| Protein name | Locus Name | Acc# |
|---|---|---|
| | sp:YDAO_ECOLI | |

Description

HYPOTHETICAL 35.6 KD PROTEIN IN DBPA-INTR INTERGENIC REGION

| ORF Name | NTID | AAID | NT Length | AA Length | Score | Probability |
|---|---|---|---|---|---|---|
| 163515_c3_466 | 842 | 6064 | 62 | 189 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 16828575_f1_43 | 843 | 6065 | 388 | 1167 | 790 | 1.6e−80 |

| Protein name | Locus Name | Acc# |
|---|---|---|
| GTP-binding protein | gp:AF019407 | AF019407 |

Description

*Caulobacter crescentus* GTP-binding protein (cgtA) gene, complete cds.

| ORF Name | NTID | AAID | NT Length | AA Length | Score | Probability |
|---|---|---|---|---|---|---|
| 16829461_f2_112 | 844 | 6066 | 119 | 360 | 108 | 3.2e−06 |

| Protein name | Locus Name | Acc# |
|---|---|---|
| hypothetical protein PH0360 | pir:E71143 | E71143 |

Description

| ORF Name | NTID | AAID | NT Length | AA Length | Score | Probability |
|---|---|---|---|---|---|---|
| 16832885_f2_159 | 845 | 6067 | 431 | 1296 | 1723 | 2.3e−177 |

| Protein name | Locus Name | Acc# |
|---|---|---|
| hypothetical protein | pir:JQ1020 | JQ1020 |

Description

| ORF Name | NTID | AAID | NT Length | AA Length | Score | Probability |
|---|---|---|---|---|---|---|
| 19703461_c1_311 | 846 | 6068 | 481 | 1446 | 1581 | 2.6e−162 |

| Protein name | Locus Name | Acc# |
|---|---|---|
| unknown | gp:AF048749 | AF048749 |

Description

*Bacteroides fragilis* capsular polysaccharide biosynthesis operon, complete sequence.

-continued

| ORF Name | NTID | AAID | NT Length | AA Length | Score | Probability |
|---|---|---|---|---|---|---|
| 19725250_c2_343 | 847 | 6069 | 202 | 609 | 327 | 2.0e−29 |

| Protein name | | | | Locus Name | | Acc# |
|---|---|---|---|---|---|---|
| | | | | sp:YI12_METTH | | O27840 |

Description

HYPOTHETICAL PROTEIN MTH1812

| ORF Name | NTID | AAID | NT Length | AA Length | Score | Probability |
|---|---|---|---|---|---|---|
| 19797162_f2_119 | 848 | 6070 | 357 | 1074 | 1095 | 8.1e−111 |

| Protein name | | | | Locus Name | | Acc# |
|---|---|---|---|---|---|---|
| nucleotide sugar epimerase | | | | gp:AF059755 | | AF059755 |

Description

*Vibrio vulnificus* nucleotide sugar epimerase gene, complete cds.

| ORF Name | NTID | AAID | NT Length | AA Length | Score | Probability |
|---|---|---|---|---|---|---|
| 1992187_f3_212 | 849 | 6071 | 355 | 1068 | 193 | 8.7e−15 |

| Protein name | | | | Locus Name | | Acc# |
|---|---|---|---|---|---|---|
| lumQ protein:protein slr1213:protein slr1213 | | | | pir:S77548 | | S77548 |

Description

| ORF Name | NTID | AAID | NT Length | AA Length | Score | Probability |
|---|---|---|---|---|---|---|
| 20050402_f3_253 | 850 | 6072 | 163 | 492 | 129 | 1.8e−07 |

| Protein name | | | | Locus Name | | Acc# |
|---|---|---|---|---|---|---|
| phosphopyruvate hydratase | | | | pir:C75251 | | C75251 |

Description

| ORF Name | NTID | AAID | NT Length | AA Length | Score | Probability |
|---|---|---|---|---|---|---|
| 20087751_f3_199 | 851 | 6073 | 319 | 960 | 1657 | 2.3e−170 |

| Protein name | | | | Locus Name | | Acc# |
|---|---|---|---|---|---|---|
| putative UDP-GlcNAc:undecaprenylphosphate | | | | gp:AF048749 | | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 2037502_f1_17 | 852 | 6074 | 256 | 771 | 245 | 9.6e−21 |

| Protein name | | | | Locus Name | | Acc# |
|---|---|---|---|---|---|---|
| conserved hypothetical protein | | | | pir:D72320 | | D72320 |

Description

| ORF Name | NTID | AAID | NT Length | AA Length | Score | Probability |
|---|---|---|---|---|---|---|
| 20734625_f3_208 | 853 | 6075 | 223 | 672 | 225 | 1.3e−18 |

| Protein name | Locus Name | Acc# |
|---|---|---|
| hypothetical protein | gp:SSU18930 | Y18930 |

Description

*Sulfolobus solfataricus* 281 kb genomic DNA fragment, strain P2.

| ORF Name | NTID | AAID | NT Length | AA Length | Score | Probability |
|---|---|---|---|---|---|---|
| 20754427_f3_198 | 854 | 6076 | 347 | 1044 | 1691 | 5.7e−174 |

| Protein name | Locus Name | Acc# |
|---|---|---|
| UDP-glucose-4-epimerase/dTDP-glucose-4,6 | gp:AF048749 | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 211510_f1_57 | 855 | 6077 | 342 | 1029 | 307 | 2.6e−27 |

| Protein name | Locus Name | Acc# |
|---|---|---|
| activator protein | gp:AF047527 | AF047527 |

Description

*Pseudomonas fluorescens* activator protein (mtlR) gene, complete cds.

| ORF Name | NTID | AAID | NT Length | AA Length | Score | Probability |
|---|---|---|---|---|---|---|
| 21640887_f2_117 | 856 | 6078 | 362 | 1089 | 157 | 1.7e−08 |

| Protein name | Locus Name | Acc# |
|---|---|---|
| hypothetical protein 7.17 | pir:D47677 | |

Description

| ORF Name | NTID | AAID | NT Length | AA Length | Score | Probability |
|---|---|---|---|---|---|---|
| 21681552_c3_442 | 857 | 6079 | 466 | 1401 | 793 | 8.2e−79 |

| Protein name | Locus Name | Acc# |
|---|---|---|
| thiophene and furan oxidation protein | pir:C70375 | C70375 |

Description

| ORF Name | NTID | AAID | NT Length | AA Length | Score | Probability |
|---|---|---|---|---|---|---|
| 22536527_f3_190 | 858 | 6080 | 215 | 648 | 1136 | 3.7e−115 |

| Protein name | Locus Name | Acc# |
|---|---|---|
| putative methyl transferase | gp:AF048749 | AF048749 |

Description

*Bacteroides fragilis* capsular polysaccharide biosynthesis operon, complete sequence.

-continued

| ORF Name | NTID | AAID | NT Length | AA Length | Score | Probability |
|---|---|---|---|---|---|---|
| 22540937_f1_4 | 859 | 6081 | 522 | 1569 | 304 | 1.1e−45 |

| Protein name | Locus Name | Acc# |
|---|---|---|
| | sp:STS_HUMAN | P08842 |

Description

SULFATE SULFOHYDROLASE) ARYLSULFATASE C) (ASC)

| ORF Name | NTID | AAID | NT Length | AA Length | Score | Probability |
|---|---|---|---|---|---|---|
| 22860128_f3_255 | 860 | 6082 | 83 | 252 | 64 | 0.031 |

| Protein name | Locus Name | Acc# |
|---|---|---|
| | sp:SPRC_XENLA | P36378 |

Description (OSTEONECTIN) (ON) (BASEMENT MEMBRANE PROTEIN BM-40)

| ORF Name | NTID | AAID | NT Length | AA Length | Score | Probability |
|---|---|---|---|---|---|---|
| 23472533_f3_254 | 861 | 6083 | 124 | 375 | 132 | 8.7e−08 |

| Protein name | Locus Name | Acc# |
|---|---|---|
| phosphopyruvate hydratase | pir:C75251 | C75251 |

Description

| ORF Name | NTID | AAID | NT Length | AA Length | Score | Probability |
|---|---|---|---|---|---|---|
| 23479066_c3_434 | 862 | 6084 | 183 | 552 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 23647758_c2_399 | 863 | 6085 | 81 | 246 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 23709625_c3_433 | 864 | 6086 | 321 | 966 | 627 | 3.2e−61 |

| Protein name | Locus Name | Acc# |
|---|---|---|
| dolichol-phosphate mannosyltransferase | pir:G70463 | G70463 |

Description

-continued

| ORF Name | NTID | AAID | NT Length | AA Length | Score | Probability |
|---|---|---|---|---|---|---|
| 24064142__f2__148 | 865 | 6087 | 265 | 798 | 362 | 3.8e−33 |

| Protein name | Locus Name | Acc# |
|---|---|---|
| hypothetical protein ywnB | pir:E70063 | E70063 |

Description

| ORF Name | NTID | AAID | NT Length | AA Length | Score | Probability |
|---|---|---|---|---|---|---|
| 24114142__c2__373 | 866 | 6088 | 291 | 876 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24229677__c2__340 | 867 | 6089 | 238 | 717 | 280 | 1.9e−24 |

| Protein name | Locus Name | Acc# |
|---|---|---|
| hypothetical protein yisX | pir:G69838 | G69838 |

Description

| ORF Name | NTID | AAID | NT Length | AA Length | Score | Probability |
|---|---|---|---|---|---|---|
| 24245437__c2__423 | 868 | 6090 | 153 | 462 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24257187__f2__132 | 869 | 6091 | 411 | 1236 | 1104 | 9.0e−112 |

| Protein name | Locus Name | Acc# |
|---|---|---|
| putative carboxybiotin decarboxylase subunit of | gp:MRU87980 | U87980 |

Description

*Malonomonas rubra* putative IS-element gene, partial cds, and malonate decarboxylase gene cluster (madY, madZ, madG, madB, madA, madE, madC, madD, madH, madK, madF, madL, madM, madN) genes, complete cds.

| ORF Name | NTID | AAID | NT Length | AA Length | Score | Probability |
|---|---|---|---|---|---|---|
| 24401507__c1__299 | 870 | 6092 | 510 | 1533 | 2702 | 4.2e−281 |

| Protein name | Locus Name | Acc# |
|---|---|---|
| unknown | gp:AF048749 | AF048749 |

Description

*Bacteroides fragilis* capsular polysaccharide biosynthesis operon, complete sequence.

-continued

| ORF Name | NTID | AAID | NT Length | AA Length | Score | Probability |
|---|---|---|---|---|---|---|
| 24473192_c2_372 | 871 | 6093 | 642 | 1929 | 110 | 0.0037 |

| Protein name | Locus Name | Acc# |
|---|---|---|
| | sp:Y0BW_MYCLE | Q49757 |

Description

HYPOTHETICAL 31.1 KD PROTEIN B1937_F2_39

| ORF Name | NTID | AAID | NT Length | AA Length | Score | Probability |
|---|---|---|---|---|---|---|
| 24473817_f2_106 | 872 | 6094 | 431 | 1296 | 457 | 3.3e−43 |

| Protein name | Locus Name | Acc# |
|---|---|---|
| putative hemolysin | gp:AF051356 | AF051356 |

Description

*Streptococcus mutans* YtqB (ytqB) gene, partial cds; ABC transporter (abcX), putative permease (perM), putative hemolysin (hlyX), pyruvate−formate lyase activating enzyme (pflC), D-alanine−D-alanylcarrier protein ligase (dltA), integral membrane protein (dltB), D-alanyl carrier protein (dltC), extramembranal protein (dltD), and putative exopolyphosphatase (ppxl) genes,

| ORF Name | NTID | AAID | NT Length | AA Length | Score | Probability |
|---|---|---|---|---|---|---|
| 24495337_c2_345 | 873 | 6095 | 499 | 1500 | 119 | 0.00014 |

| Protein name | Locus Name | Acc# |
|---|---|---|
| immunogenic 75 kDa protein PG4 | gp:AF145800 | AF145800 |

Description

*Porphyromonas gingivalis* strain W50 immunogenic 75 kDa protein PG4 gene, complete cds.

| ORF Name | NTID | AAID | NT Length | AA Length | Score | Probability |
|---|---|---|---|---|---|---|
| 24631305_f2_116 | 874 | 6096 | 183 | 552 | 575 | 1.0e−55 |

| Protein name | Locus Name | Acc# |
|---|---|---|
| unknown | gp:AF048749 | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 24647763_c1_275 | 875 | 6097 | 498 | 1497 | 685 | 2.3e−67 |

| Protein name | Locus Name | Acc# |
|---|---|---|
| | sp:RIBB_ECOLI | P24199 |

Description 3,4-DIHYDROXY-2-BUTANONE 4-PHOSPHATE SYNTHASE (DHBP SYNTHASE)

-continued

| ORF Name | NTID | AAID | NT Length | AA Length | Score | Probability |
|---|---|---|---|---|---|---|
| 24651515_f2_91 | 876 | 6098 | 108 | 327 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 24666000_c3_437 | 877 | 6099 | 306 | 921 | 150 | 4.1e−16 |
| Protein name | | | Locus Name | | | Acc# |
| probable uridine phosphorylase APE2105 | | | pir:D72516 | | | D72516 |
| Description | | | | | | |

| ORF Name | NTID | AAID | NT Length | AA Length | Score | Probability |
|---|---|---|---|---|---|---|
| 24804663_f3_195 | 878 | 6100 | 386 | 1161 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 25972937_c3_459 | 879 | 6101 | 69 | 210 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 26212777_c3_450 | 880 | 6102 | 300 | 903 | 215 | 1.4e−17 |
| Protein name | | | Locus Name | | | Acc# |
| hypothetical protein sll1671 | | | pir:S74655 | | | S74655 |
| Description | | | | | | |

| ORF Name | NTID | AAID | NT Length | AA Length | Score | Probability |
|---|---|---|---|---|---|---|
| 26261313_f1_58 | 881 | 6103 | 63 | 192 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 26444687_c2_341 | 882 | 6104 | 434 | 1305 | 1588 | 4.6e−163 |
| Protein name | | | Locus Name | | | Acc# |
| | | | sp:ENO_STAAU | | | O69174 |
| Description | | | | | | |
| GLYCERATE HYDRO-LYASE) (LAMININ BINDING PROTEIN) | | | | | | |

-continued

| ORF Name | NTID | AAID | NT Length | AA Length | Score | Probability |
|---|---|---|---|---|---|---|
| 26594206_f1_42 | 883 | 6105 | 180 | 543 | 896 | 9.9e−90 |

| Protein name | Locus Name | Acc# |
|---|---|---|
| putative hypoxanthine guanine | gp:AF048749 | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 26594686_c2_346 | 884 | 6106 | 158 | 477 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 26595337_f3_180 | 885 | 6107 | 175 | 528 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 26664012_c2_404 | 886 | 6108 | 355 | 1068 | 112 | 0.0032 |

| Protein name | Locus Name | Acc# |
|---|---|---|
| gamma response I protein | gp:ATH131708 | AJ131708 |

Description

*Arabidopsis thaliana* gr I gene, exons 1-3.

| ORF Name | NTID | AAID | NT Length | AA Length | Score | Probability |
|---|---|---|---|---|---|---|
| 26761057_c2_361 | 887 | 6109 | 1017 | 3054 | 627 | 1.0e−119 |

| Protein name | Locus Name | Acc# |
|---|---|---|
| restriction endonuclease | gp:AF060119 | AF060119 |

Description

*Pasteurella haemolytica* methyltransferase (mod) and restriction endonuclease (res) genes, complete cds.

| ORF Name | NTID | AAID | NT Length | AA Length | Score | Probability |
|---|---|---|---|---|---|---|
| 26836680_f2_109 | 888 | 6110 | 416 | 1251 | 1189 | 8.9e−121 |

| Protein name | Locus Name | Acc# |
|---|---|---|
| immunoreactive 47 kD antigen PG120 | gp:AF144640 | AF144640 |

Description

*Porphyromonas gingivalis* strain W50 immunoreactive 47 kD antigen PG120 gene, complete cds.

-continued

| ORF Name | NTID | AAID | NT Length | AA Length | Score | Probability |
|---|---|---|---|---|---|---|
| 275125_f2_111 | 889 | 6111 | 469 | 1410 | 111 | 2.7e−06 |

| Protein name | Locus Name | Acc# |
|---|---|---|
| hypothetical protein Rv2333c | pir:F70705 | F70705 |

Description

| ORF Name | NTID | AAID | NT Length | AA Length | Score | Probability |
|---|---|---|---|---|---|---|
| 2812827_f3_207 | 890 | 6112 | 270 | 813 | 298 | 2.3e−26 |

| Protein name | Locus Name | Acc# |
|---|---|---|
| | sp:YFIH_HAEIN | P44552 |

Description

HYPOTHETICAL PROTEIN HI0175

| ORF Name | NTID | AAID | NT Length | AA Length | Score | Probability |
|---|---|---|---|---|---|---|
| 29336040_f1_36 | 891 | 6113 | 420 | 1263 | 144 | 7.9e−07 |

| Protein name | Locus Name | Acc# |
|---|---|---|
| NADH dehydrogenase (ubiquinone), chain 2 | pir:T11319 | T11319 |

Description

| ORF Name | NTID | AAID | NT Length | AA Length | Score | Probability |
|---|---|---|---|---|---|---|
| 29703165_f2_118 | 892 | 6114 | 396 | 1191 | 369 | 6.9e−34 |

| Protein name | Locus Name | Acc# |
|---|---|---|
| | sp:CAPA_BACAN | P19579 |

Description

CAPA PROTEIN

| ORF Name | NTID | AAID | NT Length | AA Length | Score | Probability |
|---|---|---|---|---|---|---|
| 30084688_f2_127 | 893 | 6115 | 60 | 183 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 3023452_c3_522 | 894 | 6116 | 524 | 1575 | 572 | 2.1e−55 |

| Protein name | Locus Name | Acc# |
|---|---|---|
| alkaline phosphatase | gp:SSPPHOA2 | Z48801 |

Description

*Synechococcus* PCC7942 phoV gene for alkaline phosphatase.

-continued

| ORF Name | NTID | AAID | NT Length | AA Length | Score | Probability |
|---|---|---|---|---|---|---|
| 31330037_c2_347 | 895 | 6117 | 182 | 549 | 204 | 6.9e−15 |

| Protein name | Locus Name | Acc# |
|---|---|---|
| DNA polymerase III, alpha subunit | pir:C72360 | C72360 |

Description

| ORF Name | NTID | AAID | NT Length | AA Length | Score | Probability |
|---|---|---|---|---|---|---|
| 3240675_f3_182 | 896 | 6118 | 135 | 408 | 115 | 7.2e−07 |

| Protein name | Locus Name | Acc# |
|---|---|---|
| protein-export membrane protein | pir:E71837 | E71837 |

Description

| ORF Name | NTID | AAID | NT Length | AA Length | Score | Probability |
|---|---|---|---|---|---|---|
| 33301250_c2_380 | 897 | 6119 | 421 | 1266 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 33397811_f1_45 | 898 | 6120 | 898 | 2697 | 115 | 0.00042 |

| Protein name | Locus Name | Acc# |
|---|---|---|
| histidine kinase sensor protein | pir:D70328 | D70328 |

Description

| ORF Name | NTID | AAID | NT Length | AA Length | Score | Probability |
|---|---|---|---|---|---|---|
| 33489041_f2_110 | 899 | 6121 | 260 | 783 | 94 | 0.045 |

| Protein name | Locus Name | Acc# |
|---|---|---|
| | sp:TPMN_XENLA | Q01174 |

Description

TROPOMYOSIN ALPHA CHAIN, NON MUSCLE

| ORF Name | NTID | AAID | NT Length | AA Length | Score | Probability |
|---|---|---|---|---|---|---|
| 33881887_f3_192 | 900 | 6122 | 83 | 252 | 69 | 0.042 |

| Protein name | Locus Name | Acc# |
|---|---|---|
| | sp:YA49_HAEIN | |

Description

HYPOTHETICAL PROTEIN HI1049

-continued

| ORF Name | NTID | AAID | NT Length | AA Length | Score | Probability |
|---|---|---|---|---|---|---|
| 34189385_f1_38 | 901 | 6123 | 311 | 936 | 514 | 3.0e−49 |
| Protein name | | | Locus Name | | | Acc# |
| | | | gp:BCY11138 | | | Y11138 |

Description

*B. cereus* DNA for ORF1, ORF2 and ORF3 (2402 bp).

| ORF Name | NTID | AAID | NT Length | AA Length | Score | Probability |
|---|---|---|---|---|---|---|
| 34407193_f1_47 | 902 | 6124 | 144 | 435 | | |
| Protein name | | | Locus Name | | | Acc# |

Description

NO-HIT

| ORF Name | NTID | AAID | NT Length | AA Length | Score | Probability |
|---|---|---|---|---|---|---|
| 34412513_f3_194 | 903 | 6125 | 303 | 912 | 193 | 1.4e−14 |
| Protein name | | | Locus Name | | | Acc# |
| glycosyl transferase PAB0772 | | | pir:B75096 | | | B75096 |

Description

| ORF Name | NTID | AAID | NT Length | AA Length | Score | Probability |
|---|---|---|---|---|---|---|
| 34640915_f1_53 | 904 | 6126 | 63 | 192 | | |
| Protein name | | | Locus Name | | | Acc# |

Description

NO-HIT

| ORF Name | NTID | AAID | NT Length | AA Length | Score | Probability |
|---|---|---|---|---|---|---|
| 34650341_f3_230 | 905 | 6127 | 79 | 240 | | |
| Protein name | | | Locus Name | | | Acc# |

Description

NO-HIT

| ORF Name | NTID | AAID | NT Length | AA Length | Score | Probability |
|---|---|---|---|---|---|---|
| 34652167_f2_108 | 906 | 6128 | 375 | 1128 | 530 | 6.0e−51 |
| Protein name | | | Locus Name | | | Acc# |
| pyridoxal phosphate biosynthetic protein PdxA | | | pir:H70373 | | | H70373 |

Description

| ORF Name | NTID | AAID | NT Length | AA Length | Score | Probability |
|---|---|---|---|---|---|---|
| 34666452_f3_224 | 907 | 6129 | 172 | 519 | | |
| Protein name | | | Locus Name | | | Acc# |

Description

NO-HIT

-continued

| ORF Name | NTID | AAID | NT Length | AA Length | Score | Probability |
|---|---|---|---|---|---|---|
| 36134637_f3_249 | 908 | 6130 | 123 | 372 | 221 | 3.3e−18 |

| Protein name | Locus Name | Acc# |
|---|---|---|
| hypothetical protein | pir:H75473 | H75473 |

Description

| ORF Name | NTID | AAID | NT Length | AA Length | Score | Probability |
|---|---|---|---|---|---|---|
| 3944005_f1_39 | 909 | 6131 | 440 | 1323 | 1205 | 1.8e−122 |

| Protein name | Locus Name | Acc# |
|---|---|---|
| putative UDP-glucose dehydrogenase | gp:AF159428 | AF159428 |

Description

*Burkholderia pseudomallei* putative UDP-glucose dehydrogenase (udg), putative ADP-heptose synthase (waaE), and putative ADP-glycero-mannoheptose epimerase (gmhD) genes, complete cds.

| ORF Name | NTID | AAID | NT Length | AA Length | Score | Probability |
|---|---|---|---|---|---|---|
| 3988318_c2_384 | 910 | 6132 | 699 | 2100 | 3614 | 0.0 |

| Protein name | Locus Name | Acc# |
|---|---|---|
| putative TonB-dependent outer membrane receptor | gp:AF048749 | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 3990900_f3_193 | 911 | 6133 | 392 | 1179 | 272 | 1.3e−31 |

| Protein name | Locus Name | Acc# |
|---|---|---|
| probable galactosyltransferase trsD | pir:S51263 | |

Description

| ORF Name | NTID | AAID | NT Length | AA Length | Score | Probability |
|---|---|---|---|---|---|---|
| 4065757_c1_259 | 912 | 6134 | 262 | 789 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4094512_c3_436 | 913 | 6135 | 344 | 1035 | 1054 | 1.8e−106 |

| Protein name | Locus Name | Acc# |
|---|---|---|
| | sp:YQFA_BACSU | P54466 |

Description

HYPOTHETICAL 35.6 KD PROTEIN IN RPSU-PHOH INTEREGENIC REGION

-continued

| ORF Name | NTID | AAID | NT Length | AA Length | Score | Probability |
|---|---|---|---|---|---|---|
| 4116680_f3_175 | 914 | 6136 | 245 | 738 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4119677_f2_125 | 915 | 6137 | 248 | 747 | 198 | 1.2e−15 |

| Protein name | Locus Name | Acc# |
|---|---|---|
| hypothetical protein jhp1456 | pir:C71806 | C71806 |

Description

| ORF Name | NTID | AAID | NT Length | AA Length | Score | Probability |
|---|---|---|---|---|---|---|
| 4147280_c2_374 | 916 | 6138 | 67 | 204 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 425010_f3_196 | 917 | 6139 | 385 | 1158 | 642 | 8.2e−63 |

| Protein name | Locus Name | Acc# |
|---|---|---|
| WbpU | gp:AF035937 | AF035937 |

Description

*Pseudomonas aeruginosa* strain IATS O6 RpsA (rpsA) gene, partial cds; Ihf-Beta, Wzz (wzz), and Wzx (wzx) genes, complete cds; and wbp gene cluster for O-antigen biosynthesis, complete sequence.

| ORF Name | NTID | AAID | NT Length | AA Length | Score | Probability |
|---|---|---|---|---|---|---|
| 427215_f3_162 | 918 | 6140 | 473 | 1422 | 143 | 1.6e−06 |

| Protein name | Locus Name | Acc# |
|---|---|---|
| unknown | gp:U96771 | U96771 |

Description

*Prevotella bryantii* putative polygalacturonase, B-1,4-endoglucanse, and mannanase genes, complete cds; and unknown genes.

| ORF Name | NTID | AAID | NT Length | AA Length | Score | Probability |
|---|---|---|---|---|---|---|
| 4323262_c1_273 | 919 | 6141 | 955 | 2868 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 4331300_c2_390 | 920 | 6142 | 82 | 249 | 103 | 1.1e−05 |

| Protein name | Locus Name | Acc# |
|---|---|---|
| hypothetical protein | gp:SSU18930 | Y18930 |

Description

*Sulfolobus solfataricus* 281 kb genomic DNA fragment, strain P2.

| ORF Name | NTID | AAID | NT Length | AA Length | Score | Probability |
|---|---|---|---|---|---|---|
| 4409462_c2_403 | 921 | 6143 | 506 | 1521 | 631 | 1.2e−61 |

| Protein name | Locus Name | Acc# |
|---|---|---|
| conserved hypothetical protein aq_1365 | pir:F70418 | F70418 |

Description

| ORF Name | NTID | AAID | NT Length | AA Length | Score | Probability |
|---|---|---|---|---|---|---|
| 4694152_f2_107 | 922 | 6144 | 717 | 2154 | 122 | 0.00078 |

| Protein name | Locus Name | Acc# |
|---|---|---|
| putative peptidyl-prolyl cis-trans isomerase | gp:ASAJ2316 | AJ002316 |

Description

*Acinetobacter* sp. ADP1 alkR & alkM genes, ORF1 & ORF4.

| ORF Name | NTID | AAID | NT Length | AA Length | Score | Probability |
|---|---|---|---|---|---|---|
| 4725257_f2_104 | 923 | 6145 | 427 | 1284 | 89 | 0.011 |

| Protein name | Locus Name | Acc# |
|---|---|---|
| membrane protein | gp:PPUY18245 | Y18245 |

Description

*Pseudomonas putida* todX, todF, todC1, todC2, todB, todA, todD, todE, todG, todI, todH, todS, todT genes.

| ORF Name | NTID | AAID | NT Length | AA Length | Score | Probability |
|---|---|---|---|---|---|---|
| 4804632_c3_476 | 924 | 6146 | 218 | 657 | 1119 | 2.3-113 |

| Protein name | Locus Name | Acc# |
|---|---|---|
| unknown | gp:AF048749 | AF048749 |

Description

*Bacteroides fragilis* capsular polysaccharide biosynthesis operon, complete sequence.

-continued

| ORF Name | NTID | AAID | NT Length | AA Length | Score | Probability |
|---|---|---|---|---|---|---|
| 5110700_f1_35 | 925 | 6147 | 485 | 1458 | 780 | 1.9e-77 |

| Protein name | Locus Name | Acc# |
|---|---|---|
| O-antigen repeat unit transporter Wzx | gp:AF172324 | AF172324 |

Description

*Escherichia coli* GalF (galF) gene, partial cds; O-antigen repeat unit transporter Wzx (wzx), WbnA (wbnA), O-antigen polymerase Wzy (wzy), WbnB (wbnB), WbnC (wbnC), WbnD (wbnD), WbnE (wbnE), UDP-Glc-4-epimerase GalE (galE), 6-phosphogluconate dehydrogenase Gnd (gnd), UDP-Glc-6-dehydrogenase Ugd (ugd), and WbnF (wbnF) genes, complete cds; and chain length determinant

| ORF Name | NTID | AAID | NT Length | AA Length | Score | Probability |
|---|---|---|---|---|---|---|
| 5270252_f2_124 | 926 | 6148 | 192 | 579 | 335 | 3.4e-40 |

| Protein name | Locus Name | Acc# |
|---|---|---|
|  | gp:AB017508 | AB017508 |

Description

*Bacillus halodurans* C-125 genomic DNA, 32 kb fragment, complete cds.

| ORF Name | NTID | AAID | NT Length | AA Length | Score | Probability |
|---|---|---|---|---|---|---|
| 5313775_f1_34 | 927 | 6149 | 157 | 474 | 614 | 7.6e-60 |

| Protein name | Locus Name | Acc# |
|---|---|---|
| unknown | gp:AF048749 | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 5531212_f3_241 | 928 | 6150 | 654 | 1965 | 485 | 6.4e-45 |

| Protein name | Locus Name | Acc# |
|---|---|---|
| sensory transduction histidine kinase slr2098:protein slr2098:protein slr2098 | pir:S75130 | S75130 |

Description

| ORF Name | NTID | AAID | NT Length | AA Length | Score | Probability |
|---|---|---|---|---|---|---|
| 657956_c1_258 | 929 | 6151 | 210 | 633 |  |  |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 6671887_f3_238 | 930 | 6152 | 1294 | 3885 | 384 | 6.5e−33 |
| Protein name | | | | Locus Name | | Acc# |
| putative alpha-glucosidase | | | | gp:AAC252161 | | AJ252161 |

Description

*Alicyclobacillus acidocaldarius* maltose/maltodextrine transport gene region (malEFGR genes, cdaA gene and glcA gene).

| ORF Name | NTID | AAID | NT Length | AA Length | Score | Probability |
|---|---|---|---|---|---|---|
| 6687552_f1_19 | 931 | 6153 | 349 | 1050 | 602 | 1.4e−58 |
| Protein name | | | | Locus Name | | Acc# |
| | | | | sp:YFGB_ECOLI | | P36979 |

Description

HYPOTHETICAL 43.1 KD PROTEIN IN NDK-GCPE INTERGENIC REGION

| ORF Name | NTID | AAID | NT Length | AA Length | Score | Probability |
|---|---|---|---|---|---|---|
| 6767537_f1_13 | 932 | 6154 | 75 | 228 | | |
| Protein name | | | | Locus Name | | Acc# |

Description

NO-HIT

| ORF Name | NTID | AAID | NT Length | AA Length | Score | Probability |
|---|---|---|---|---|---|---|
| 6854762_c3_470 | 933 | 6155 | 68 | 207 | | |
| Protein name | | | | Locus Name | | Acc# |

Description

NO-HIT

| ORF Name | NTID | AAID | NT Length | AA Length | Score | Probability |
|---|---|---|---|---|---|---|
| 7225916_f1_83 | 934 | 6156 | 65 | 198 | | |
| Protein name | | | | Locus Name | | Acc# |

Description

NO-HIT

| ORF Name | NTID | AAID | NT Length | AA Length | Score | Probability |
|---|---|---|---|---|---|---|
| 796875_f2_158 | 935 | 6157 | 60 | 183 | | |
| Protein name | | | | Locus Name | | Acc# |

Description

NO-HIT

-continued

| ORF Name | NTID | AAID | NT Length | AA Length | Score | Probability |
|---|---|---|---|---|---|---|
| 961067_c3_479 | 936 | 6158 | 63 | 192 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 9813_c3_473 | 937 | 6159 | 65 | 198 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 9921927_c1_288 | 938 | 6160 | 419 | 1260 | 568 | 5.7e−55 |

| Protein name | | | | Locus Name | | Acc# |
|---|---|---|---|---|---|---|
| conserved hypothetical protein ykgB | | | | pir:D69856 | | D69856 |

Description

| ORF Name | NTID | AAID | NT Length | AA Length | Score | Probability |
|---|---|---|---|---|---|---|
| 10009632_c1_84 | 939 | 6161 | 598 | 1797 | 75 | 0.032 |

| Protein name | | | | Locus Name | | Acc# |
|---|---|---|---|---|---|---|
| unknown | | | | gp:U96771 | | U96771 |

Description

*Prevotella bryantii* putative polygalacturonase, B-1,4-endoglucanse, and mannanase genes, complete cds; and unknown genes.

| ORF Name | NTID | AAID | NT Length | AA Length | Score | Probability |
|---|---|---|---|---|---|---|
| 10753760_f2_32 | 940 | 6162 | 131 | 396 | 224 | 1.6e−18 |

| Protein name | | | | Locus Name | | Acc# |
|---|---|---|---|---|---|---|
| IgA Fc receptor-like protein A428L | | | | pir:T17931 | | T17931 |

Description

| ORF Name | NTID | AAID | NT Length | AA Length | Score | Probability |
|---|---|---|---|---|---|---|
| 12787768_f3_65 | 941 | 6163 | 67 | 204 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 13953388_c1_94 | 942 | 6164 | 296 | 891 | 133 | 2.2e−06 |
| Protein name | | | | Locus Name | | Acc# |
| | | | | sp:VIRF_YEREN | | P13225 |

Description

VIRULENCE REGULON TRANSCRIPTIONAL ACTIVATOR

| ORF Name | NTID | AAID | NT Length | AA Length | Score | Probability |
|---|---|---|---|---|---|---|
| 14511086_c1_86 | 943 | 6165 | 330 | 993 | 212 | 1.5e−18 |
| Protein name | | | | Locus Name | | Acc# |
| hypothetical protein F14F9.5 | | | | pir:T33774 | | T33774 |

Description

| ORF Name | NTID | AAID | NT Length | AA Length | Score | Probability |
|---|---|---|---|---|---|---|
| 16832885_f3_68 | 944 | 6166 | 431 | 1296 | 1723 | 2.3e−177 |
| Protein name | | | | Locus Name | | Acc# |
| hypothetical protein | | | | pir:JQ1020 | | JQ1020 |

Description

| ORF Name | NTID | AAID | NT Length | AA Length | Score | Probability |
|---|---|---|---|---|---|---|
| 22860128_f1_11 | 945 | 6167 | 83 | 252 | 64 | 0.031 |
| Protein name | | | | Locus Name | | Acc# |
| | | | | sp:SPRC_XENLA | | P36378 |

Description (OSTEONECTIN) (ON) (BASEMENT MEMBRANE PROTEIN BM-40)

| ORF Name | NTID | AAID | NT Length | AA Length | Score | Probability |
|---|---|---|---|---|---|---|
| 23469691_c3_111 | 946 | 6168 | 179 | 540 | | |
| Protein name | | | | Locus Name | | Acc# |

Description

NO-HIT

| ORF Name | NTID | AAID | NT Length | AA Length | Score | Probability |
|---|---|---|---|---|---|---|
| 23515762_f2_52 | 947 | 6169 | 92 | 279 | | |
| Protein name | | | | Locus Name | | Acc# |

Description

NO-HIT

-continued

| ORF Name | NTID | AAID | NT Length | AA Length | Score | Probability |
|---|---|---|---|---|---|---|
| 23984402_c1_82 | 948 | 6170 | 711 | 2136 | 488 | 8.9e−44 |
| Protein name | | | Locus Name | | Acc# | |
| receptor antigen (RagA) | | | gp:PGI130872 | | AJ130872 | |

Description

*Porphyromonas gingivalis* W50 receptor antigen (rag) locus encoding a major immunodominant 55 kDa antigen.

| ORF Name | NTID | AAID | NT Length | AA Length | Score | Probability |
|---|---|---|---|---|---|---|
| 24640675_c2_99 | 949 | 6171 | 511 | 1536 | | |
| Protein name | | | Locus Name | | Acc# | |

Description

NO-HIT

| ORF Name | NTID | AAID | NT Length | AA Length | Score | Probability |
|---|---|---|---|---|---|---|
| 24806300_f2_40 | 950 | 6172 | 267 | 804 | | |
| Protein name | | | Locus Name | | Acc# | |

Description

NO-HIT

| ORF Name | NTID | AAID | NT Length | AA Length | Score | Probability |
|---|---|---|---|---|---|---|
| 25706687_c1_83 | 951 | 6173 | 415 | 1248 | 162 | 2.3e−17 |
| Protein name | | | Locus Name | | Acc# | |
| receptor antigen (RagA) | | | gp:PGI130872 | | AJ130872 | |

Description

*Porphyromonas gingivalis* W50 receptor antigen (rag) locus encoding a major immunodominant 55 kDa antigen.

| ORF Name | NTID | AAID | NT Length | AA Length | Score | Probability |
|---|---|---|---|---|---|---|
| 26360636_f1_5 | 952 | 6174 | 201 | 606 | 208 | 8.0e−17 |
| Protein name | | | Locus Name | | Acc# | |
| | | | gp:AHU56832 | | U56832 | |

Description

*Aeromonas hydrophila* FK506 binding protein (fkpA) gene, complete cds in 3.9 kb fragment.

| ORF Name | NTID | AAID | NT Length | AA Length | Score | Probability |
|---|---|---|---|---|---|---|
| 2813912_c3_110 | 953 | 6175 | 460 | 1383 | 508 | 1.3e−48 |
| Protein name | | | Locus Name | | Acc# | |
| | | | sp:YHAM_ECOLI | | P42626 | |

Description

HYPOTHETICAL 19.4 KD PROTEIN IN EXUR-TDCC INTERGENIC REGION (F188)

-continued

| ORF Name | NTID | AAID | NT Length | AA Length | Score | Probability |
|---|---|---|---|---|---|---|
| 3417677_c1_85 | 954 | 6176 | 354 | 1065 | 171 | 3.3e−12 |

| Protein name | | | | Locus Name | | Acc# |
|---|---|---|---|---|---|---|
| KIAA0879 protein | | | | gp:AB020686 | | AB020686 |

Description

*Homo sapiens* mRNA for KIAA0879 protein, complete cds.

| ORF Name | NTID | AAID | NT Length | AA Length | Score | Probability |
|---|---|---|---|---|---|---|
| 37925_f1_10 | 955 | 6177 | 63 | 192 | 54 | 0.020 |

| Protein name | | | | Locus Name | | Acc# |
|---|---|---|---|---|---|---|
| | | | | gp:AFSCR | | X70080 |

Description

*A. franciscana* Scr gene (homologue of *Drosophila* Sex combs reduced).

| ORF Name | NTID | AAID | NT Length | AA Length | Score | Probability |
|---|---|---|---|---|---|---|
| 474167_c3_105 | 956 | 6178 | 559 | 1680 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 4742812_f3_64 | 957 | 6179 | 378 | 1137 | 388 | 7.2e−50 |

| Protein name | | | | Locus Name | | Acc# |
|---|---|---|---|---|---|---|
| hypothetical protein | | | | gp:ATH132745 | | AJ132745 |

Description

*Arabidopsis thaliana* hypothetical protein, clone EMG9a29.

| ORF Name | NTID | AAID | NT Length | AA Length | Score | Probability |
|---|---|---|---|---|---|---|
| 4804562_c2_103 | 958 | 6180 | 452 | 1359 | 156 | 2.6e−11 |

| Protein name | | | | Locus Name | | Acc# |
|---|---|---|---|---|---|---|
| putative outer membrane porin | | | | gp:AF030977 | | |

Description

*Vibrio cholerae* glutamyl tRNA synthetase (gltX) gene, partial cds; putative outer membrane porin (ompA), unknown protein, *vibrio bactin* receptor precursor (viuA), and ViuB protein (viuB) genes, complete cds; and VibF (vibF) gene, partial cds.

| ORF Name | NTID | AAID | NT Length | AA Length | Score | Probability |
|---|---|---|---|---|---|---|
| 4875035_c1_80 | 959 | 6181 | 193 | 582 | 180 | 7.4e−14 |

| Protein name | | | | Locus Name | | Acc# |
|---|---|---|---|---|---|---|
| RNA polymerase sigma factor SigZ-like protein | | | | gp:AF137263 | | AF137263 |

Description

*Bacteroides thetaiotao* micron 30S ribosomal protein S16-like protein, fucose gene cluster, and RNA polymerase sigma factor SigZ-like protein (sigZ) genes, complete cds.

-continued

| ORF Name | NTID | AAID | NT Length | AA Length | Score | Probability |
|---|---|---|---|---|---|---|
| 4882012_c1_95 | 960 | 6182 | 377 | 1131 | 253 | 1.4e−19 |

| Protein name | Locus Name | Acc# |
|---|---|---|
| | gp:AF083424 | AF083424 |

Description

*Ateline herpes* virus 3 complete genome.

| ORF Name | NTID | AAID | NT Length | AA Length | Score | Probability |
|---|---|---|---|---|---|---|
| 5351507_f2_39 | 961 | 6183 | 378 | 1137 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 5881877_c3_107 | 962 | 6184 | 352 | 1059 | 147 | 1.3e−07 |

| Protein name | Locus Name | Acc# |
|---|---|---|
| transmembrane sensor | gp:AF051691 | AF051691 |

Description

*Pseudomonas aeruginosa* stress factor A (psfA), ECF sigma factor (fiuI), transmembrane sensor (fiuR), and hydroxamate-type ferrisiderophore receptor (fiuA) genes, complete cds.

| ORF Name | NTID | AAID | NT Length | AA Length | Score | Probability |
|---|---|---|---|---|---|---|
| 970385_c3_108 | 963 | 6185 | 824 | 2475 | 209 | 1.2e−13 |

| Protein name | Locus Name | Acc# |
|---|---|---|
| serine/threonine protein kinase related protein | pir:H69064 | H69064 |

Description

| ORF Name | NTID | AAID | NT Length | AA Length | Score | Probability |
|---|---|---|---|---|---|---|
| 1064063_c2_139 | 964 | 6186 | 297 | 894 | 126 | 0.00030 |

| Protein name | Locus Name | Acc# |
|---|---|---|
| 115K outer membrane protein precursor:SusC protein | pir:JC6027 | JC6027 |

Description

| ORF Name | NTID | AAID | NT Length | AA Length | Score | Probability |
|---|---|---|---|---|---|---|
| 10742332_c1_106 | 965 | 6187 | 85 | 258 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 11836662_f2_46 | 966 | 6188 | 659 | 1980 | 1330 | 1.0e−135 |

| Protein name | Locus Name | Acc# |
|---|---|---|
|  | sp:YFIC_BACSU | P54719 |

Description

HYPOTHETICAL ABC TRANSPORTER ATP-BINDING PROTEIN 2 IN GLVBC 3' REGION

| ORF Name | NTID | AAID | NT Length | AA Length | Score | Probability |
|---|---|---|---|---|---|---|
| 16284692_c2_135 | 967 | 6189 | 64 | 195 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 20507827_f3_79 | 968 | 6190 | 574 | 1725 | 1246 | 8.1e−127 |

| Protein name | Locus Name | Acc# |
|---|---|---|
| ABC transporter, ATP-binding protein | pir:E72396 | E72396 |

Description

| ORF Name | NTID | AAID | NT Length | AA Length | Score | Probability |
|---|---|---|---|---|---|---|
| 23562802_c3_144 | 969 | 6191 | 421 | 1266 | 575 | 1.0e−55 |

| Protein name | Locus Name | Acc# |
|---|---|---|
|  | sp:SBCD_RHOCA | O068033 |

Description

EXONUCLEASE SBCD HOMOLOG

| ORF Name | NTID | AAID | NT Length | AA Length | Score | Probability |
|---|---|---|---|---|---|---|
| 24651557_c2_138 | 970 | 6192 | 380 | 1143 | 78 | 0.038 |

| Protein name | Locus Name | Acc# |
|---|---|---|
| fibronecton type III | gp:HUMFN3A | M12549 |

Description

*Human fibronectin* gene type III homology unit corresponding to the cell-binding domain, exons 6 and 7.

| ORF Name | NTID | AAID | NT Length | AA Length | Score | Probability |
|---|---|---|---|---|---|---|
| 24666005_c3_145 | 971 | 6193 | 996 | 2991 | 464 | 1.5e−84 |

| Protein name | Locus Name | Acc# |
|---|---|---|
| probable exonuclease, | pir:T03465 | T03465 |

Description

-continued

| ORF Name | NTID | AAID | NT Length | AA Length | Score | Probability |
|---|---|---|---|---|---|---|
| 25978516_c2_119 | 972 | 6194 | 98 | 297 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 273442_c2_117 | 973 | 6195 | 363 | 1092 | 180 | 2.7e−11 |

| Protein name | | | | Locus Name | | Acc# |
|---|---|---|---|---|---|---|
| cation efflux system (czcB-like) | | | | pir:C70415 | | C70415 |

Description

| ORF Name | NTID | AAID | NT Length | AA Length | Score | Probability |
|---|---|---|---|---|---|---|
| 2947138_f1_6 | 974 | 6196 | 195 | 588 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 29940912_f3_90 | 975 | 6197 | 345 | 1038 | 279 | 2.4e−24 |

| Protein name | | | | Locus Name | | Acc# |
|---|---|---|---|---|---|---|
| hypothetical protein TM1693 | | | | pir:G72223 | | G72223 |

Description

| ORF Name | NTID | AAID | NT Length | AA Length | Score | Probability |
|---|---|---|---|---|---|---|
| 3157813_f1_7 | 976 | 6198 | 390 | 1173 | 305 | 4.2e−27 |

| Protein name | | | | Locus Name | | Acc# |
|---|---|---|---|---|---|---|
| probable phosphoesterase, ykuE | | | | pir:B69865 | | B69865 |

Description

| ORF Name | NTID | AAID | NT Length | AA Length | Score | Probability |
|---|---|---|---|---|---|---|
| 34173431_f1_5 | 977 | 6199 | 180 | 543 | 183 | 3.6e−14 |

| Protein name | | | | Locus Name | | Acc# |
|---|---|---|---|---|---|---|
| SigX | | | | gp:AF115334 | | |

Description

*Pseudomonas fluorescens* PpsA (ppsA) gene, partial cds; EstX (estX), MenG (menG), CmaX (cmaX), CrfX (crfX), CmpX (cmpX), SigX (sigX), OprF (oprF), and CobA (cobA) genes, complete cds; and unknown gene.

-continued

| ORF Name | NTID | AAID | NT Length | AA Length | Score | Probability |
|---|---|---|---|---|---|---|
| 34661301_c1_102 | 978 | 6200 | 1083 | 3252 | 394 | 6.3e−53 |

| Protein name | Locus Name | Acc# |
|---|---|---|
| acriflavine resistance protein (acrB) homolog | pir:D70117 | D70117 |

Description

| ORF Name | NTID | AAID | NT Length | AA Length | Score | Probability |
|---|---|---|---|---|---|---|
| 3938215_c2_118 | 979 | 6201 | 550 | 1653 | 384 | 7.4e−33 |

| Protein name | Locus Name | Acc# |
|---|---|---|
| cation efflux (AcrB/AcrD/AcrF family) | pir:F70368 | F70368 |

Description

| ORF Name | NTID | AAID | NT Length | AA Length | Score | Probability |
|---|---|---|---|---|---|---|
| 4394642_f3_71 | 980 | 6202 | 152 | 459 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4805286_c1_99 | 981 | 6203 | 486 | 1461 | 533 | 2.7e−50 |

| Protein name | Locus Name | Acc# |
|---|---|---|
| acriflavine resistance protein (acrB) homolog | pir:D70117 | D70117 |

Description

| ORF Name | NTID | AAID | NT Length | AA Length | Score | Probability |
|---|---|---|---|---|---|---|
| 5195317_c1_101 | 982 | 6204 | 430 | 1293 | 110 | 0.0047 |

| Protein name | Locus Name | Acc# |
|---|---|---|
| | sp:YD40_HAEIN | P44165 |

Description

HYPOTHETICAL PROTEIN HI1340

| ORF Name | NTID | AAID | NT Length | AA Length | Score | Probability |
|---|---|---|---|---|---|---|
| 6853436_c1_115 | 983 | 6205 | 161 | 486 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 10235877_c2_250 | 984 | 6206 | 389 | 1170 | 2007 | 1.8e−207 |

| Protein name | Locus Name | Acc# |
|---|---|---|
| putative epimerase/dehydratase | gp:AF125164 | AF125164 |

Description

*Bacteroides fragilis* 638R polysaccharide B (PS B2) biosynthesislocus, complete sequence; and unknown genes.

| ORF Name | NTID | AAID | NT Length | AA Length | Score | Probability |
|---|---|---|---|---|---|---|
| 10585817_f3_105 | 985 | 6207 | 66 | 201 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 1064005_f1_40 | 986 | 6208 | 632 | 1899 | 291 | 5.0e−23 |

| Protein name | Locus Name | Acc# |
|---|---|---|
| hypothetical protein Rv2731 | pir:B70506 | B70506 |

Description

| ORF Name | NTID | AAID | NT Length | AA Length | Score | Probability |
|---|---|---|---|---|---|---|
| 10667943_f2_70 | 987 | 6209 | 113 | 342 | 125 | 5.0e−08 |

| Protein name | Locus Name | Acc# |
|---|---|---|
| HipA protein. | gp:D90794 | |

Description

*E. coli* genomic DNA, Kohara clone #303 (34.3–34.6 min.).

| ORF Name | NTID | AAID | NT Length | AA Length | Score | Probability |
|---|---|---|---|---|---|---|
| 10969017_c3_293 | 988 | 6210 | 343 | 1032 | 1742 | 2.2e−179 |

| Protein name | Locus Name | Acc# |
|---|---|---|
| putative epimerase/dehydratase | gp:AF125164 | AF125164 |

Description

*Bacteroides fragilis* 638R polysaccharide B (PS B2) biosynthesislocus, complete sequence; and unknown genes.

| ORF Name | NTID | AAID | NT Length | AA Length | Score | Probability |
|---|---|---|---|---|---|---|
| 11023432_c1_205 | 989 | 6211 | 414 | 1245 | 2081 | 2.7e−215 |

| Protein name | Locus Name | Acc# |
|---|---|---|
| putative glycosyltransferase | gp:AF125164 | AF125164 |

Description

*Bacteroides fragilis* 638R polysaccharide B (PS B2) biosynthesislocus, complete sequence; and unknown genes.

-continued

| ORF Name | NTID | AAID | NT Length | AA Length | Score | Probability |
|---|---|---|---|---|---|---|
| 1188951_f2_61 | 990 | 6212 | 60 | 183 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 12187817_f3_117 | 991 | 6213 | 162 | 489 | 93 | 0.031 |

| Protein name | | | | Locus Name | | Acc# |
|---|---|---|---|---|---|---|
| cell cycle progression restoration 8 protein | | | | gp:AF011794 | | AF011794 |

Description

*Homo sapiens* cell cycle progression restoration 8 protein (CPR8) mRNA, complete cds.

| ORF Name | NTID | AAID | NT Length | AA Length | Score | Probability |
|---|---|---|---|---|---|---|
| 12520688_c3_280 | 992 | 6214 | 61 | 186 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 13804187_f1_47 | 993 | 6215 | 98 | 297 | 84 | 0.0018 |

| Protein name | | | | Locus Name | | Acc# |
|---|---|---|---|---|---|---|
| hypothetical protein | | | | gp:MTH243656 | | AJ243656 |

Description

*Methanobacterium thermoautotrophicum* ehbA, B, C, D, E, F, G, H, I, J, K, L, M, N, O, P, Q, & ORFS 1, 2 & 3.

| ORF Name | NTID | AAID | NT Length | AA Length | Score | Probability |
|---|---|---|---|---|---|---|
| 14250637_f3_147 | 994 | 6216 | 387 | 1164 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 14258450_f3_118 | 995 | 6217 | 121 | 366 | 100 | 2.2e−05 |

| Protein name | | | | Locus Name | | Acc# |
|---|---|---|---|---|---|---|
| hypothetical protein TM1330 | | | | pir:F72267 | | F72267 |

Description

-continued

| ORF Name | NTID | AAID | NT Length | AA Length | Score | Probability |
|---|---|---|---|---|---|---|
| 14275252_f3_162 | 996 | 6218 | 681 | 2046 | 1133 | 7.6e−115 |

| Protein name | Locus Name | Acc# |
|---|---|---|
| (p) ppGpp synthetase | gp:BSU86377 | U86377 |

Description

*Bacillus subtilis* (p) ppGpp synthetase (relA) and adeninephosphoribosyltransferase (apt) genes, complete cds.

| ORF Name | NTID | AAID | NT Length | AA Length | Score | Probability |
|---|---|---|---|---|---|---|
| 14648380_f1_18 | 997 | 6219 | 295 | 888 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 14650882_f3_114 | 998 | 6220 | 121 | 366 | 96 | 0.00067 |

| Protein name | Locus Name | Acc# |
|---|---|---|
| hypothetical protein PFB0225c | pir:E71620 | E71620 |

Description

| ORF Name | NTID | AAID | NT Length | AA Length | Score | Probability |
|---|---|---|---|---|---|---|
| 14660952_f3_150 | 999 | 6221 | 119 | 360 | 220 | 4.3e−18 |

| Protein name | Locus Name | Acc# |
|---|---|---|
| ybeB protein homolog iojap:protein slr1886:protein slr1886 | pir:S77145 | S77145 |

Description

| ORF Name | NTID | AAID | NT Length | AA Length | Score | Probability |
|---|---|---|---|---|---|---|
| 14925162_f3_119 | 1000 | 6222 | 74 | 225 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 15709675_c1_193 | 1001 | 6223 | 367 | 1104 | 798 | 2.4e−79 |

| Protein name | Locus Name | Acc# |
|---|---|---|
| | sp:YS18_MYCTU | P71777 |

Description

HYPOTHETICAL 36.3 KD PROTEIN CY277.18

-continued

| ORF Name | NTID | AAID | NT Length | AA Length | Score | Probability |
|---|---|---|---|---|---|---|
| 15790675_c1_199 | 1002 | 6224 | 401 | 1206 | 862 | 4.0e−86 |

| Protein name | Locus Name | Acc# |
|---|---|---|
| phosphonopyruvate decarboxylase, fom2 | pir:S60212 | S60212 |

Description

| ORF Name | NTID | AAID | NT Length | AA Length | Score | Probability |
|---|---|---|---|---|---|---|
| 19533462_c3_278 | 1003 | 6225 | 419 | 1260 | 869 | 7.2e−87 |

| Protein name | Locus Name | Acc# |
|---|---|---|
|  | sp:YBDG_ECOLI |  |

Description

HYPOTHETICAL 46.6 KD PROTEIN IN PHEP-NFNB INTERGENIC REGION

| ORF Name | NTID | AAID | NT Length | AA Length | Score | Probability |
|---|---|---|---|---|---|---|
| 1964058_f2_92 | 1004 | 6226 | 279 | 840 | 716 | 1.2e−70 |

| Protein name | Locus Name | Acc# |
|---|---|---|
|  | sp:SOJ_BACSU | P37522 |

Description

SOJ PROTEIN

| ORF Name | NTID | AAID | NT Length | AA Length | Score | Probability |
|---|---|---|---|---|---|---|
| 20736678_c3_296 | 1005 | 6227 | 204 | 615 | 1056 | 1.1e−106 |

| Protein name | Locus Name | Acc# |
|---|---|---|
| putative undecaprenyl-phosphate | gp:AF125164 | AF125164 |

Description

*Bacteroides fragilis* 638R polysaccharide B (PS B2) biosynthesislocus, complete sequence; and unknown genes.

| ORF Name | NTID | AAID | NT Length | AA Length | Score | Probability |
|---|---|---|---|---|---|---|
| 22689642_c2_249 | 1006 | 6228 | 355 | 1068 | 465 | 4.7e−44 |

| Protein name | Locus Name | Acc# |
|---|---|---|
| putative glycosyltransferase | gp:AF125164 | AF125164 |

Description

*Bacteroides fragilis* 638R polysaccharide B (PS B2) biosynthesislocus, complete sequence; and unknown genes.

| ORF Name | NTID | AAID | NT Length | AA Length | Score | Probability |
|---|---|---|---|---|---|---|
| 23490876_c3_289 | 1007 | 6229 | 508 | 1527 | 195 | 3.4e−12 |

| Protein name | Locus Name | Acc# |
|---|---|---|
| putative flippase | gp:AF125164 | AF125164 |

Description

*Bacteroides fragilis* 638R polysaccharide B (PS B2) biosynthesislocus, complete sequence; and unknown genes.

-continued

| ORF Name | NTID | AAID | NT Length | AA Length | Score | Probability |
|---|---|---|---|---|---|---|
| 23553136_c2_238 | 1008 | 6230 | 345 | 1038 | | |

| Protein name | | | Locus Name | | Acc# | |
|---|---|---|---|---|---|---|

Description

NO-HIT

| ORF Name | NTID | AAID | NT Length | AA Length | Score | Probability |
|---|---|---|---|---|---|---|
| 23554555_f3_142 | 1009 | 6231 | 254 | 765 | | |

| Protein name | | | Locus Name | | Acc# | |
|---|---|---|---|---|---|---|

Description

NO-HIT

| ORF Name | NTID | AAID | NT Length | AA Length | Score | Probability |
|---|---|---|---|---|---|---|
| 23595137_f3_115 | 1010 | 6232 | 119 | 360 | | |

| Protein name | | | Locus Name | | Acc# | |
|---|---|---|---|---|---|---|

Description

NO-HIT

| ORF Name | NTID | AAID | NT Length | AA Length | Score | Probability |
|---|---|---|---|---|---|---|
| 23635952_c1_182 | 1011 | 6233 | 333 | 1002 | 123 | 6.7e−11 |

| Protein name | | | Locus Name | | Acc# | |
|---|---|---|---|---|---|---|
| dolichol-P-glucose synthetase homolog | | | pir:E69322 | | E69322 | |

Description

| ORF Name | NTID | AAID | NT Length | AA Length | Score | Probability |
|---|---|---|---|---|---|---|
| 23678252_c2_247 | 1012 | 6234 | 444 | 1335 | 1376 | 1.4e−140 |

| Protein name | | | Locus Name | | Acc# | |
|---|---|---|---|---|---|---|
| phosphoenolpyruvate phosphomutase FOM1 | | | pir:S60206 | | | |

Description

| ORF Name | NTID | AAID | NT Length | AA Length | Score | Probability |
|---|---|---|---|---|---|---|
| 2382882_c2_216 | 1013 | 6235 | 383 | 1152 | 403 | 1.7e−37 |

| Protein name | | | Locus Name | | Acc# | |
|---|---|---|---|---|---|---|
| hypothetical protein | | | pir:S76344 | | S76344 | |

Description

| ORF Name | NTID | AAID | NT Length | AA Length | Score | Probability |
|---|---|---|---|---|---|---|
| 24017687_f3_152 | 1014 | 6236 | 284 | 855 | 304 | 5.4e−27 |

| Protein name | | | Locus Name | | Acc# | |
|---|---|---|---|---|---|---|
| | | | sp:CDSA_HAEIN | | | |

Description

SYNTHASE)

-continued

| ORF Name | NTID | AAID | NT Length | AA Length | Score | Probability |
|---|---|---|---|---|---|---|
| 24226587_c2_241 | 1015 | 6237 | 314 | 945 | 301 | 1.1e−26 |

| Protein name | Locus Name | Acc# |
|---|---|---|
| activator protein | gp:AF047527 | AF047527 |

Description

*Pseudomonas fluorescens* activator protein (mtlR) gene, complete cds.

| ORF Name | NTID | AAID | NT Length | AA Length | Score | Probability |
|---|---|---|---|---|---|---|
| 24398376_f3_148 | 1016 | 6238 | 107 | 324 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24413577_f1_144 | 1017 | 6239 | 288 | 867 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24641925_c1_203 | 1018 | 6240 | 401 | 1206 | 136 | 3.8e−06 |

| Protein name | Locus Name | Acc# |
|---|---|---|
| galactosyltransferase homolog | pir:G69465 | G69465 |

Description

| ORF Name | NTID | AAID | NT Length | AA Length | Score | Probability |
|---|---|---|---|---|---|---|
| 24806538_c3_292 | 1019 | 6241 | 342 | 1029 | 179 | 2.0e−11 |

| Protein name | Locus Name | Acc# |
|---|---|---|
| capsular polysaccharide biosynthesis protein | pir:F70441 | F70441 |

Description

| ORF Name | NTID | AAID | NT Length | AA Length | Score | Probability |
|---|---|---|---|---|---|---|
| 2537575_c2_234 | 1020 | 6242 | 124 | 375 | 87 | 0.011 |

| Protein name | Locus Name | Acc# |
|---|---|---|
| probable membrane protein YOL019w:hypothetical protein O2313 | pir:S66701 | S66701 |

Description

-continued

| ORF Name | NTID | AAID | NT Length | AA Length | Score | Probability |
|---|---|---|---|---|---|---|
| 26204682_f3_128 | 1021 | 6243 | 326 | 981 | 221 | 3.3e−18 |

| Protein name | Locus Name | Acc# |
|---|---|---|
|  | sp:Y266_ARCFU | O29973 |

Description

HYPOTHETICAL PROTEIN AF0266

| ORF Name | NTID | AAID | NT Length | AA Length | Score | Probability |
|---|---|---|---|---|---|---|
| 26367176_c2_217 | 1022 | 6244 | 251 | 756 |  |  |

| Protein name | Locus Name | Acc# |
|---|---|---|

Description

NO HIT

| ORF Name | NTID | AAID | NT Length | AA Length | Score | Probability |
|---|---|---|---|---|---|---|
| 26379677_f1_43 | 1023 | 6245 | 300 | 903 | 539 | 6.7e−52 |

| Protein name | Locus Name | Acc# |
|---|---|---|
|  | sp:YGI2_PSEPU | P31857 |

Description

HYPOTHETICAL 32.4 KD PROTEIN IN GIDB-UNCI INTERGENIC REGION

| ORF Name | NTID | AAID | NT Length | AA Length | Score | Probability |
|---|---|---|---|---|---|---|
| 29850282_f1_19 | 1024 | 6246 | 269 | 810 | 216 | 1.7e−17 |

| Protein name | Locus Name | Acc# |
|---|---|---|
|  | sp:Y665_HAEIN | P44033 |

Description

HYPOTHETICAL PROTEIN HI0665

| ORF Name | NTID | AAID | NT Length | AA Length | Score | Probability |
|---|---|---|---|---|---|---|
| 32636311_f2_83 | 1025 | 6247 | 480 | 1443 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 33376906_c3_290 | 1026 | 6248 | 316 | 951 | 351 | 5.6e−32 |

| Protein name | Locus Name | Acc# |
|---|---|---|
| LicD1 | gp:AF106539 | AF106539 |

Description

*Streptococcus pneumoniae* LicD1 (licD1) and LicD2 (licD2) genes, complete cds; and unknown gene.

| ORF Name | NTID | AAID | NT Length | AA Length | Score | Probability |
|---|---|---|---|---|---|---|
| 33406567_f2_82 | 1027 | 6249 | 925 | 2778 | 129 | 6.1e−05 |

| Protein name | | | Locus Name | | | Acc# |
|---|---|---|---|---|---|---|
| 115K outer membrane protein precursor:SusC protein | | | pir:JC6027 | | | JC6027 |

Description

| ORF Name | NTID | AAID | NT Length | AA Length | Score | Probability |
|---|---|---|---|---|---|---|
| 33839461_c1_200 | 1028 | 6250 | 338 | 1017 | 348 | 1.2e−31 |

| Protein name | | | Locus Name | | | Acc# |
|---|---|---|---|---|---|---|
| putative alcohol dehydrogenase | | | gp:CZA382 | | | AL078635 |

Description

*Amycolatopsis orientalis* cosmid pCZA382.

| ORF Name | NTID | AAID | NT Length | AA Length | Score | Probability |
|---|---|---|---|---|---|---|
| 35396876_c3_295 | 1029 | 6251 | 418 | 1257 | 2046 | 1.4e−211 |

| Protein name | | | Locus Name | | | Acc# |
|---|---|---|---|---|---|---|
| putative epimerase | | | gp:AF125164 | | | AF125164 |

Description

*Bacteroides fragilis* 638R polysaccharide B (PS B2) biosynthesis locus, complete sequence; and unknown genes.

| ORF Name | NTID | AAID | NT Length | AA Length | Score | Probability |
|---|---|---|---|---|---|---|
| 35401627_c3_288 | 1030 | 6252 | 141 | 426 | 431 | 1.9e−40 |

| Protein name | | | Locus Name | | | Acc# |
|---|---|---|---|---|---|---|
| WcgF | | | gp:AF125164 | | | AF125164 |

Description

*Bacteroides fragilis* 638R polysaccharide B (PS B2) biosynthesis locus, complete sequence; and unknown genes.

| ORF Name | NTID | AAID | NT Length | AA Length | Score | Probability |
|---|---|---|---|---|---|---|
| 36362675_c1_207 | 1031 | 6253 | 197 | 594 | 317 | 2.2e−28 |

| Protein name | | | Locus Name | | | Acc# |
|---|---|---|---|---|---|---|
| | | | gP:AB008550 | | | AB008550 |

Description

*Pseudomonas aeruginosa* phage phi CTX, complete genome sequence.

-continued

| ORF Name | NTID | AAID | NT Length | AA Length | Score | Probability |
|---|---|---|---|---|---|---|
| 3914025_c3_287 | 1032 | 6254 | 166 | 501 | 181 | 5.8e−14 |
| Protein name | | | Locus Name | | Acc# | |
| unknown | | | gp:AF125164 | | AF125164 | |
| Description | | | | | | |

*Bacteroides fragilis* 638R polysaccharide B (PS B2) biosynthesis locus, complete sequence; and unknown genes.

| ORF Name | NTID | AAID | NT Length | AA Length | Score | Probability |
|---|---|---|---|---|---|---|
| 3943753_c2_245 | 1033 | 6255 | 296 | 891 | 1278 | 3.3e−130 |
| Protein name | | | Locus Name | | Acc# | |
| glucose-1-phosphate thymidyltransferase | | | gp:AF125164 | | AF125164 | |
| Description | | | | | | |

*Bacteroides fragilis* 638R polysaccharide B (PS B2) biosynthesis locus, complete sequence; and unknown genes.

| ORF Name | NTID | AAID | NT Length | AA Length | Score | Probability |
|---|---|---|---|---|---|---|
| 3955062_c3_299 | 1034 | 6256 | 265 | 798 | 918 | 4.6e−92 |
| Protein name | | | Locus Name | | Acc# | |
| unknown | | | gp:AF125164 | | AF125164 | |
| Description | | | | | | |

*Bacteroides fragilis* 638R polysaccharide B (PS B2) biosynthesis locus, complete sequence; and unknown genes.

| ORF Name | NTID | AAID | NT Length | AA Length | Score | Probability |
|---|---|---|---|---|---|---|
| 3991300_c3_258 | 1035 | 6257 | 295 | 888 | 405 | 1.1e−37 |
| Protein name | | | Locus Name | | Acc# | |
| stationary phase survival protein SurE | | | pir:A70372 | | A70372 | |
| Description | | | | | | |

| ORF Name | NTID | AAID | NT Length | AA Length | Score | Probability |
|---|---|---|---|---|---|---|
| 4157762_c2_244 | 1036 | 6258 | 182 | 549 | 95 | 0.00012 |
| Protein name | | | Locus Name | | Acc# | |
| unknown | | | gp:AF048749 | | AF048749 | |
| Description | | | | | | |

*Bacteroides fragilis* capsular polysaccharide biosynthesis operon, complete sequence.

| ORF Name | NTID | AAID | NT Length | AA Length | Score | Probability |
|---|---|---|---|---|---|---|
| 4175255_f3_151 | 1037 | 6259 | 680 | 2043 | 1389 | 4.3e−148 |
| Protein name | | | Locus Name | | Acc# | |
| FtsH2 | | | gp:AB023310 | | AB023310 | |
| Description | | | | | | |

*Cyanidioschyzon merolae* gene or FtsH2, complete cds.

-continued

| ORF Name | NTID | AAID | NT Length | AA Length | Score | Probability |
|---|---|---|---|---|---|---|
| 4304812_c2_246 | 1038 | 6260 | 140 | 423 | 532 | 3.7e−51 |

| Protein name | Locus Name | Acc# |
|---|---|---|
| WcgG | gp:AF125164 | AF125164 |

Description

*Bacteroides fragilis* 638R polysaccharide B (PS B2) biosynthesis locus, complete sequence; and unknown genes.

| ORF Name | NTID | AAID | NT Length | AA Length | Score | Probability |
|---|---|---|---|---|---|---|
| 4803555_c3_297 | 1039 | 6261 | 198 | 597 | 996 | 2.5e−100 |

| Protein name | Locus Name | Acc# |
|---|---|---|
| putative acetyltransferase | gp:AF125164 | AF125164 |

Description

*Bacteroides fragilis* 638R polysaccharide B (PS B2) biosynthesis locus, complete sequence; and unknown genes.

| ORF Name | NTID | AAID | NT Length | AA Length | Score | Probability |
|---|---|---|---|---|---|---|
| 4878277_c1_192 | 1040 | 6262 | 205 | 618 | 95 | 0.0062 |

| Protein name | Locus Name | Acc# |
|---|---|---|
|  | gp:YP102KB | AL031866 |

Description

*Yersinia pestsis* 102 kbases unstable region: from 1 to 119443.

| ORF Name | NTID | AAID | NT Length | AA Length | Score | Probability |
|---|---|---|---|---|---|---|
| 4897128_c1_201 | 1041 | 6263 | 298 | 897 | 299 | 1.8e−26 |

| Protein name | Locus Name | Acc# |
|---|---|---|
| N-acetylglucosaminyltransferase | gp:AB017355 | AB017355 |

Description

*Streptococcus agalactiae* DNA, cps (capsular polysaccharide) genes, partial and complete cds.

| ORF Name | NTID | AAID | NT Length | AA Length | Score | Probability |
|---|---|---|---|---|---|---|
| 4897256_c1_183 | 1042 | 6264 | 498 | 1497 | 1152 | 7.4e−117 |

| Protein name | Locus Name | Acc# |
|---|---|---|
| X-His dipeptidase, :aminoacylhistidine dipeptidase:aminopeptidase D:beta-alanyl-histidine | pir:JU0300 |  |

Description

| ORF Name | NTID | AAID | NT Length | AA Length | Score | Probability |
|---|---|---|---|---|---|---|
| 4962760_c2_233 | 1043 | 6265 | 1927 | 5784 | 167 | 6.8e−20 |

| Protein name | Locus Name | Acc# |
|---|---|---|
| hypothetical protein | pir:E72310 | E72310 |

Description

-continued

| ORF Name | NTID | AAID | NT Length | AA Length | Score | Probability |
|---|---|---|---|---|---|---|
| 5136411_c1_202 | 1044 | 6266 | 362 | 1089 | 178 | 5.4e−11 |

| Protein name | Locus Name | Acc# |
|---|---|---|
| capsular polysaccharide biosynthesis homolog yveQ | pir:F70036 | F70036 |

Description

| ORF Name | NTID | AAID | NT Length | AA Length | Score | Probability |
|---|---|---|---|---|---|---|
| 5213541_c3_263 | 1045 | 6267 | 281 | 846 | 297 | 3.0e−26 |

| Protein name | Locus Name | Acc# |
|---|---|---|
| hypothetical protein APE2014 | pir:H72504 | H72504 |

Description

| ORF Name | NTID | AAID | NT Length | AA Length | Score | Probability |
|---|---|---|---|---|---|---|
| 5275281_f1_45 | 1046 | 6268 | 440 | 1323 | 375 | 1.3e−38 |

| Protein name | Locus Name | Acc# |
|---|---|---|
| probable membrane-bound lytic murein transglycosylase D (dniR) | pir:H71301 | H71301 |

Description

| ORF Name | NTID | AAID | NT Length | AA Length | Score | Probability |
|---|---|---|---|---|---|---|
| 6037801_c3_276 | 1047 | 6269 | 379 | 1140 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 6648452_f2_87 | 1048 | 6270 | 272 | 819 | 396 | 9.6e−377 |

| Protein name | Locus Name | Acc# |
|---|---|---|
| | sp:KSGA_MYCCA | P43038 |

Decsription

DIMETHYLTRANSFERASE)

| ORF Name | NTID | AAID | NT Length | AA Length | Score | Probability |
|---|---|---|---|---|---|---|
| 6832757_f3_149 | 1049 | 6271 | 471 | 1416 | 665 | 3.0e−65 |

| Protein name | Locus Name | Acc# |
|---|---|---|
| Ykok | gp:AB013374 | AB013374 |

Description

*Bacillus halodurans* C-125 mamX, yjdA, ykoK and yvfK genes, partial and complete cds.

-continued

| ORF Name | NTID | AAID | NT Length | AA Length | Score | Probability |
|---|---|---|---|---|---|---|
| 6853387_c1_198 | 1050 | 6272 | 367 | 1104 | 1050 | 4.8e−106 |

| Protein name | Locus Name | Acc# |
|---|---|---|
| PCZA361.5 | gp:AOPCZA361 | AJ223998 |

Description

*Amycolatopsis orientalis* cosmid PCZA361.

| ORF Name | NTID | AAID | NT Length | AA Length | Score | Probability |
|---|---|---|---|---|---|---|
| 800812_c2_235 | 1051 | 6273 | 379 | 1140 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 824051_c1_206 | 1052 | 6274 | 402 | 1209 | 1943 | 1.1e−200 |

| Protein name | Locus Name | Acc# |
|---|---|---|
| putative aminotransferase | gp:AF125164 | AF125164 |

Description

*Bacteroides fragilis* 638R polysaccharide B (PS B2) biosynthesis locus, complete sequence; and unknown genes.

| ORF Name | NTID | AAID | NT Length | AA Length | Score | Probability |
|---|---|---|---|---|---|---|
| 882702_c2_237 | 1053 | 6275 | 279 | 840 | 114 | 1.3e−06 |

| Protein name | Locus Name | Acc# |
|---|---|---|
| unknown | gp:AF068902 | AF068902 |

Description

*Streptococcus pneumoniae* D-glutamic acid adding enzyme MurD (murD), undecaprenyl-PP-MurNAc-pentapeptide-UDPGlcNAc GlcNAc transferase (murG), cell division protein DivIB (divIB), orotidine-5'-decarboxylase PyrF (pyrF), and orotatephosphoribosyltransferase PyrE (pyrE) genes, complete cds; and unknown

| ORF Name | NTID | AAID | NT Length | AA Length | Score | Probability |
|---|---|---|---|---|---|---|
| 9944428_f3_97 | 1054 | 6276 | 100 | 303 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24864688_c1_7 | 1055 | 6277 | 77 | 234 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 29317557_c2_9 | 1056 | 6278 | 519 | 1560 | 142 | 6.3e−06 |

| Protein name | Locus Name | Acc# |
|---|---|---|
| receptor antigen (RagA) | gp:PGI130872 | AJ130872 |

Description

*Porphyromonas gingivalis* W50 receptor antigen (rag) locus encoding a major immunodominant 55 kDa antigen.

| ORF Name | NTID | AAID | NT Length | AA Length | Score | Probability |
|---|---|---|---|---|---|---|
| 1038461_f3_25 | 1057 | 6279 | 274 | 825 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 16211377_f3_28 | 1058 | 6280 | 158 | 477 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 16486287_f1_6 | 1059 | 6281 | 151 | 456 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24647938_f1_5 | 1060 | 6282 | 133 | 402 | 110 | 2.2e−06 |

| Protein name | Locus Name | Acc# |
|---|---|---|
| muramoyl-pentapeptide carboxypeptidase | pir:T34747 | T34747 |

Description

| ORF Name | NTID | AAID | NT Length | AA Length | Score | Probability |
|---|---|---|---|---|---|---|
| 24666313_f3_31 | 1061 | 6283 | 948 | 2847 | 218 | 6.3e−14 |

| Protein name | Locus Name | Acc# |
|---|---|---|
| slow myosin heavy chain 2 | gp:GGU85023 | U85023 |

Description

*Gallus gallus* slow myosin heavy chain 2 (SM2) mRNA, partial cds.

-continued

| ORF Name | NTID | AAID | NT Length | AA Length | Score | Probability |
|---|---|---|---|---|---|---|
| 4100885_f3_26 | 1062 | 6284 | 316 | 951 | | |

| Protein name | | | Locus Name | | Acc# | |
|---|---|---|---|---|---|---|
| | | | | | | |

Description

NO-HIT

| ORF Name | NTID | AAID | NT Length | AA Length | Score | Probability |
|---|---|---|---|---|---|---|
| 4119637_f1_8 | 1063 | 6285 | 215 | 648 | 115 | 0.00017 |

| Protein name | | | Locus Name | | Acc# | |
|---|---|---|---|---|---|---|
| hypothetical protein jhp0052 | | | pir:F71980 | | F71980 | |

Description

| ORF Name | NTID | AAID | NT Length | AA Length | Score | Probability |
|---|---|---|---|---|---|---|
| 4900252_f1_1 | 1064 | 6286 | 264 | 795 | | |

| Protein name | | | Locus Name | | Acc# | |
|---|---|---|---|---|---|---|
| | | | | | | |

Description

NO-HIT

| ORF Name | NTID | AAID | NT Length | AA Length | Score | Probability |
|---|---|---|---|---|---|---|
| 5946032_f2_16 | 1065 | 6287 | 285 | 858 | | |

| Protein name | | | Locus Name | | Acc# | |
|---|---|---|---|---|---|---|
| | | | | | | |

Description

NO-HIT

| ORF Name | NTID | AAID | NT Length | AA Length | Score | Probability |
|---|---|---|---|---|---|---|
| 10755437_f1_11 | 1066 | 6288 | 168 | 507 | 280 | 1.9e−24 |

| Protein name | | | Locus Name | | Acc# | |
|---|---|---|---|---|---|---|
| | | | sp:BKDR_PSEPU | | P42179 | |

Description

BKD OPERON TRANSCRIPTIONAL REGULATOR

| ORF Name | NTID | AAID | NT Length | AA Length | Score | Probability |
|---|---|---|---|---|---|---|
| 1175211_f3_35 | 1067 | 6289 | 215 | 648 | 550 | 4.6e−53 |

| Protein name | | | Locus Name | | Acc# | |
|---|---|---|---|---|---|---|
| inner membrane ABC transporter | | | gp:AF213822 | | AF213822 | |

Description

*Zymomonas mobilis* strain ZM4 fosmid clone 42B3, complete sequence.

-continued

| ORF Name | NTID | AAID | NT Length | AA Length | Score | Probability |
|---|---|---|---|---|---|---|
| 12272127_f3_40 | 1068 | 6290 | 140 | 423 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 1423427_f1_4 | 1069 | 6291 | 608 | 1827 | 871 | 4.4e−87 |

| Protein name | | | | Locus Name | | Acc# |
|---|---|---|---|---|---|---|
| | | | | gp:YP102KB | | AL031866 |

Description

*Yersinia pestis* 102 kbases unstable region: from 1 to 119443.

| ORF Name | NTID | AAID | NT Length | AA Length | Score | Probability |
|---|---|---|---|---|---|---|
| 15657687_f1_13 | 1070 | 6292 | 185 | 558 | 373 | 2.6e−34 |

| Protein name | | | | Locus Name | | Acc# |
|---|---|---|---|---|---|---|
| | | | | sp:YBDM_ECOLI | | P77174 |

Description

HYPOTHETICAL 23.9 KD PROTEIN IN CSTA-DSBG INTERGENIC REGION

| ORF Name | NTID | AAID | NT Length | AA Length | Score | Probability |
|---|---|---|---|---|---|---|
| 15900317_f1_5 | 1071 | 6293 | 337 | 1014 | 315 | 1.6e−27 |

| Protein name | | | | Locus Name | | Acc# |
|---|---|---|---|---|---|---|
| NrpB | | | | gp:PMU46488 | | U46488 |

Description

*Proteus mirabilis* NrpS (nrpS) gene, partial cds, NrpU (nrpU), NrpT (nrpT), NrpA (nrpA), NrpB (nrpB), NrpG (nrpG) and IrpP (irpP) genes, complete cds.

| ORF Name | NTID | AAID | NT Length | AA Length | Score | Probability |
|---|---|---|---|---|---|---|
| 2090080_f1_15 | 1072 | 6294 | 117 | 354 | 135 | 4.0e−08 |

| Protein name | | | | Locus Name | | Acc# |
|---|---|---|---|---|---|---|
| 60 kDa protein | | | | gp:AB004560 | | AB004560 |

Description

*Porphyromonas gingivalis* DNA for 60 kDa protein, complete cds.

| ORF Name | NTID | AAID | NT Length | AA Length | Score | Probability |
|---|---|---|---|---|---|---|
| 22657052_c1_54 | 1073 | 6295 | 156 | 471 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 22928450_f1_16 | 1074 | 6296 | 60 | 183 | | |

| Protein name | | Locus Name | Acc# |
|---|---|---|---|
| | | | |

Description

NO-HIT

| ORF Name | NTID | AAID | NT Length | AA Length | Score | Probability |
|---|---|---|---|---|---|---|
| 23556577_f2_25 | 1075 | 6297 | 434 | 1305 | 537 | 1.2e−59 |

| Protein name | | Locus Name | Acc# |
|---|---|---|---|
| | | sp:YBDN_ECOLI | P77216 |

Description

HYPOTHETICAL 47.8 KD PROTEIN IN CSTA-DSBG INTERGENIC REGION

| ORF Name | NTID | AAID | NT Length | AA Length | Score | Probability |
|---|---|---|---|---|---|---|
| 23867917_c2_88 | 1076 | 6298 | 96 | 291 | 84 | 0.0043 |

| Protein name | | Locus Name | Acc# |
|---|---|---|---|
| MHC class II alpha chain | | gp:AF091557 | AF091557 |

Description

*Aulonocara hansbaenschi* MHC class II alpha chain MHC-Auha-DAA1 mRNA (MHC-Auha-DAA1*01 allele), complete cds.

| ORF Name | NTID | AAID | NT Length | AA Length | Score | Probability |
|---|---|---|---|---|---|---|
| 24431537_c2_75 | 1077 | 6299 | 108 | 327 | | |

| Protein name | | Locus Name | Acc# |
|---|---|---|---|
| | | | |

Description

NO-HIT

| ORF Name | NTID | AAID | NT Length | AA Length | Score | Probability |
|---|---|---|---|---|---|---|
| 24492078_f1_1 | 1078 | 6300 | 307 | 924 | | |

| Protein name | | Locus Name | Acc# |
|---|---|---|---|
| | | | |

Description

NO-HIT

| ORF Name | NTID | AAID | NT Length | AA Length | Score | Probability |
|---|---|---|---|---|---|---|
| 29580387_f3_38 | 1079 | 6301 | 317 | 954 | 142 | 1.7e−07 |

| Protein name | | Locus Name | Acc# |
|---|---|---|---|
| pobR regulator | | gp:PSEY18527 | Y18527 |

Description

*Pseudomonas* sp. pobA, pobR, pcaQ, pcaH and pcaG genes.

-continued

| ORF Name | NTID | AAID | NT Length | AA Length | Score | Probability |
|---|---|---|---|---|---|---|
| 31691875_f2_19 | 1080 | 6302 | 214 | 645 | 166 | 4.7e−12 |

| Protein name | Locus Name | Acc# |
|---|---|---|
|  | gp:LIINLC | Y07639 |

Description

*L. ivanovii* 23S rRNA, 5S rRNA, tRNA-Asn, tRNA-Thr, ORF Z, in1D, anc in1C genes.

| ORF Name | NTID | AAID | NT Length | AA Length | Score | Probability |
|---|---|---|---|---|---|---|
| 83399057_c1_52 | 1081 | 6303 | 288 | 867 | 159 | 1.5e−09 |

| Protein name | Locus Name | Acc# |
|---|---|---|
|  | sp:LCRF_YERPE | P28808 |

Description

THERMOREGULATORY PROTEIN LCRF

| ORF Name | NTID | AAID | NT Length | AA Length | Score | Probability |
|---|---|---|---|---|---|---|
| 35650462_f3_43 | 1082 | 6304 | 200 | 603 | 272 | 4.8e−23 |

| Protein name | Locus Name | Acc# |
|---|---|---|
| 60 kDa protein | gp:AB004560 | AB004560 |

Description

*Porphyromonas gingivalis* DNA for 60 kDa protein, complete cds.

| ORF Name | NTID | AAID | NT Length | AA Length | Score | Probability |
|---|---|---|---|---|---|---|
| 4069180_f1_14 | 1083 | 6305 | 197 | 594 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 4953586_c2_89 | 1084 | 6306 | 119 | 360 | 92 | 0.0026 |

| Protein name | Locus Name | Acc# |
|---|---|---|
| lipase precursor | gp:AF053006 | AF053006 |

Description

*Staphylococcus epidermidis* lipase precursor (geh1) gene, complete cds.

| ORF Name | NTID | AAID | NT Length | AA Length | Score | Probability |
|---|---|---|---|---|---|---|
| 4954462_f1_3 | 1085 | 6307 | 275 | 828 | 265 | 7.3e−23 |

| Protein name | Locus Name | Acc# |
|---|---|---|
|  | sp:TCMP_STRGA | P39887 |

Description (EC 2.1.1.—)

-continued

| ORF Name | NTID | AAID | NT Length | AA Length | Score | Probability |
|---|---|---|---|---|---|---|
| 5260137_c2_80 | 1086 | 6308 | 61 | 186 | 54 | 0.042 |

| Protein name | Locus Name | Acc# |
|---|---|---|
| pqqG protein | pir:B55527 | B55527 |

Description

| ORF Name | NTID | AAID | NT Length | AA Length | Score | Probability |
|---|---|---|---|---|---|---|
| 7065802_f3_28 | 1087 | 6309 | 238 | 717 | 81 | 0.0088 |

| Protein name | Locus Name | Acc# |
|---|---|---|
| hypothetical protein MTH1102 | pir:F69013 | F69013 |

Description

| ORF Name | NTID | AAID | NT Length | AA Length | Score | Probability |
|---|---|---|---|---|---|---|
| 9963202_c3_101 | 1088 | 6310 | 511 | 1536 | 373 | 1.2e−32 |

| Protein name | Locus Name | Acc# |
|---|---|---|
| sensory transduction histidine kinase sll0474:protein sll0474:protein sll0474 | pir:S76650 | S76650 |

Description

| ORF Name | NTID | AAID | NT Length | AA Length | Score | Probability |
|---|---|---|---|---|---|---|
| 11723417_c2_40 | 1089 | 6311 | 484 | 1455 | 121 | 2.8e−06 |

| Protein name | Locus Name | Acc# |
|---|---|---|
| unknown | gp:U96771 | U96771 |

Description

*Prevotella bryantii* putative polygalacturonase, B-1,4-endoglucanase, and mannanase genes, complete cds; and unknown genes.

| ORF Name | NTID | AAID | NT Length | AA Length | Score | Probability |
|---|---|---|---|---|---|---|
| 16601526_c1_38 | 1090 | 6312 | 1089 | 3270 | 801 | 7.4e−91 |

| Protein name | Locus Name | Acc# |
|---|---|---|
| receptor antigen (RagA) | gp:PGI130872 | AJ130872 |

Description

*Porphyromonas gingivalis* W50 receptor antigen (rag) locus encoding a major immunodominant 55 kDa antigen.

| ORF Name | NTID | AAID | NT Length | AA Length | Score | Probability |
|---|---|---|---|---|---|---|
| 20507937_c2_42 | 1091 | 6313 | 542 | 1629 | 138 | 3.6e−07 |

| Protein name | Locus Name | Acc# |
|---|---|---|
| unknown | gp:U96771 | U96771 |

Description

*Prevotella bryantii* putative polygalacturonase, B-1,4-endoglucanase, and mannanase genes, complete cds; and unknown genes.

-continued

| ORF Name | NTID | AAID | NT Length | AA Length | Score | Probability |
|---|---|---|---|---|---|---|
| 21678137__f3__27 | 1092 | 6314 | 420 | 1263 | 101 | 0.024 |

| Protein name | | | Locus Name | | | Acc# |
|---|---|---|---|---|---|---|
| hypothetical protein ytaP | | | pir:B69988 | | | B69988 |

Description

| ORF Name | NTID | AAID | NT Length | AA Length | Score | Probability |
|---|---|---|---|---|---|---|
| 24491512__c3__49 | 1093 | 6315 | 543 | 1632 | 147 | 5.0e−07 |

| Protein name | | | Locus Name | | | Acc# |
|---|---|---|---|---|---|---|
| unknown | | | gp:U96771 | | | U96771 |

Description

*Prevotella bryantii* putative polygalacturonase, B-1,4-endoglucanase, and mannanase genes, complete cds; and unknown genes.

| ORF Name | NTID | AAID | NT Length | AA Length | Score | Probability |
|---|---|---|---|---|---|---|
| 35351583__f3__34 | 1094 | 6316 | 71 | 216 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 4120307__f3__26 | 1095 | 6317 | 443 | 1332 | 520 | 6.9e−50 |

| Protein name | | | Locus Name | | | Acc# |
|---|---|---|---|---|---|---|
| hypothetical protein PAB1371 | | | pir:C75064 | | | C75064 |

Description

| ORF Name | NTID | AAID | NT Length | AA Length | Score | Probability |
|---|---|---|---|---|---|---|
| 4144515__f2__17 | 1096 | 6318 | 70 | 213 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 781932__c1__35 | 1097 | 6319 | 1100 | 3303 | 543 | 2.7e−85 |

| Protein name | | | Locus Name | | | Acc# |
|---|---|---|---|---|---|---|
| 115K outer membrane protein precursor:SusC protein | | | pir:JC6027 | | | JC6027 |

Description

-continued

| ORF Name | NTID | AAID | NT Length | AA Length | Score | Probability |
|---|---|---|---|---|---|---|
| 22697711_c3_9 | 1098 | 6320 | 329 | 990 | 614 | 9.2e−68 |

| Protein name | | | | Locus Name | | Acc# |
|---|---|---|---|---|---|---|
| neuraminidase precursor | | | | gp:BNRNANASE | | D28493 |

Description

*Bacteroides fragilis* nanH gene for neuraminidase, complete cds.

| ORF Name | NTID | AAID | NT Length | AA Length | Score | Probability |
|---|---|---|---|---|---|---|
| 11182950_c2_139 | 1099 | 6321 | 248 | 747 | 619 | 2.2e−60 |

| Protein name | | | | Locus Name | | Acc# |
|---|---|---|---|---|---|---|
| TruB | | | | gp:AF169967 | | AF169967 |

Description

*Flavobacterium johnsoniae* LeuS (leuS) gene, partial cds; and Fjo12 (fjo12), FtsX (ftsX), Fjo13 (fjo13), BacA (bacA), and TruB (truB) genes, complete cds.

| ORF Name | NTID | AAID | NT Length | AA Length | Score | Probability |
|---|---|---|---|---|---|---|
| 11956503_c1_120 | 1100 | 6322 | 142 | 429 | 110 | 1.9e−06 |

| Protein name | | | | Locus Name | | Acc# |
|---|---|---|---|---|---|---|
| | | | | sp:RNPA_BORBU | | P50069 |

Description

RIBONUCLEASE P PROTEIN COMPONENT, (PROTEIN C5) (RNASE P)

| ORF Name | NTID | AAID | NT Length | AA Length | Score | Probability |
|---|---|---|---|---|---|---|
| 13864002_f1_26 | 1101 | 6323 | 73 | 222 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 14882902_c1_108 | 1102 | 6324 | 381 | 1146 | 117 | 0.00018 |

| Protein name | | | | Locus Name | | Acc# |
|---|---|---|---|---|---|---|
| sensory transduction system regulatory protein slr1837:protein slr1837:protein slr1837 | | | | pir:S77341 | | S77341 |

| ORF Name | NTID | AAID | NT Length | AA Length | Score | Probability |
|---|---|---|---|---|---|---|
| 15109377_c1_119 | 1103 | 6325 | 254 | 765 | 108 | 0.0011 |

| Protein name | | | | Locus Name | | Acc# |
|---|---|---|---|---|---|---|
| | | | | sp:HEM4_SCHPO | | P87214 |

Description (UROIIIS)

-continued

| ORF Name | NTID | AAID | NT Length | AA Length | Score | Probability |
|---|---|---|---|---|---|---|
| 20176878_c3_156 | 1104 | 6326 | 280 | 843 | 106 | 0.00063 |

| Protein name | Locus Name | Acc# |
|---|---|---|
| ATPase subunit 6 | gp:TCU40265 | U40265 |

Description

*Trypanosoma cruzi* ATPase subunit 6 mRNA, complete cds.

| ORF Name | NTID | AAID | NT Length | AA Length | Score | Probability |
|---|---|---|---|---|---|---|
| 204775_c3_153 | 1105 | 6327 | 304 | 915 | 466 | 3.7e−44 |

| Protein name | Locus Name | Acc# |
|---|---|---|
| FtsX | gp:AF169967 | AF169967 |

Description

*Flavobacterium johnsoniae* LeuS (leuS) gene, partial cds; and Fjo12 (fjo12), FtsX (ftsX), Fjo13 (fjo13), BacA (bacA), and TruB (truB) genes, complete cds.

| ORF Name | NTID | AAID | NT Length | AA Length | Score | Probability |
|---|---|---|---|---|---|---|
| 2116037_c1_107 | 1106 | 6328 | 76 | 231 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 21522150_c2_141 | 1107 | 6329 | 437 | 1314 | 597 | 1.4e−110 |

| Protein name | Locus Name | Acc# |
|---|---|---|
| | sp:METK_HAEIN | P43762 |

Description

ADENOSYLTRANSFERASE) (ADOMET SYNTHETASE)

| ORF Name | NTID | AAID | NT Length | AA Length | Score | Probability |
|---|---|---|---|---|---|---|
| 23442175_c1_122 | 1108 | 6330 | 439 | 1320 | 1071 | 2.8e−108 |

| Protein name | Locus Name | Acc# |
|---|---|---|
| | sp:SYY_BACST | P00952 |

Description

TYROSYL-TRNA SYNTHETASE, (TYROSINE--TRNA LIGASE) (TYRRS)

| ORF Name | NTID | AAID | NT Length | AA Length | Score | Probability |
|---|---|---|---|---|---|---|
| 23447031_c1_109 | 1109 | 6331 | 298 | 897 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 23453160_f1_10 | 1110 | 6332 | 60 | 183 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 23712752_c3_149 | 1111 | 6333 | 89 | 270 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 24256300_c2_138 | 1112 | 6334 | 676 | 2031 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 24406253_c3_163 | 1113 | 6335 | 93 | 279 | 142 | 1.5e−09 |
| Protein name | | | Locus Name | | | Acc# |
| oxidoreductase, short chain dehydrogenase/reductase family | | | pir:A72395 | | | A72395 |
| Description | | | | | | |

| ORF Name | NTID | AAID | NT Length | AA Length | Score | Probability |
|---|---|---|---|---|---|---|
| 26605287_c1_114 | 1114 | 6336 | 268 | 807 | 400 | 3.6e−37 |
| Protein name | | | Locus Name | | | Acc# |
| | | | sp:BACA_ECOLI | | | |
| Description | | | | | | |

(EC 2.7.1.66)

| ORF Name | NTID | AAID | NT Length | AA Length | Score | Probability |
|---|---|---|---|---|---|---|
| 29303427_f1_14 | 1115 | 6337 | 81 | 246 | 70 | 0.033 |
| Protein name | | | Locus Name | | | Acc# |
| hypothetical protein A635R | | | pir:T18137 | | | T18137 |
| Description | | | | | | |

-continued

| ORF Name | NTID | AAID | NT Length | AA Length | Score | Probability |
|---|---|---|---|---|---|---|
| 29932918_c3_151 | 1116 | 6338 | 85 | 258 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 32228430_c3_161 | 1117 | 6339 | 527 | 1584 | 447 | 3.8e−42 |

| Protein name | | | | Locus Name | | Acc# |
|---|---|---|---|---|---|---|
| choline sulfatase | | | | gp:RMU39940 | | U39940 |

Description

*Sinorhizobium meliloti* bet operon, complete sequence.

| ORF Name | NTID | AAID | NT Length | AA Length | Score | Probability |
|---|---|---|---|---|---|---|
| 34251637_f2_70 | 1118 | 6340 | 90 | 273 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 35791416_c1_105 | 1119 | 6341 | 692 | 2079 | 449 | 2.4e−39 |

| Protein name | | | | Locus Name | | Acc# |
|---|---|---|---|---|---|---|
| putative secreted beta-galactosidase | | | | gp:SCF81 | | AL133171 |

Description

*Streptomyces coelicolor* cosmid F81.

| ORF Name | NTID | AAID | NT Length | AA Length | Score | Probability |
|---|---|---|---|---|---|---|
| 36366552_c1_113 | 1120 | 6342 | 79 | 240 | 175 | 2.5e−13 |

| Protein name | | | | Locus Name | | Acc# |
|---|---|---|---|---|---|---|
| Fjo13 | | | | gp:AF169967 | | AF169967 |

Description

*Flavobacterium johnsoniae* LeuS (leuS) gene, partial cds; and Fjo12 (fjo12), FtsX (ftsX), Fjo13 (fjo13), BacA (bacA), and TruB (truB) genes, complete cds.

| ORF Name | NTID | AAID | NT Length | AA Length | Score | Probability |
|---|---|---|---|---|---|---|
| 36437893_c3_148 | 1121 | 6343 | 67 | 204 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 3937750_c1_110 | 1122 | 6344 | 354 | 1065 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 3942082_c2_140 | 1123 | 6345 | 357 | 1074 | 753 | 1.4e−74 |

| Protein name | | | | Locus Name | | Acc# |
|---|---|---|---|---|---|---|
| S-adenosylmethionine tRNA ribosyltransferase | | | | pir:A72360 | | A72360 |

Description

| ORF Name | NTID | AAID | NT Length | AA Length | Score | Probability |
|---|---|---|---|---|---|---|
| 4102177_c3_162 | 1124 | 6346 | 283 | 852 | 735 | 1.1e−72 |

| Protein name | | | | Locus Name | | Acc# |
|---|---|---|---|---|---|---|
| | | | | sp:KDUI_ERWCH | | Q05529 |

Description (5-KETO-4-DEOXYURONATE ISOMERASE) (DKI ISOMERASE)

| ORF Name | NTID | AAID | NT Length | AA Length | Score | Probability |
|---|---|---|---|---|---|---|
| 4119005_c3_158 | 1125 | 6347 | 212 | 639 | 159 | 1.6e−11 |

| Protein name | | | | Locus Name | | Acc# |
|---|---|---|---|---|---|---|
| HI0454 | | | | gp:AF174390 | | AF174390 |

Description

*Haemophilus influenzae* strain Rd KW20 HI0454 gene, partial cds.

| ORF Name | NTID | AAID | NT Length | AA Length | Score | Probability |
|---|---|---|---|---|---|---|
| 4188438_c3_157 | 1126 | 6348 | 76 | 231 | 226 | 9.9e−19 |

| Protein name | | | | Locus Name | | Acc# |
|---|---|---|---|---|---|---|
| conserved hypothetical protein | | | | pir:G72251 | | G72251 |

Description

| ORF Name | NTID | AAID | NT Length | AA Length | Score | Probability |
|---|---|---|---|---|---|---|
| 4398382_c1_118 | 1127 | 6349 | 201 | 606 | 374 | 2.1e−34 |

| Protein name | | | | Locus Name | | Acc# |
|---|---|---|---|---|---|---|
| conserved hypothetical protein yvdD | | | | pir:D70033 | | D70033 |

Description

-continued

| ORF Name | NTID | AAID | NT Length | AA Length | Score | Probability |
|---|---|---|---|---|---|---|
| 4757_c3_152 | 1128 | 6350 | 375 | 1128 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 4867142_f3_74 | 1129 | 6351 | 1098 | 3297 | 302 | 1.2e−38 |

| Protein name | | | | Locus Name | | Acc# |
|---|---|---|---|---|---|---|
| hypothetical protein c0624 | | | | pir:S73091 | | S73091 |

Description

| ORF Name | NTID | AAID | NT Length | AA Length | Score | Probability |
|---|---|---|---|---|---|---|
| 4876438_f3_102 | 1130 | 6352 | 590 | 1773 | 162 | 1.7e−09 |

| Protein name | | | | Locus Name | | Acc# |
|---|---|---|---|---|---|---|
| response regulator | | | | gp:SPAJ6398 | | AJ006398 |

Description

*Streptococcus pneumoniae* rr09 and hk09 genes; two component system 09.

| ORF Name | NTID | AAID | NT Length | AA Length | Score | Probability |
|---|---|---|---|---|---|---|
| 4876515_c2_134 | 1131 | 6353 | 376 | 1131 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 4954376_c2_137 | 1132 | 6354 | 355 | 1068 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 5273377_c2_132 | 1133 | 6355 | 359 | 1080 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 553161_c2_133 | 1134 | 6356 | 81 | 246 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 553161_c2_135 | 1135 | 6357 | 83 | 252 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 5892138_c1_106 | 1136 | 6358 | 409 | 1230 | 133 | 4.7e−06 |

| Protein name | | | | Locus Name | | Acc# |
|---|---|---|---|---|---|---|
| hypothetical protein PH0283 | | | | pir:D71453 | | D71453 |

Description

| ORF Name | NTID | AAID | NT Length | AA Length | Score | Probability |
|---|---|---|---|---|---|---|
| 6829630_c2_136 | 1137 | 6359 | 376 | 1131 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 6835381_f3_93 | 1138 | 6360 | 65 | 198 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 6827828_c1_117 | 1139 | 6361 | 154 | 465 | 326 | 2.5e−29 |

| Protein name | | | | Locus Name | | Acc# |
|---|---|---|---|---|---|---|
| | | | | sp:HPPK_PORGI | | O83019 |

Description (HPPK) (6-HYDROXYMETHYL-7,8-DIHYDROPTERIN PYROPHOSPHOKINASE) (PPPK)

| ORF Name | NTID | AAID | NT Length | AA Length | Score | Probability |
|---|---|---|---|---|---|---|
| 7315641_c1_111 | 1140 | 6362 | 311 | 936 | 140 | 2.7e−07 |

| Protein name | | | | Locus Name | | Acc# |
|---|---|---|---|---|---|---|
| ubiquinone/menaquinone biosynthesis methyltransferase-related protein | | | | pir:F72262 | | F72262 |

Description

-continued

| ORF Name | NTID | AAID | NT Length | AA Length | Score | Probability |
|---|---|---|---|---|---|---|
| 10978590_f3_64 | 1141 | 6363 | 77 | 234 | | |
| Protein name | | | | Locus Name | | Acc# |

Description

NO-HIT

| ORF Name | NTID | AAID | NT Length | AA Length | Score | Probability |
|---|---|---|---|---|---|---|
| 14257762_f3_66 | 1142 | 6364 | 110 | 333 | | |
| Protein name | | | | Locus Name | | Acc# |

Description

NO-HIT

| ORF Name | NTID | AAID | NT Length | AA Length | Score | Probability |
|---|---|---|---|---|---|---|
| 16453180_f3_65 | 1143 | 6365 | 150 | 453 | 50 | 0.020 |
| Protein name | | | | Locus Name | | Acc# |
| WW domain binding protein 5 | | | | gp:MMU92454 | | U92454 |

Description

*Mus musculus* WW domain binding protein 5 mRNA, partial cds.

| ORF Name | NTID | AAID | NT Length | AA Length | Score | Probability |
|---|---|---|---|---|---|---|
| 2084768_f3_57 | 1144 | 6366 | 149 | 450 | | |
| Protein name | | | | Locus Name | | Acc# |

Description

NO-HIT

| ORF Name | NTID | AAID | NT Length | AA Length | Score | Probability |
|---|---|---|---|---|---|---|
| 23705002_f1_10 | 1145 | 6367 | 746 | 2241 | 243 | 1.2e−29 |
| Protein name | | | | Locus Name | | Acc# |
| conserved hypothetical protein ylbK | | | | pir:H69874 | | H69874 |

Description

| ORF Name | NTID | AAID | NT Length | AA Length | Score | Probability |
|---|---|---|---|---|---|---|
| 24422676_f1_15 | 1146 | 6368 | 1023 | 3072 | | |
| Protein name | | | | Locus Name | | Acc# |

Description

NO-HIT

| ORF Name | NTID | AAID | NT Length | AA Length | Score | Probability |
|---|---|---|---|---|---|---|
| 24492125_c1_105 | 1147 | 6369 | 1025 | 3075 | 2141 | 1.2e−221 |
| Protein name | | | | Locus Name | | Acc# |
| hypothetical protein mexF | | | | pir:T30830 | | T30830 |

Description

-continued

| ORF Name | NTID | AAID | NT Length | AA Length | Score | Probability |
|---|---|---|---|---|---|---|
| 24643800_f2_37 | 1148 | 6370 | 258 | 777 | 572 | 2.1e−55 |

| Protein name | Locus Name | Acc# |
|---|---|---|
| | sp:YAFV_ECOLI | Q47679 |

Description

HYPOTHETICAL 28.9 KD PROTEIN IN DNAQ-GHMA INTERGENIC REGION

| ORF Name | NTID | AAID | NT Length | AA Length | Score | Probability |
|---|---|---|---|---|---|---|
| 25975307_f1_27 | 1149 | 6371 | 112 | 339 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 26680340_f1_16 | 1150 | 6372 | 125 | 378 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 26756551_c1_104 | 1151 | 6373 | 409 | 1230 | 485 | 3.5e−46 |

| Protein name | Locus Name | Acc# |
|---|---|---|
| | sp:ACRE_ECOLI | P24180 |

Description

ACRIFLAVIN RESISTANCE PROTEIN E PRECURSOR (ENVC PROTEIN)

| ORF Name | NTID | AAID | NT Length | AA Length | Score | Probability |
|---|---|---|---|---|---|---|
| 30583162_c2_108 | 1152 | 6374 | 981 | 2946 | 1508 | 2.3e−166 |

| Protein name | Locus Name | Acc# |
|---|---|---|
| transcription-repair coupling factor | gp:AF023181 | AF023181 |

Description

*Listeria monocytogenes* transcription-repair coupling factor (mfdL), low temperature requirement B protein (ltrB), and DivIC homolog (divL) genes, complete cds.

| ORF Name | NTID | AAID | NT Length | AA Length | Score | Probability |
|---|---|---|---|---|---|---|
| 31375817_f2_44 | 1153 | 6375 | 113 | 342 | 69 | 0.042 |

| Protein name | Locus Name | Acc# |
|---|---|---|
| conserved hypothetical protein AF0188 | pir:D69273 | D69273 |

Description

-continued

| ORF Name | NTID | AAID | NT Length | AA Length | Score | Probability |
|---|---|---|---|---|---|---|
| 32147151_f1_12 | 1154 | 6376 | 392 | 1179 | 444 | 7.8e-42 |

| Protein name | | | | Locus Name | | Acc# |
|---|---|---|---|---|---|---|
| | | | | sp:NAGA_VIBCH | | O32445 |

Description

DEACETYLASE)

| ORF Name | NTID | AAID | NT Length | AA Length | Score | Probability |
|---|---|---|---|---|---|---|
| 32282637_f2_36 | 1155 | 6377 | 196 | 591 | 310 | 1.2e-27 |

| Protein name | | | | Locus Name | | Acc# |
|---|---|---|---|---|---|---|
| hypothetical protein | | | | pir:G75263 | | G75263 |

Description

| ORF Name | NTID | AAID | NT Length | AA Length | Score | Probability |
|---|---|---|---|---|---|---|
| 34181513_f1_26 | 1156 | 6378 | 460 | 1383 | 293 | 4.1e-42 |

| Protein name | | | | Locus Name | | Acc# |
|---|---|---|---|---|---|---|
| dihydroorotase (pyrc) PAB1149 | | | | pir:C75027 | | C75027 |

Description

| ORF Name | NTID | AAID | NT Length | AA Length | Score | Probability |
|---|---|---|---|---|---|---|
| 34430317_f2_38 | 1157 | 6379 | 262 | 789 | 304 | 5.4e-27 |

| Protein name | | | | Locus Name | | Acc# |
|---|---|---|---|---|---|---|
| protein-tyrosine phosphatase | | | | gp:AB028630 | | AB028630 |

DescriptiOn

*Clostridium perfringens* hyp27, bacH, ptp, cpd genes for hypothetical protein, bacterial hemoglobin, protein-tyrosinephosphatase, 2',3'-cuclic nucleotide 2'-phosphodiesterase, partial and complete cds.

| ORF Name | NTID | AAID | NT Length | AA Length | Score | Probability |
|---|---|---|---|---|---|---|
| 4554753_f2_45 | 1158 | 6380 | 161 | 486 | 211 | 3.8e-17 |

| Protein name | | | | Locus Name | | Acc# |
|---|---|---|---|---|---|---|
| | | | | sp:YQGC_BACSU | | P54486 |

Description

HYPOTHETICAL 17.3 KD PROTEIN IN CCCA-SODA INTERGENIC REGION

| ORF Name | NTID | AAID | NT Length | AA Length | Score | Probability |
|---|---|---|---|---|---|---|
| 4570341_f1_25 | 1159 | 6381 | 263 | 792 | 531 | 4.7e−51 |

| Protein name | Locus Name | Acc# |
|---|---|---|
| putative glycosyl transferase. | gp:SC6D7 | AL133213 |

Description

*Streptomyces coelicolor* cosmid 6D7.

-continued

| ORF Name | NTID | AAID | NT Length | AA Length | Score | Probability |
|---|---|---|---|---|---|---|
| 47200_f1_13 | 1160 | 6382 | 689 | 2070 | 439 | 7.4e−41 |

| Protein name | Locus Name | Acc# |
|---|---|---|
| | sp:NAGB_BACSU | O35000 |

Description

PHOSPHATE DEAMINASE) (GNPDA) (GLCN6P DEAMINASE)

| ORF Name | NTID | AAID | NT Length | AA Length | Score | Probability |
|---|---|---|---|---|---|---|
| 4876090_c1_82 | 1161 | 6383 | 204 | 615 | 122 | 0.00012 |

| Protein name | Locus Name | Acc# |
|---|---|---|
| | sp:MFD_BACSU | P37474 |

Description

TRANSCRIPTION-REPAIR COUPLING FACTOR (TRCF)

| ORF Name | NTID | AAID | NT Length | AA Length | Score | Probability |
|---|---|---|---|---|---|---|
| 4876300_c1_88 | 1162 | 6384 | 65 | 198 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 7157576_f3_67 | 1163 | 6385 | 642 | 1929 | 886 | 1.1e−88 |

| Protein name | Locus Name | Acc# |
|---|---|---|
| conserved hypothetical protein | pir:C72391 | C72391 |

Description

| ORF Name | NTID | AAID | NT Length | AA Length | Score | Probability |
|---|---|---|---|---|---|---|
| 835175_f1_28 | 1164 | 6386 | 226 | 678 | 237 | 1.9e−18 |

| Protein name | Locus Name | Acc# |
|---|---|---|
| | sp:METH_HUMAN | |

Description (METHIONINE SYNTHASE, VITAMIN-B12 DEPENDENT) (MS)

| ORF Name | NTID | AAID | NT Length | AA Length | Score | Probability |
|---|---|---|---|---|---|---|
| 10437958_c3_133 | 1165 | 6387 | 135 | 408 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 10647055_f2_17 | 1166 | 6388 | 263 | 792 | 124 | 5.7e−06 |

| Protein name | Locus Name | Acc# |
|---|---|---|
| transcription regulator, crp family | pir:F72285 | F72285 |

Description

| ORF Name | NTID | AAID | NT Length | AA Length | Score | Probability |
|---|---|---|---|---|---|---|
| 1406526_c2_128 | 1167 | 6389 | 417 | 1254 | 876 | 1.3e−87 |

| Protein name | Locus Name | Acc# |
|---|---|---|
| | sp:PATB_BACSU | Q08432 |

Description

PUTATIVE AMINOTRANSFERASE B,

| ORF Name | NTID | AAID | NT Length | AA Length | Score | Probability |
|---|---|---|---|---|---|---|
| 14494530_f1_6 | 1168 | 6390 | 862 | 2589 | 169 | 1.2e−08 |

| Protein name | Locus Name | Acc# |
|---|---|---|
| outer membrane assembly protein (asmA) RP347 | pir:E71691 | E71691 |

Description

| ORF Name | NTID | AAID | NT Length | AA Length | Score | Probability |
|---|---|---|---|---|---|---|
| 14648577_c1_93 | 1169 | 6391 | 368 | 1107 | 174 | 1.1e−10 |

| Protein name | Locus Name | Acc# |
|---|---|---|
| transmembrane sensor | gp:AF051691 | AF051691 |

Description

*Pseudomonas aeruginosa* stress factor A (psfA), ECF sigma factor (fiuI), transmembrane sensor (fiuR), and hydroxamate-typeferrisiderophore receptor (fiuA) genes, complete cds.

| ORF Name | NTID | AAID | NT Length | AA Length | Score | Probability |
|---|---|---|---|---|---|---|
| 14875635_c3_139 | 1170 | 6392 | 313 | 942 | 602 | 1.4e−58 |

| Protein name | Locus Name | Acc# |
|---|---|---|
| conserved hypothetical protein ytqA | pir:D69999 | D69999 |

Description

| ORF Name | NTID | AAID | NT Length | AA Length | Score | Probability |
|---|---|---|---|---|---|---|
| 20088937_f1_11 | 1171 | 6393 | 292 | 879 | 717 | 9.2e−71 |

| Protein name | Locus Name | Acc# |
|---|---|---|
| lipoic acid synthase | pir:A75480 | A75480 |

Description

| ORF Name | NTID | AAID | NT Length | AA Length | Score | Probability |
|---|---|---|---|---|---|---|
| 22478311_c3_145 | 1172 | 6394 | 149 | 450 | | |

| Protein name | Locus Name | Acc# |
|---|---|---|
| | | |

Decsription

NO-HIT

| ORF Name | NTID | AAID | NT Length | AA Length | Score | Probability |
|---|---|---|---|---|---|---|
| 22708153_c3_132 | 1173 | 6395 | 364 | 1095 | 317 | 2.2e−28 |

| Protein name | Locus Name | Acc# |
|---|---|---|
| GldB | gp:AF158732 | AF158372 |

Description

*Flavobacterium johnsoniae* hypothetical protein gene, partial cds; GldB (gldB), GldC (gldC), and hypothetical protein genes, complete cds; and hypothetical protein gene, partial cds.

| ORF Name | NTID | AAID | NT Length | AA Length | Score | Probability |
|---|---|---|---|---|---|---|
| 23620910_c2_111 | 1174 | 6396 | 85 | 258 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24337765_f3_68 | 1175 | 6397 | 904 | 2712 | 432 | 9.6e−68 |

| Protein name | Locus Name | Acc# |
|---|---|---|
| 115K outer membrane protein precursor:SusC protein | pir:JC6027 | JC6027 |

Description

| ORF Name | NTID | AAID | NT Length | AA Length | Score | Probability |
|---|---|---|---|---|---|---|
| 24431510_c3_137 | 1176 | 6398 | 243 | 732 | 108 | 0.00085 |

| Protein name | Locus Name | Acc# |
|---|---|---|
| hypothetical protein yvqF | pir:G70045 | G70045 |

Description

| ORF Name | NTID | AAID | NT Length | AA Length | Score | Probability |
|---|---|---|---|---|---|---|
| 24695187_c2_110 | 1177 | 6399 | 274 | 825 | 998 | 1.5e−100 |

| Protein name | Locus Name | Acc# |
|---|---|---|
| | sp:NAGB_BORBU | O30564 |

Description

PHOSPHATE DEAMINASE) (GNPDA) (GLCN6P DEAMINASE)

-continued

| ORF Name | NTID | AAID | NT Length | AA Length | Score | Probability |
|---|---|---|---|---|---|---|
| 2814055_c2_99 | 1178 | 6400 | 320 | 963 | 304 | 5.4e-27 |
| Protein name | | | Locus Name | | | Acc# |
| enoyl-acyl carrier protein reductase | | | pir:H75330 | | | H75330 |
| Description | | | | | | |

| ORF Name | NTID | AAID | NT Length | AA Length | Score | Probability |
|---|---|---|---|---|---|---|
| 2869825_c2_103 | 1179 | 6401 | 157 | 474 | 143 | 6.2e-10 |
| Protein name | | | Locus Name | | | Acc# |
| hypothetical protein APE2345 | | | pir:F72462 | | | F72462 |
| Description | | | | | | |

| ORF Name | NTID | AAID | NT Length | AA Length | Score | Probability |
|---|---|---|---|---|---|---|
| 30470261_c3_143 | 1180 | 6402 | 369 | 1110 | 562 | 2.5e-54 |
| Protein name | | | Locus Name | | | Acc# |
| O-acetylhomoserine sulfhydrylase | | | pir:D72324 | | | D72324 |
| Description | | | | | | |

| ORF Name | NTID | AAID | NT Length | AA Length | Score | Probability |
|---|---|---|---|---|---|---|
| 3256642_c2_97 | 1181 | 6403 | 66 | 201 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 36360812_f2_36 | 1182 | 6404 | 374 | 1125 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 36406537_f1_5 | 1183 | 6405 | 673 | 2022 | 344 | 2.8e-40 |
| Protein name | | | Locus Name | | | Acc# |
| | | | gp:SC9745 | | | |
| Description | | | | | | |
| *S. cerevisiae* chromosome XIII cosmid 9745. | | | | | | |

| ORF Name | NTID | AAID | NT Length | AA Length | Score | Probability |
|---|---|---|---|---|---|---|
| 3944711_f3_52 | 1184 | 6406 | 207 | 624 | 399 | 4.6e-37 |
| Protein name | | | Locus Name | | | Acc# |
| probable translation factor yciO | | | pir:F64874 | | | F64874 |
| Description | | | | | | |

| ORF Name | NTID | AAID | NT Length | AA Length | Score | Probability |
|---|---|---|---|---|---|---|
| 3946886_f3_53 | 1185 | 6407 | 144 | 435 | 114 | 7.3e−07 |

| Protein name | Locus Name | Acc# |
|---|---|---|
| maturation protein pPM32 | gp:AF166485 | AF166485 |

Description

Glycine max maturation protein pPM32 (PM32) mRNA, complete cds.

| ORF Name | NTID | AAID | NT Length | AA Length | Score | Probability |
|---|---|---|---|---|---|---|
| 4007687_f1_10 | 1186 | 6408 | 745 | 2238 | 1937 | 4.8e−200 |

| Protein name | Locus Name | Acc# |
|---|---|---|
| DPP IV | gp:AB008194 | AB008194 |

Description

Porphyromonas gingivalis gene or DDP IV, complete cds.

| ORF Name | NTID | AAID | NT Length | AA Length | Score | Probability |
|---|---|---|---|---|---|---|
| 4119037_c3_138 | 1187 | 6409 | 281 | 846 | 134 | 9.7e−07 |

| Protein name | Locus Name | Acc# |
|---|---|---|
| two-component response regulator lytT-involved | pir:B69655 | B69655 |

Description

| ORF Name | NTID | AAID | NT Length | AA Length | Score | Probability |
|---|---|---|---|---|---|---|
| 4960937_c2_109 | 1188 | 6410 | 402 | 1209 | 524 | 2.6e−50 |

| Protein name | Locus Name | Acc# |
|---|---|---|
| hypothetical protein b2710 | pir:B65051 | B65051 |

Description

| ORF Name | NTID | AAID | NT Length | AA Length | Score | Probability |
|---|---|---|---|---|---|---|
| 6772836_f3_47 | 1189 | 6411 | 292 | 879 | 376 | 1.3e−34 |

| Protein name | Locus Name | Acc# |
|---|---|---|
| conserved hypothetical protein ykrA | pir:C69862 | C69862 |

Description

| ORF Name | NTID | AAID | NT Length | AA Length | Score | Probability |
|---|---|---|---|---|---|---|
| 969812_c3_144 | 1190 | 6412 | 204 | 615 | 164 | 3.7e−12 |

| Protein name | Locus Name | Acc# |
|---|---|---|
| RNA polymerase ECF-type sigma factor homolog yhdM | pir:C69826 | C69826 |

Description

-continued

| ORF Name | NTID | AAID | NT Length | AA Length | Score | Probability |
|---|---|---|---|---|---|---|
| 975405_c2_100 | 1191 | 6413 | 245 | 738 | 339 | 1.0e−30 |

| Protein name | Locus Name | Acc# |
|---|---|---|
| sam-dependent methytransferase | pir:C72086 | C72086 |

Description

| ORF Name | NTID | AAID | NT Length | AA Length | Score | Probability |
|---|---|---|---|---|---|---|
| 10011662_c1_209 | 1192 | 6414 | 458 | 1374 | 922 | 1.7e−92 |

| Protein name | Locus Name | Acc# |
|---|---|---|
| | sp:PRIA_BACSU | |

Description

PRIMOSOMAL PROTEIN N' (REPLICATION FACTOR Y)

| ORF Name | NTID | AAID | NT Length | AA Length | Score | Probability |
|---|---|---|---|---|---|---|
| 10350927_f3_138 | 1193 | 6415 | 510 | 1533 | 172 | 5.8e−16 |

| Protein name | Locus Name | Acc# |
|---|---|---|
| hypothetical protein MJ0749 | pir:E64393 | E64393 |

Description

| ORF Name | NTID | AAID | NT Length | AA Length | Score | Probability |
|---|---|---|---|---|---|---|
| 11767812_f1_20 | 1194 | 6416 | 265 | 798 | 281 | 1.5e−24 |

| Protein name | Locus Name | Acc# |
|---|---|---|
| two-component response regulator lytT-involved | pir:B69655 | B69655 |

Description

| ORF Name | NTID | AAID | NT Length | AA Length | Score | Probability |
|---|---|---|---|---|---|---|
| 1204052_f1_26 | 1195 | 6417 | 280 | 843 | 131 | 3.5e−08 |

| Protein name | Locus Name | Acc# |
|---|---|---|
| | sp:YGEK_ECOLI | Q46791 |

Description

HYPOTHETICAL TRANSCRIPTIONAL REGULATOR IN KDUI-LYSS INTERGENIC REGION

| ORF Name | NTID | AAID | NT Length | AA Length | Score | Probability |
|---|---|---|---|---|---|---|
| 13729582_f1_24 | 1196 | 6418 | 195 | 588 | 128 | 2.4e−08 |

| Protein name | Locus Name | Acc# |
|---|---|---|
| hypothetical protein | pir:C72325 | C72325 |

Description

-continued

| ORF Name | NTID | AAID | NT Length | AA Length | Score | Probability |
|---|---|---|---|---|---|---|
| 13773262_f1_41 | 1197 | 6419 | 87 | 264 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 14252182_f1_45 | 1198 | 6420 | 212 | 639 | 222 | 2.6e−18 |

| Protein name | | | Locus Name | | | Acc# |
|---|---|---|---|---|---|---|
| resolvase | | | pir:S38652 | | | S38652 |

Description

| ORF Name | NTID | AAID | NT Length | AA Length | Score | Probability |
|---|---|---|---|---|---|---|
| 14354025_f1_1 | 1199 | 6421 | 447 | 1344 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 14570301_f2_66 | 1200 | 6422 | 65 | 198 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 14928462_c3_289 | 1201 | 6423 | 63 | 192 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 16673406_f2_95 | 1202 | 6424 | 419 | 1260 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 16832885_c1_170 | 1203 | 6425 | 431 | 1296 | 1723 | 2.3e−177 |

| Protein name | | | Locus Name | | | Acc# |
|---|---|---|---|---|---|---|
| hypothetical protein | | | pir:JQ1020 | | | JQ1020 |

Description

-continued

| ORF Name | NTID | AAID | NT Length | AA Length | Score | Probability |
|---|---|---|---|---|---|---|
| 19614050_c1_162 | 1204 | 6426 | 165 | 498 | | |
| Protein name | | | Locus Name | | Acc# | |
| Description | | | | | | |
| NO-HIT | | | | | | |

| ORF Name | NTID | AAID | NT Length | AA Length | Score | Probability |
|---|---|---|---|---|---|---|
| 19735306_f2_97 | 1205 | 6427 | 65 | 198 | 63 | 0.045 |
| Protein name | | | Locus Name | | Acc# | |
| | | | sp:SRD2_CAEEL | | Q21767 | |
| Description | | | | | | |
| SRD-2 PROTEIN | | | | | | |

| ORF Name | NTID | AAID | NT Length | AA Length | Score | Probability |
|---|---|---|---|---|---|---|
| 19773437_f3_126 | 1206 | 6428 | 64 | 195 | | |
| Protein name | | | Locus Name | | Acc# | |
| Description | | | | | | |
| NO-HIT | | | | | | |

| ORF Name | NTID | AAID | NT Length | AA Length | Score | Probability |
|---|---|---|---|---|---|---|
| 20328267_c1_164 | 1207 | 6429 | 66 | 201 | | |
| Protein name | | | Locus Name | | Acc# | |
| Description | | | | | | |
| NO HIT | | | | | | |

| ORF Name | NTID | AAID | NT Length | AA Length | Score | Probability |
|---|---|---|---|---|---|---|
| 20390875_f3_151 | 1208 | 6430 | 192 | 579 | 193 | 3.1e−15 |
| Protein name | | | Locus Name | | Acc# | |
| conserved hypothetical protein | | | pir:E72312 | | E72312 | |
| Description | | | | | | |

| ORF Name | NTID | AAID | NT Length | AA Length | Score | Probability |
|---|---|---|---|---|---|---|
| 20437675_c2_241 | 1209 | 6431 | 235 | 708 | | |
| Protein name | | | Locus Name | | Acc# | |
| Description | | | | | | |
| NO-HIT | | | | | | |

| ORF Name | NTID | AAID | NT Length | AA Length | Score | Probability |
|---|---|---|---|---|---|---|
| 20703426_f2_94 | 1210 | 6432 | 67 | 204 | | |
| Protein name | | | Locus Name | | Acc# | |
| Description | | | | | | |
| NO-HIT | | | | | | |

-continued

| ORF Name | NTID | AAID | NT Length | AA Length | Score | Probability |
|---|---|---|---|---|---|---|
| 20723160_c2_218 | 1211 | 6433 | 240 | 723 | 138 | 3.3e−09 |
| Protein name | | | | Locus Name | | Acc# |
| conserved hypothetical protein HP0713 | | | | pir:A64609 | | A64609 |

Description

| ORF Name | NTID | AAID | NT Length | AA Length | Score | Probability |
|---|---|---|---|---|---|---|
| 20976426_f3_114 | 1212 | 6434 | 91 | 276 | 124 | 3.9e−07 |
| Protein name | | | | Locus Name | | Acc# |
| asparaginase homolog yccC | | | | pir:F69754 | | F69754 |

Description

| ORF Name | NTID | AAID | NT Length | AA Length | Score | Probability |
|---|---|---|---|---|---|---|
| 21647925_f1_7 | 1213 | 6435 | 459 | 1380 | 1231 | 3.1e−125 |
| Protein name | | | | Locus Name | | Acc# |
| | | | | sp:DCUB_HAEIN | | P44855 |

Description

ANAEROBIC C4-DICARBOXYLATE TRANSPORTER DCUB

| ORF Name | NTID | AAID | NT Length | AA Length | Score | Probability |
|---|---|---|---|---|---|---|
| 21992175_f3_177 | 1214 | 6436 | 327 | 984 | 84 | 0.0070 |
| Protein name | | | | Locus Name | | Acc# |
| putative transmembrane efflux protein. | | | | gp:SCF91 | | AL132973 |

Description

*Streptomyces coelicolor* cosmid F91.

| ORF Name | NTID | AAID | NT Length | AA Length | Score | Probability |
|---|---|---|---|---|---|---|
| 22860128_c2_219 | 1215 | 6437 | 83 | 252 | 64 | 0.031 |
| Protein name | | | | Locus Name | | Acc# |
| | | | | sp:SPRC_XENLA | | P36378 |

Description (OSTEONECTIN) (ON) (BASEMENT MEMBRANE PROTEIN BM-40)

| ORF Name | NTID | AAID | NT Length | AA Length | Score | Probability |
|---|---|---|---|---|---|---|
| 23617137_c3_268 | 1216 | 6438 | 224 | 675 | 267 | 4.5e−23 |
| Protein name | | | | Locus Name | | Acc# |
| | | | | sp:YJV7_YEAST | | P40893 |

Description

HYPOTHETICAL 22.0 KD PROTEIN IN HXT11-HXT8 INTERGENIC REGION

-continued

| ORF Name | NTID | AAID | NT Length | AA Length | Score | Probability |
|---|---|---|---|---|---|---|
| 23631252_c2_239 | 1217 | 6439 | 229 | 690 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 23631550_c1_174 | 1218 | 6440 | 123 | 372 | 125 | 5.0e−08 |

| Protein name | | | | Locus Name | | Acc# |
|---|---|---|---|---|---|---|
| hypothetical protein MJ1618 | | | | pir:A64502 | | A64502 |

Description

| ORF Name | NTID | AAID | NT Length | AA Length | Score | Probability |
|---|---|---|---|---|---|---|
| 2362787_c1_193 | 1219 | 6441 | 314 | 945 | 110 | 3.6e−05 |

| Protein name | | | | Locus Name | | Acc# |
|---|---|---|---|---|---|---|
| probable integrase/recombinase | | | | pir:B71194 | | B71194 |

Description

| ORF Name | NTID | AAID | NT Length | AA Length | Score | Probability |
|---|---|---|---|---|---|---|
| 24009637_c3_256 | 1220 | 6442 | 76 | 231 | 67 | 0.025 |

| Protein name | | | | Locus Name | | Acc# |
|---|---|---|---|---|---|---|
| | | | | sp:VE2_HPV38 | | Q80910 |

Description

REGULATORY PROTEIN E2

| ORF Name | NTID | AAID | NT Length | AA Length | Score | Probability |
|---|---|---|---|---|---|---|
| 24066056_f3_155 | 1221 | 6443 | 91 | 276 | 134 | 5.5e−09 |

| Protein name | | | | Locus Name | | Acc# |
|---|---|---|---|---|---|---|
| | | | | sp:CEBA_BACAM | | P23939 |

Description

BAMHI CONTROL ELEMENT

| ORF Name | NTID | AAID | NT Length | AA Length | Score | Probability |
|---|---|---|---|---|---|---|
| 24236057_f2_73 | 1222 | 6444 | 60 | 183 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 24353391_f1_40 | 1223 | 6445 | 153 | 462 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24394017_f3_153 | 1224 | 6446 | 63 | 192 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24485932_c3_279 | 1225 | 6447 | 848 | 2547 | 106 | 0.0070 |

| Protein name | | | | Locus Name | | Acc# |
|---|---|---|---|---|---|---|
| arylesterase | | | | gp:AF044683 | | AF044683 |

Description

*Agrobacterium radiobacter* putative dihydrolipoamideS-acetyltransferase (dla) gene, partial cds; arylesterase (ada) gene, complete cds; and putative dihydrolipoamide dehydrogenase (dlh) gene, partial cds.

| ORF Name | NTID | AAID | NT Length | AA Length | Score | Probability |
|---|---|---|---|---|---|---|
| 2461567_c3_281 | 1226 | 6448 | 73 | 222 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24640807_f2_53 | 1227 | 6449 | 397 | 1194 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24882203_f1_29 | 1228 | 6450 | 62 | 189 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 24882932_c1_175 | 1229 | 6451 | 178 | 537 | 348 | 1.2e−31 |

| Protein name | Locus Name | Acc# |
|---|---|---|
| adaptive response regulatory protein | gp:AF047839 | AF047839 |

Description

*Pseudoalteromonas* sp. S9 putative glucosyl hydrolase precursor and adaptive response regulatory protein (ada) genes, complete cds.

| ORF Name | NTID | AAID | NT Length | AA Length | Score | Probability |
|---|---|---|---|---|---|---|
| 2531640_c2_242 | 1230 | 6452 | 200 | 603 | 352 | 4.4e−32 |

| Protein name | Locus Name | Acc# |
|---|---|---|
| unknown | gp:AF006034 | AF006034 |

Description

*Clostridium pasteurianum* 1,3-propanediol dehydrogenase (dhaT) gene, complete cds.

| ORF Name | NTID | AAID | NT Length | AA Length | Score | Probability |
|---|---|---|---|---|---|---|
| 25578438_f2_86 | 1231 | 6453 | 78 | 237 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 25914666_f3_147 | 1232 | 6454 | 92 | 279 | 86 | 0.010 |

| Protein name | Locus Name | Acc# |
|---|---|---|
| probable serine-threonine-protein kinase | pir:T41341 | T41341 |

Description

| ORF Name | NTID | AAID | NT Length | AA Length | Score | Probability |
|---|---|---|---|---|---|---|
| 26178177_c2_221 | 1233 | 6455 | 172 | 519 | 126 | 3.9e−08 |

| Protein name | Locus Name | Acc# |
|---|---|---|
| hypothetical protein MTH847 | pir:A69213 | A69213 |

Description

| ORF Name | NTID | AAID | NT Length | AA Length | Score | Probability |
|---|---|---|---|---|---|---|
| 26306637_c3_297 | 1234 | 6456 | 448 | 1347 | 303 | 3.0e−24 |

| Protein name | Locus Name | Acc# |
|---|---|---|
| | sp:PRIA_BACSU | |

Description

PRIMOSOMAL PROTEIN N' (REPLICATION FACTOR Y)

-continued

| ORF Name | NTID | AAID | NT Length | AA Length | Score | Probability |
|---|---|---|---|---|---|---|
| 26360312_c3_290 | 1235 | 6457 | 328 | 987 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 26369028_f1_8 | 1236 | 6458 | 323 | 972 | 912 | 2.0e−91 |

| Protein name | | | | Locus Name | | Acc# |
|---|---|---|---|---|---|---|
| | | | | sp:ASG2_ECOLI | | P00805 |

Description

AMIDOHYDROLASE II) (L-ASNASE II) (COLASPASE)

| ORF Name | NTID | AAID | NT Length | AA Length | Score | Probability |
|---|---|---|---|---|---|---|
| 26460937_f2_102 | 1237 | 6459 | 392 | 1179 | 590 | 2.6e−57 |

| Protein name | | | | Locus Name | | Acc# |
|---|---|---|---|---|---|---|
| mannose-1-phosphate guanylyltransferase | | | | pir:H72303 | | H72303 |

Description

| ORF Name | NTID | AAID | NT Length | AA Length | Score | Probability |
|---|---|---|---|---|---|---|
| 26593800_c3_267 | 1238 | 6460 | 197 | 594 | 580 | 3.0e−56 |

| Protein name | | | | Locus Name | | Acc# |
|---|---|---|---|---|---|---|
| | | | | sp:YJV8_YEAST | | P40892 |

Description (EC 2.3.1.—)

| ORF Name | NTID | AAID | NT Length | AA Length | Score | Probability |
|---|---|---|---|---|---|---|
| 26595192_f1_22 | 1239 | 6461 | 462 | 1389 | 534 | 2.3e−51 |

| Protein name | | | | Locus Name | | Acc# |
|---|---|---|---|---|---|---|
| oxidoreductase, aldo/keto reductase family | | | | pir:E72284 | | E72284 |

Description

| ORF Name | NTID | AAID | NT Length | AA Length | Score | Probability |
|---|---|---|---|---|---|---|
| 26601062_c3_259 | 1240 | 6462 | 61 | 186 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 29328501_f3_131 | 1241 | 6463 | 66 | 201 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 31723562_c2_248 | 1242 | 6464 | 385 | 1158 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 3320802_c3_294 | 1243 | 6465 | 77 | 234 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 33245255_c1_188 | 1244 | 6466 | 261 | 786 | 103 | 0.014 |

| Protein name | | | Locus Name | | | Acc# |
|---|---|---|---|---|---|---|
| hypothetical protein 2 | | | pir:S49113 | | | S49113 |

Description

| ORF Name | NTID | AAID | NT Length | AA Length | Score | Probability |
|---|---|---|---|---|---|---|
| 34078300_f3_152 | 1245 | 6467 | 284 | 855 | 182 | 6.3e-12 |

| Protein name | | | Locus Name | | | Acc# |
|---|---|---|---|---|---|---|
| integrase | | | gp:BFU75371 | | | U75371 |

Description

*Bacteroides fragilis* transposon Tn4555 TnpA (tnpA), integrase (int), TnpC (tnpC), excisionase (xis), mobilization protein (mobA), and beta-lactamase (cfxA) genes, complete cds; and unknown genes.

| ORF Name | NTID | AAID | NT Length | AA Length | Score | Probability |
|---|---|---|---|---|---|---|
| 34104127_f3_141 | 1246 | 6468 | 808 | 2427 | 274 | 3.0e-20 |

| Protein name | | | Locus Name | | | Acc# |
|---|---|---|---|---|---|---|
| | | | sp:IRGA_VIBCH | | | P27772 |

Description

IRON-REGULATED OUTER MEMBRANE VIRULENCE PROTEIN PRECURSOR

-continued

| ORF Name | NTID | AAID | NT Length | AA Length | Score | Probability |
|---|---|---|---|---|---|---|
| 34260911_f3_150 | 1247 | 6469 | 166 | 501 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 35314080_f2_65 | 1248 | 6470 | 716 | 2151 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 35704786_f2_92 | 1249 | 6471 | 92 | 279 | 326 | 2.5e−29 |

| Protein name | | | | Locus Name | | Acc# |
|---|---|---|---|---|---|---|
| integrase IntN1 | | | | gp:BUU51917 | | U51917 |

Description

*Bacteroides uniformis* insertion element NBU1 fragment, integrase IntN1 gene, complete cds.

| ORF Name | NTID | AAID | NT Length | AA Length | Score | Probability |
|---|---|---|---|---|---|---|
| 3938817_c2_247 | 1250 | 6472 | 480 | 1443 | 1319 | 1.5e−134 |

| Protein name | | | | Locus Name | | Acc# |
|---|---|---|---|---|---|---|
| aspartate ammonia-lyase | | | | gp:WSAJ2933 | | AJ002933 |

Description

*Wolinella succinogenes* aspA, dcuA genes and partial ansA gene.

| ORF Name | NTID | AAID | NT Length | AA Length | Score | Probability |
|---|---|---|---|---|---|---|
| 3940943_f2_74 | 1251 | 6473 | 355 | 1068 | 180 | 2.8e−11 |

| Protein name | | | | Locus Name | | Acc# |
|---|---|---|---|---|---|---|
| AlgZ | | | | gp:PAU52431 | | U52431 |

Description

*Pseudomonas aeruginosa* AlgR-cognate sensor AlgZ (algZ) gene, complete cds.

| ORF Name | NTID | AAID | NT Length | AA Length | Score | Probability |
|---|---|---|---|---|---|---|
| 4000953_f2_87 | 1252 | 6474 | 301 | 906 | 147 | 3.1e−08 |

| Protein name | | | | Locus Name | | Acc# |
|---|---|---|---|---|---|---|
| transcription regulator | | | | gp:AF008220 | | AF008220 |

Description

*Bacillus subtilis* rrnB-dnaB genomic region.

-continued

| ORF Name | NTID | AAID | NT Length | AA Length | Score | Probability |
|---|---|---|---|---|---|---|
| 4072187_c1_172 | 1253 | 6475 | 587 | 1764 | 483 | 9.3e−95 |

| Protein name | Locus Name | Acc# |
|---|---|---|
|  | sp:DXS_BACSU | P54523 |

Description

PROBABLE 1-DEOXYXYLULOSE-5-PHOSPHATE SYNTHASE (DXP SYNTHASE)

| ORF Name | NTID | AAID | NT Length | AA Length | Score | Probability |
|---|---|---|---|---|---|---|
| 423162_c1_207 | 1254 | 6476 | 221 | 666 |  |  |

| Protein name | Locus Name | Acc# |
|---|---|---|
|  |  |  |

Description

NO-HIT

| ORF Name | NTID | AAID | NT Length | AA Length | Score | Probability |
|---|---|---|---|---|---|---|
| 4345337_f3_110 | 1255 | 6477 | 401 | 1206 | 143 | 3.8e−09 |

| Protein name | Locus Name | Acc# |
|---|---|---|
|  | gP:ECASPA | X02307 |

Description

*E. coli* aspA gene for aspartase (L-aspartate ammonia-lyase_ (EC4.3.1.1).

| ORF Name | NTID | AAID | NT Length | AA Length | Score | Probability |
|---|---|---|---|---|---|---|
| 4454000_c2_238 | 1256 | 6478 | 806 | 2421 | 171 | 1.0e−08 |

| Protein name | Locus Name | Acc# |
|---|---|---|
| R27-2 protein | pir:T30296 | T30296 |

Description

| ORF Name | NTID | AAID | NT Length | AA Length | Score | Probability |
|---|---|---|---|---|---|---|
| 4960312_f1_46 | 1257 | 6479 | 523 | 1572 | 227 | 7.2e−16 |

| Protein name | Locus Name | Acc# |
|---|---|---|
| putative integrase | gp:BA1242593 | AJ242593 |

Description

Bacteriophage A118 complete genome.

| ORF Name | NTID | AAID | NT Length | AA Length | Score | Probability |
|---|---|---|---|---|---|---|
| 579712_f1_42 | 1258 | 6480 | 339 | 1020 |  |  |

| Protein name | Locus Name | Acc# |
|---|---|---|
|  |  |  |

Description

NO-HIT

-continued

| ORF Name | NTID | AAID | NT Length | AA Length | Score | Probability |
|---|---|---|---|---|---|---|
| 6728452_c3_293 | 1259 | 6481 | 87 | 264 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 867688_f3_136 | 1260 | 6482 | 206 | 621 | 243 | 1.6e−20 |
| Protein name | | | Locus Name | | | Acc# |
| hypothetical protein slr2078 | | | pir:S77566 | | | S77566 |
| Description | | | | | | |

| ORF Name | NTID | AAID | NT Length | AA Length | Score | Probability |
|---|---|---|---|---|---|---|
| 9800466_c1_192 | 1261 | 6483 | 63 | 192 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 994002_f2_99 | 1262 | 6484 | 197 | 594 | 92 | 0.00034 |
| Protein name | | | Locus Name | | | Acc# |
| probable prefoldin subunit APE1440 | | | pir:G72622 | | | G72622 |
| Description | | | | | | |

| ORF Name | NTID | AAID | NT Length | AA Length | Score | Probability |
|---|---|---|---|---|---|---|
| 10647550_f2_40 | 1263 | 6485 | 812 | 2439 | 498 | 2.7e−45 |
| Protein name | | | Locus Name | | | Acc# |
| putative transmembrane protein Wzc | | | gp:AF104912 | | | AF104912 |
| Description | | | | | | |

*Escherichia coli* K30 capsule biosynthesis cluster, partial sequence.

| ORF Name | NTID | AAID | NT Length | AA Length | Score | Probability |
|---|---|---|---|---|---|---|
| 10985663_f1_25 | 1264 | 6486 | 101 | 306 | 75 | 0.034 |
| Protein name | | | Locus Name | | | Acc# |
| nuclear factor kappa-B2 | | | gp:HSU20816 | | | U20816 |
| Description | | | | | | |

Human nuclear factor kappa-B2 (NK-KB2) gene, partial cds.

-continued

| ORF Name | NTID | AAID | NT Length | AA Length | Score | Probability |
|---|---|---|---|---|---|---|
| 133301_f2_28 | 1265 | 6487 | 588 | 1767 | 1406 | 9.0e−144 |

| Protein name | | | | Locus Name | | Acc# |
|---|---|---|---|---|---|---|
| | | | | sp:SYQ_ECOLI | | |

Description (GLNRS)

| ORF Name | NTID | AAID | NT Length | AA Length | Score | Probability |
|---|---|---|---|---|---|---|
| 1350033_f1_11 | 1266 | 6488 | 224 | 675 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 1381287_c2_91 | 1267 | 6489 | 172 | 519 | 470 | 1.4e−44 |

| Protein name | | | | Locus Name | | Acc# |
|---|---|---|---|---|---|---|
| | | | | sp:TPX_MYCTU | | P95282 |

Description

PROBABLE THIOL PEROXIDASE,

| ORF Name | NTID | AAID | NT Length | AA Length | Score | Probability |
|---|---|---|---|---|---|---|
| 13859702_f3_54 | 1268 | 6490 | 379 | 1140 | 181 | 3.8e−11 |

| Protein name | | | | Locus Name | | Acc# |
|---|---|---|---|---|---|---|
| transposase | | | | gp:AF038866 | | AF038866 |

Description

*Bacteroides fragilis* transposon Tn5520 transposase (bipH) and mobilization protein BmpH (bmpH) genes, complete cds.

| ORF Name | NTID | AAID | NT Length | AA Length | Score | Probability |
|---|---|---|---|---|---|---|
| 13945437_c3_98 | 1269 | 6491 | 155 | 468 | 86 | 0.00077 |

| Protein name | | | | Locus Name | | Acc# |
|---|---|---|---|---|---|---|
| | | | | sp:DBH_THEMA | | P36206 |

Description

DNA-BINDING PROTEIN HU

| ORF Name | NTID | AAID | NT Length | AA Length | Score | Probability |
|---|---|---|---|---|---|---|
| 15738937_f1_24 | 1270 | 6492 | 104 | 315 | | |

| Protein name | | | | Locus Name | | Acc# |
|---|---|---|---|---|---|---|

Description

NO-HIT

-continued

| ORF Name | NTID | AAID | NT Length | AA Length | Score | Probability |
|---|---|---|---|---|---|---|
| 15909682_f3_52 | 1271 | 6493 | 212 | 639 | 137 | 1.9e−08 |

| Protein name | Locus Name | Acc# |
|---|---|---|
| hypothetical protein Rv1624c | pir:F70558 | F70558 |

Description

| ORF Name | NTID | AAID | NT Length | AA Length | Score | Probability |
|---|---|---|---|---|---|---|
| 23475200_f1_8 | 1272 | 6494 | 482 | 1449 | 179 | 1.1e−10 |

| Protein name | Locus Name | Acc# |
|---|---|---|
| conserved hypothetical protein MTH72 | pir:B69196 | B69196 |

Description

| ORF Name | NTID | AAID | NT Length | AA Length | Score | Probability |
|---|---|---|---|---|---|---|
| 24070786_c2_97 | 1273 | 6495 | 254 | 762 | 356 | 1.7e−32 |

| Protein name | Locus Name | Acc# |
|---|---|---|
| | sp:YQGH_BACSU | P46339 |

Description

REGION (ORF72)

| ORF Name | NTID | AAID | NT Length | AA Length | Score | Probability |
|---|---|---|---|---|---|---|
| 26438887_c3_100 | 1274 | 6496 | 424 | 1275 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 29947188_f1_15 | 1275 | 6497 | 62 | 189 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 30563966_f1_20 | 1276 | 6498 | 153 | 462 | 121 | 1.3e−07 |

| Protein name | Locus Name | Acc# |
|---|---|---|
| hypothetical protein | pir:T28682 | T28682 |

Description

-continued

| ORF Name | NTID | AAID | NT Length | AA Length | Score | Probability |
|---|---|---|---|---|---|---|
| 34179077_f1_16 | 1277 | 6499 | 262 | 789 | 170 | 1.2e−10 |

| Protein name | Locus Name | Acc# |
|---|---|---|
| | sp:EPSA_BURSO | Q45407 |

Description

EPS I POLYSACCHARIDE EXPORT OUTER MEMBRANE PROTEIN EPSA PRECURSOR

| ORF Name | NTID | AAID | NT Length | AA Length | Score | Probability |
|---|---|---|---|---|---|---|
| 36131937_c1_78 | 1278 | 6500 | 149 | 450 | 123 | 2.5e−07 |

| Protein name | Locus Name | Acc# |
|---|---|---|
| phosphate-binding protein PstS | pir:H69097 | H69097 |

Description

| ORF Name | NTID | AAID | NT Length | AA Length | Score | Probability |
|---|---|---|---|---|---|---|
| 4176337_f3_55 | 1279 | 6501 | 470 | 1413 | 656 | 2.7e−64 |

| Protein name | Locus Name | Acc# |
|---|---|---|
| GumD protein | pir:S67820 | S67820 |

Description

| ORF Name | NTID | AAID | NT Length | AA Length | Score | Probability |
|---|---|---|---|---|---|---|
| 4744002_c2_89 | 1280 | 6502 | 198 | 597 | 249 | 3.6e−21 |

| Protein name | Locus Name | Acc# |
|---|---|---|
| hypothetical protein (repA 5' region) | pir:S30120 | S30120 |

Description

| ORF Name | NTID | AAID | NT Length | AA Length | Score | Probability |
|---|---|---|---|---|---|---|
| 4867127_f2_31 | 1281 | 6503 | 216 | 651 | 308 | 2.0e−27 |

| Protein name | Locus Name | Acc# |
|---|---|---|
| DedA family protein | pir:B75253 | B75253 |

Description

| ORF Name | NTID | AAID | NT Length | AA Length | Score | Probability |
|---|---|---|---|---|---|---|
| 6721890_c3_99 | 1282 | 6504 | 163 | 492 | 270 | 2.1e−23 |

| Protein name | Locus Name | Acc# |
|---|---|---|
| N-acetylmuramoyl-L-alanine amidase homolog | pir:G64126 | G64126 |

Description

| ORF Name | NTID | AAID | NT Length | AA Length | Score | Probability |
|---|---|---|---|---|---|---|
| 7313162_f1_4 | 1283 | 6505 | 285 | 858 | 410 | 3.1e−28 |

| Protein name | Locus Name | Acc# |
|---|---|---|
| phosphate-binding protein PstS | pir:H69097 | H69097 |

Description

-continued

| ORF Name | NTID | AAID | NT Length | AA Length | Score | Probability |
|---|---|---|---|---|---|---|
| 1212751_c1_87 | 1284 | 6506 | 147 | 444 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 14103176_c3_114 | 1285 | 6507 | 681 | 2046 | 246 | 2.5e−34 |

| Protein name | | | | Locus Name | | Acc# |
|---|---|---|---|---|---|---|
| | | | | gp:PGU60208 | | U60208 |

Description

*Porphyromonas gingivalis* orf1, orf2 and orf3 genes, complete cds.

| ORF Name | NTID | AAID | NT Length | AA Length | Score | Probability |
|---|---|---|---|---|---|---|
| 179762_c2_94 | 1286 | 6508 | 399 | 1200 | 465 | 9.2e−62 |

| Protein name | | | | Locus Name | | Acc# |
|---|---|---|---|---|---|---|
| | | | | sp:YBDG_ECOLI | | |

Description

HYPOTHETICAL 46.6 KD PROTEIN IN PHEP-NFNB INTERGENIC REGION

| ORF Name | NTID | AAID | NT Length | AA Length | Score | Probability |
|---|---|---|---|---|---|---|
| 22063387_c2_92 | 1287 | 6509 | 620 | 1863 | 378 | 9.5e−67 |

| Protein name | | | | Locus Name | | Acc# |
|---|---|---|---|---|---|---|
| alpha-1,¾-fucosidase precursor | | | | gp:SSU39394 | | U39394 |

Description

*Streptomyces* sp. alpha-1,¾-fucosidase precursor gene, complete cds.

| ORF Name | NTID | AAID | NT Length | AA Length | Score | Probability |
|---|---|---|---|---|---|---|
| 238255_c3_113 | 1288 | 6510 | 322 | 969 | 106 | 0.0027 |

| Protein name | | | | Locus Name | | Acc# |
|---|---|---|---|---|---|---|
| | | | | sp:YEHT_ECOLI | | |

Description

HYPOTHETICAL 27.9 KD PROTEIN IN MOLR-BGLX INTERGENIC REGION

| ORF Name | NTID | AAID | NT Length | AA Length | Score | Probability |
|---|---|---|---|---|---|---|
| 24397305_c2_98 | 1289 | 6511 | 91 | 276 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 24406550_c2_99 | 1290 | 6512 | 209 | 630 | 106 | 1.0e−05 |
| Protein name | | | Locus Name | | | Acc# |
| | | | gp:GGU25741 | | | U25741 |

Description

Group G streptococcus strain g6 emmL gene, partial cds.

| ORF Name | NTID | AAID | NT Length | AA Length | Score | Probability |
|---|---|---|---|---|---|---|
| 25428436_c2_105 | 1291 | 6513 | 288 | 864 | | |
| Protein name | | | Locus Name | | | Acc# |

Description

NO-HIT

| ORF Name | NTID | AAID | NT Length | AA Length | Score | Probability |
|---|---|---|---|---|---|---|
| 25897507_f1_15 | 1292 | 6514 | 356 | 1071 | 105 | 0.038 |
| Protein name | | | Locus Name | | | Acc# |
| probable extracellular nuclease | | | pir:D75625 | | | D75625 |

Description

| ORF Name | NTID | AAID | NT Length | AA Length | Score | Probability |
|---|---|---|---|---|---|---|
| 26210912_c3_117 | 1293 | 6515 | 408 | 1227 | 109 | 0.0058 |
| Protein name | | | Locus Name | | | Acc# |
| silent surface layer protein | | | gp:AF079365 | | | AF079365 |

Description

*Lactobacillus crispatus* silent surface layer protein (cbsB) gene, partial cds.

| ORF Name | NTID | AAID | NT Length | AA Length | Score | Probability |
|---|---|---|---|---|---|---|
| 265878_f3_62 | 1294 | 6516 | 114 | 345 | 80 | 0.043 |
| Protein name | | | Locus Name | | | Acc# |
| MAR binding filament-like protein 1:MFP1 protein | | | pir:T07111 | | | T07111 |

Description

| ORF Name | NTID | AAID | NT Length | AA Length | Score | Probability |
|---|---|---|---|---|---|---|
| 2845427_c1_89 | 1295 | 6517 | 939 | 2820 | 132 | 0.00012 |
| Protein name | | | Locus Name | | | Acc# |
| | | | sp:PFEA_PSEAE | | | Q05098 |

Description

FERRIC ENTEROBACTIN RECEPTOR PRECURSOR

-continued

| ORF Name | NTID | AAID | NT Length | AA Length | Score | Probability |
|---|---|---|---|---|---|---|
| 30192086_c1_76 | 1296 | 6518 | 566 | 1701 | 831 | 7.7e−83 |

| Protein name | Locus Name | Acc# |
|---|---|---|
| | sp:BGAL_THEMA | |

Description

BETA-GALACTOSIDASE, (LACTASE)

| ORF Name | NTID | AAID | NT Length | AA Length | Score | Probability |
|---|---|---|---|---|---|---|
| 31256287_c3_116 | 1297 | 6519 | 641 | 1926 | 730 | 3.9e−72 |

| Protein name | Locus Name | Acc# |
|---|---|---|
| DNA-directed DNA polymerase, III chain dnaX:DNA polymerase III (gamma and tau subunits) dnaX | pir:S13786 | |

Description

| ORF Name | NTID | AAID | NT Length | AA Length | Score | Probability |
|---|---|---|---|---|---|---|
| 34570437_f2_47 | 1298 | 6520 | 492 | 1479 | 1142 | 8.5e−116 |

| Protein name | Locus Name | Acc# |
|---|---|---|
| | sp:PEPD_ECOLI | P15288 |

Description (PEPTIDASE D)

| ORF Name | NTID | AAID | NT Length | AA Length | Score | Probability |
|---|---|---|---|---|---|---|
| 35990807_c1_79 | 1299 | 6521 | 222 | 669 | 611 | 1.6e−59 |

| Protein name | Locus Name | Acc# |
|---|---|---|
| transaldolase-related protein | pir:G72394 | G72394 |

Description

| ORF Name | NTID | AAID | NT Length | AA Length | Score | Probability |
|---|---|---|---|---|---|---|
| 4101555_c2_102 | 1300 | 6522 | 332 | 999 | 144 | 2.0e−09 |

| Protein name | Locus Name | Acc# |
|---|---|---|
| | gp:APU72238 | U72238 |

Description

Anabaena PCC7120 ORFR1, ORFR2, ORFR3, ORFR4, and ORFR5 genes, complete sequences.

| ORF Name | NTID | AAID | NT Length | AA Length | Score | Probability |
|---|---|---|---|---|---|---|
| 447825_c3_106 | 1301 | 6523 | 502 | 1509 | 977 | 2.6e−98 |

| Protein name | Locus Name | Acc# |
|---|---|---|
| | sp:BGAL_BACME | O52847 |

Description

BETA-GALACTOSIDASE, (LACTASE)

-continued

| ORF Name | NTID | AAID | NT Length | AA Length | Score | Probability |
|---|---|---|---|---|---|---|
| 4961691_f2_39 | 1302 | 6524 | 117 | 354 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 15112533_f3_19 | 1303 | 6525 | 355 | 1068 | 210 | 5.1e−15 |
| Protein name | | | Locus Name | | | Acc# |
| probable proteinase PAB1960 | | | pir:A75179 | | | A75179 |
| Description | | | | | | |

| ORF Name | NTID | AAID | NT Length | AA Length | Score | Probability |
|---|---|---|---|---|---|---|
| 15820341_f2_14 | 1304 | 6526 | 157 | 474 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 204811_f2_16 | 1305 | 6527 | 274 | 825 | 105 | 0.012 |
| Protein name | | | Locus Name | | | Acc# |
| | | | gp:ATAC012563 | | | AC012563 |
| Description | | | | | | |

*Arabidopsis thaliana* chromosome I BAC T23K23 genomic sequence, complete sequence.

| ORF Name | NTID | AAID | NT Length | AA Length | Score | Probability |
|---|---|---|---|---|---|---|
| 21664062_f1_5 | 1306 | 6528 | 168 | 507 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 26604687_f2_12 | 1307 | 6529 | 205 | 618 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 33456962_f1_2 | 1308 | 6530 | 293 | 882 | | |
| Protein name | | | Locus Name | | | Acc# |
| Description | | | | | | |

NO-HIT

-continued

| ORF Name | NTID | AAID | NT Length | AA Length | Score | Probability |
|---|---|---|---|---|---|---|
| 4098437_f1_1 | 1309 | 6531 | 268 | 807 | 115 | 0.00062 |

| Protein name | Locus Name | Acc# |
|---|---|---|
| | sp:Y066_METJA | Q60377 |

Description

HYPOTHETICAL PROTEIN MJ0066

| ORF Name | NTID | AAID | NT Length | AA Length | Score | Probability |
|---|---|---|---|---|---|---|
| 6837782_f1_4 | 1310 | 6532 | 62 | 189 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 9939142_f1_3 | 1311 | 6533 | 115 | 348 | | |

| Protein name | Locus Name | Acc# |
|---|---|---|

Description

NO HIT

| ORF Name | NTID | AAID | NT Length | AA Length | Score | Probability |
|---|---|---|---|---|---|---|
| 10041563_c1_120 | 1312 | 6534 | 63 | 192 | | |

| Protein name | Locus Name | Acc# |
|---|---|---|

Description

NO HIT

| ORF Name | NTID | AAID | NT Length | AA Length | Score | Probability |
|---|---|---|---|---|---|---|
| 10726552_c3_185 | 1313 | 6535 | 80 | 243 | | |

| Protein name | Locus Name | Acc# |
|---|---|---|

Description

NO HIT

| ORF Name | NTID | AAID | NT Length | AA Length | Score | Probability |
|---|---|---|---|---|---|---|
| 12500086_c1_119 | 1314 | 6536 | 64 | 195 | | |

| Protein name | Locus Name | Acc# |
|---|---|---|

Description

NO HIT

-continued

| ORF Name | NTID | AAID | NT Length | AA Length | Score | Probability |
|---|---|---|---|---|---|---|
| 13860653_c3_194 | 1315 | 6537 | 488 | 1467 | 1040 | 5.5e−105 |

| Protein name | Locus Name | Acc# |
|---|---|---|
| cell division protein | gp:PAL249201 | AJ249201 |

Description

*Prevotella albensis* ftsQ (partial), ftsA and ftsZ genes and ORF-fts (partial).

| ORF Name | NTID | AAID | NT Length | AA Length | Score | Probability |
|---|---|---|---|---|---|---|
| 14298312_c1_131 | 1316 | 6538 | 489 | 1470 | 1275 | 6.8e−130 |

| Protein name | Locus Name | Acc# |
|---|---|---|
|  | sp:MURC_PORGI | Q51831 |

Description

ACETYLMURANOYL-L-ALANINE SYNTHETASE)

| ORF Name | NTID | AAID | NT Length | AA Length | Score | Probability |
|---|---|---|---|---|---|---|
| 14644152_c2_164 | 1317 | 6539 | 254 | 765 | 341 | 6.4e−31 |

| Protein name | Locus Name | Acc# |
|---|---|---|
| FtsQ | gp:AB004555 | AB004555 |

Description

*Porphyromonas gingivalis* genes for FtsQ, FtsA, FtsZ, comlete cds.

| ORF Name | NTID | AAID | NT Length | AA Length | Score | Probability |
|---|---|---|---|---|---|---|
| 164651_c2_169 | 1318 | 6540 | 669 | 2010 | 3334 | 0.0 |

| Protein name | Locus Name | Acc# |
|---|---|---|
| DNA gyrase B subunit | gp:AB017713 | AB017713 |

Description

*Bacteroides fragilis* gyrB gene for DNA gyrase B subunit, complete cds.

| ORF Name | NTID | AAID | NT Length | AA Length | Score | Probability |
|---|---|---|---|---|---|---|
| 16593937_c1_127 | 1319 | 6541 | 435 | 1308 | 388 | 6.7e−36 |

| Protein name | Locus Name | Acc# |
|---|---|---|
|  | sp:YLAO_BACSU | O07639 |

Description

HYPOTHETICAL 43.7 KD PROTEIN IN NPRE-PYCA INTERGENIC REGION

| ORF Name | NTID | AAID | NT Length | AA Length | Score | Probability |
|---|---|---|---|---|---|---|
| 16808437_c3_192 | 1320 | 6542 | 135 | 408 | 223 | 6.9e−18 |

| Protein name | Locus Name | Acc# |
|---|---|---|
| UDP-N-acetylmuramoylalanine-D-glutamate ligase | pir:H70477 | H70477 |

Description

-continued

| ORF Name | NTID | AAID | NT Length | AA Length | Score | Probability |
|---|---|---|---|---|---|---|
| 177253_c1_137 | 1321 | 6543 | 66 | 201 | 62 | 0.047 |

| Protein name | | | | Locus Name | | Acc# |
|---|---|---|---|---|---|---|
| Orfs10c | | | | gp:SCU42227 | | U42227 |

Description

*Saccharomyces cerevisiae* replicative mitochondrial DNA polymerasecatalytic subunit (MIP1) gene, nuclear gene encoding mitochondrial protein, partial cds, and putative 10-formyl-tetrahydrofolate binding protein (FTB1) gene, complete cds.

| ORF Name | NTID | AAID | NT Length | AA Length | Score | Probability |
|---|---|---|---|---|---|---|
| 19808211_c1_135 | 1322 | 6544 | 181 | 546 | 289 | 2.1e−25 |

| Protein name | | | | Locus Name | | Acc# |
|---|---|---|---|---|---|---|
| hypothetical protein 1 | | | | pir:S70830 | | S70830 |

Description

| ORF Name | NTID | AAID | NT Length | AA Length | Score | Probability |
|---|---|---|---|---|---|---|
| 20010316_f2_72 | 1323 | 6545 | 67 | 204 | | |

| Protein name | | | | Locus Name | | Acc # |
|---|---|---|---|---|---|---|

Description

NO HIT

| ORF Name | NTID | AAID | NT Length | AA Length | Score | Probability |
|---|---|---|---|---|---|---|
| 2149013_c3_187 | 1324 | 6546 | 343 | 1032 | 614 | 7.6e−60 |

| Protein name | | | | Locus Name | | Acc# |
|---|---|---|---|---|---|---|
| unknown | | | | gp:EFU94707 | | U94707 |

Description

*Enterococcus faecalis* strain A24836 cell wall/cell division gene cluster, y11B, y11C, y11D, pbpC, mraY, murD, murG, div1B, ftsA and ftsZ genes, complete cds.

| ORF Name | NTID | AAID | NT Length | AA Length | Score | Probability |
|---|---|---|---|---|---|---|
| 2151417_f3_78 | 1325 | 6547 | 180 | 543 | 186 | 2.5e−13 |

| Protein name | | | | Locus Name | | Acc# |
|---|---|---|---|---|---|---|
| | | | | sp:YGY4_HALSQ | | P21562 |

Description

HYPOTHETICAL 80.2 KD PROTEIN IN THE 5' REGION OF GYRA AND GYRB (ORF 4)

| ORF Name | NTID | AAID | NT Length | AA Length | Score | Probability |
|---|---|---|---|---|---|---|
| 22303400_c2_166 | 1326 | 6548 | 442 | 1329 | 1291 | 1.4e−131 |

| Protein name | | | | Locus Name | | Acc# |
|---|---|---|---|---|---|---|
| cell division protein | | | | gp:PAL249201 | | AJ249201 |

Description

*Prevotella albensis* ftsQ (partial), ftsA and ftsZ genes and ORF-fts (partial).

-continued

| ORF Name | NTID | AAID | NT Length | AA Length | Score | Probability |
|---|---|---|---|---|---|---|
| 23468837_f3_100 | 1327 | 6549 | 171 | 516 | | |
| Protein name | | | | Locus Name | | Acc# |
| Description | | | | | | |
| NO HIT | | | | | | |

| ORF Name | NTID | AAID | NT Length | AA Length | Score | Probability |
|---|---|---|---|---|---|---|
| 23646942_c1_126 | 1328 | 6550 | 328 | 987 | 368 | 8.9e−34 |
| Protein name | | | | Locus Name | | Acc# |
| | | | | sp:MURD_BACSU | | |
| Description | | | | | | |
| ADDING ENZYME) | | | | | | |

| ORF Name | NTID | AAID | NT Length | AA Length | Score | Probability |
|---|---|---|---|---|---|---|
| 24072177_c3_175 | 1329 | 6551 | 452 | 1359 | 730 | 3.9e−72 |
| Protein name | | | | Locus Name | | Acc# |
| hypothetical protein | | | | pir:S76527 | | S76527 |
| Description | | | | | | |

| ORF Name | NTID | AAID | NT Length | AA Length | Score | Probability |
|---|---|---|---|---|---|---|
| 24413875_c2_167 | 1330 | 6552 | 61 | 186 | | |
| Protein name | | | | Locus Name | | Acc# |
| Description | | | | | | |
| NO HIT | | | | | | |

| ORF Name | NTID | AAID | NT Length | AA Length | Score | Probability |
|---|---|---|---|---|---|---|
| 24414077_f1_33 | 1331 | 6553 | 208 | 627 | | |
| Protein name | | | | Locus Name | | Acc# |
| Description | | | | | | |
| NO HIT | | | | | | |

| ORF Name | NTID | AAID | NT Length | AA Length | Score | Probability |
|---|---|---|---|---|---|---|
| 245643_f3_75 | 1332 | 6554 | 140 | 423 | 146 | 4.8e−09 |
| Protein name | | | | Locus Name | | Acc# |
| conserved hypothetical protein | | | | pir:H75460 | | H75460 |
| Description | | | | | | |

| ORF Name | NTID | AAID | NT Length | AA Length | Score | Probability |
|---|---|---|---|---|---|---|
| 24658577_f2_68 | 1333 | 6555 | 113 | 342 | | |
| Protein name | | | | Locus Name | | Acc# |
| Description | | | | | | |
| NO HIT | | | | | | |

-continued

| ORF Name | NTID | AAID | NT Length | AA Length | Score | Probability |
|---|---|---|---|---|---|---|
| 25832161_f2_41 | 1334 | 6556 | 880 | 2643 | | |
| Protein name | | | Locus Name | | | Acc# |
| Description | | | | | | |

NO HIT

| ORF Name | NTID | AAID | NT Length | AA Length | Score | Probability |
|---|---|---|---|---|---|---|
| 2620187_f3_96 | 1335 | 6557 | 217 | 654 | | |
| Protein name | | | Locus Name | | | Acc# |
| Description | | | | | | |

NO HIT

| ORF Name | NTID | AAID | NT Length | AA Length | Score | Probability |
|---|---|---|---|---|---|---|
| 26750336_f1_37 | 1336 | 6558 | 347 | 1044 | 1218 | 7.5e−124 |
| Protein name | | | Locus Name | | | Acc# |
| hemolysin A | | | gp:PMU27587 | | | U27587 |
| Description | | | | | | |

*Prevotella melaninogenica* hemolysin A (phyA) gene, complete cds.

| ORF Name | NTID | AAID | NT Length | AA Length | Score | Probability |
|---|---|---|---|---|---|---|
| 2931518_c3_189 | 1337 | 6559 | 486 | 1461 | 892 | 2.6e−89 |
| Protein name | | | Locus Name | | | Acc# |
| UDP-MurNac-tripeptide synthetase | | | pir: E70450 | | | E70450 |
| Description | | | | | | |

| ORF Name | NTID | AAID | NT Length | AA Length | Score | Probability |
|---|---|---|---|---|---|---|
| 30166437_c3_191 | 1338 | 6560 | 82 | 249 | 75 | 1.5e−06 |
| Protein name | | | Locus Name | | | Acc# |
| phospho-n-acetylmuramoyl-pentapeptide-transferase (mraY1) RP595 | | | pir:E71664 | | | E71664 |
| Description | | | | | | |

| ORF Name | NTID | AAID | NT Length | AA Length | Score | Probability |
|---|---|---|---|---|---|---|
| 31534452_f1_40 | 1339 | 6561 | 595 | 1788 | 342 | 1.6e−28 |
| Protein name | | | Locus Name | | | Acc# |
| conserved hypothetical protein aq_854 | | | pir:B70374 | | | B70374 |
| Description | | | | | | |

-continued

| ORF Name | NTID | AAID | NT Length | AA Length | Score | Probability |
|---|---|---|---|---|---|---|
| 3166057_c2_163 | 1340 | 6562 | 389 | 1170 | 641 | 1.0e−62 |

| Protein name | Locus Name | Acc# |
|---|---|---|
| | sp:MURG_BACSU | |

Description (EC 2.4.1.—)

| ORF Name | NTID | AAID | NT Length | AA Length | Score | Probability |
|---|---|---|---|---|---|---|
| 33398557_f3_102 | 1341 | 6563 | 206 | 621 | | |

| Protein name | Locus Name | Acc# |
|---|---|---|

Description

NO HIT

| ORF Name | NTID | AAID | NT Length | AA Length | Score | Probability |
|---|---|---|---|---|---|---|
| 33787927_f1_39 | 1342 | 6564 | 150 | 453 | 419 | 3.5e−39 |

| Protein name | Locus Name | Acc# |
|---|---|---|
| | sp:DUT_AQUAE | O66592 |

Description (DUTPASE) (DUTP PYROPHOSPHATASE)

| ORF Name | NTID | AAID | NT Length | AA Length | Score | Probability |
|---|---|---|---|---|---|---|
| 33986038_f1_35 | 1343 | 6565 | 723 | 2172 | 164 | 9.8e−15 |

| Protein name | Locus Name | Acc# |
|---|---|---|
| putative TonB-dependent outer membrane receptor | gp:AF048749 | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 34260912_c1_122 | 1344 | 6566 | 118 | 357 | 75 | 0.0099 |

| Protein name | Locus Name | Acc# |
|---|---|---|
| hypothetical protein 2 | pir:I40759 | |

Description

| ORF Name | NTID | AAID | NT Length | AA Length | Score | Probability |
|---|---|---|---|---|---|---|
| 37542_c2_153 | 1345 | 6567 | 198 | 597 | 229 | 4.8e−19 |

| Protein name | Locus Name | Acc# |
|---|---|---|
| probable RNA polymerase sigma factor | pir:T42015 | T42015 |

Description

-continued

| ORF Name | NTID | AAID | NT Length | AA Length | Score | Probability |
|---|---|---|---|---|---|---|
| 390927_f1_11 | 1346 | 6568 | 168 | 507 | 190 | 2.7e−14 |
| Protein name | | | | Locus Name | | Acc# |
| | | | | gP:AB028868 | | AB028868 |

Description

*Mus musculus* P4 (21)n mRNA, partial cds.

| ORF Name | NTID | AAID | NT Length | AA Length | Score | Probability |
|---|---|---|---|---|---|---|
| 3992135_f3_95 | 1347 | 6569 | 122 | 369 | | |
| Protein name | | | | Locus Name | | Acc# |

Description

NO HIT

| ORF Name | NTID | AAID | NT Length | AA Length | Score | Probability |
|---|---|---|---|---|---|---|
| 4079668_f2_66 | 1348 | 6570 | 414 | 1245 | 105 | 0.032 |
| Protein name | | | | Locus Name | | Acc# |
| RING finger protein | | | | gp:AF036255 | | AF036255 |

Description

*Rattus norvegicus* RING finger protein mRNA, complete cds.

| ORF Name | NTID | AAID | NT Length | AA Length | Score | Probability |
|---|---|---|---|---|---|---|
| 4174013_f1_7 | 1349 | 6571 | 265 | 798 | 101 | 6.7e−05 |
| Protein name | | | | Locus Name | | Acc# |
| RecO | | | | gp:HIU17037 | | U17037 |

Description

*Haemophilus influenzae* opacity associated proteins OapA and OapB (oapA and oapB) genes, complete cds, and DNA recombination and repair protein (recO) gene, partial cds.

| ORF Name | NTID | AAID | NT Length | AA Length | Score | Probability |
|---|---|---|---|---|---|---|
| 4875812_c3_186 | 1350 | 6572 | 171 | 516 | 84 | 0.0019 |
| Protein name | | | | Locus Name | | Acc# |
| DNA-binding protein HB:DNA-binding protein HU:DNA-binding protein II | | | | pir:S00015 | | |

Description

| ORF Name | NTID | AAID | NT Length | AA Length | Score | Probability |
|---|---|---|---|---|---|---|
| 4957837_f2_65 | 1351 | 6573 | 352 | 1059 | | |
| Protein name | | | | Locus Name | | Acc# |

Description

NO HIT

-continued

| ORF Name | NTID | AAID | NT Length | AA Length | Score | Probability |
|---|---|---|---|---|---|---|
| 5117268_c1_121 | 1352 | 6574 | 160 | 483 | 177 | 1.5e−13 |
| Protein name | | | | Locus Name | | Acc# |
| | | | | sp:YABB_ECOLI | | P22186 |

Description

HYPOTHETICAL 17.4 KD PROTEIN IN FRUR-FTSL INTERGENIC REGION (ORFC)

| ORF Name | NTID | AAID | NT Length | AA Length | Score | Probability |
|---|---|---|---|---|---|---|
| 5994087_c1_123 | 1353 | 6575 | 708 | 2127 | 337 | 2.1e−34 |
| Protein name | | | | Locus Name | | Acc# |
| | | | | sp:SP5D_BACSU | | Q03524 |

Description

BINDING PROTEIN)

| ORF Name | NTID | AAID | NT Length | AA Length | Score | Probability |
|---|---|---|---|---|---|---|
| 6072683_c1_125 | 1354 | 6576 | 376 | 1131 | 344 | 8.1e−51 |
| Protein name | | | | Locus Name | | Acc# |
| | | | | sp:MRAY_BORBU | | Q44776 |

Description (UDP-MURNAC-PENTAPEPTIDE PHOSPHOTRANSFERASE)

| ORF Name | NTID | AAID | NT Length | AA Length | Score | Probability |
|---|---|---|---|---|---|---|
| 6649037_c2_168 | 1355 | 6577 | 89 | 270 | 153 | 5.4e−11 |
| Protein name | | | | Locus Name | | Acc# |
| probable ribosomal protein S20 rpsT | | | | pir:G70684 | | G70684 |

Description

| ORF Name | NTID | AAID | NT Length | AA Length | Score | Probability |
|---|---|---|---|---|---|---|
| 6758437_f1_36 | 1356 | 6578 | 286 | 861 | 186 | 7.0e−13 |
| Protein name | | | | Locus Name | | Acc# |
| probable sulfolipid biosynthesis protein SqdA | | | | pir:A42380 | | A42380 |

Description

| ORF Name | NTID | AAID | NT Length | AA Length | Score | Probability |
|---|---|---|---|---|---|---|
| 10328410_f1_3 | 1357 | 6579 | 71 | 216 | | |
| Protein name | | | | Locus Name | | Acc# |

Description

NO-HIT

-continued

| ORF Name | NTID | AAID | NT Length | AA Length | Score | Probability |
|---|---|---|---|---|---|---|
| 10442793_f3_46 | 1358 | 6580 | 115 | 348 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 10744192_c1_95 | 1359 | 6581 | 281 | 846 | 153 | 8.1e−08 |
| Protein name | | | Locus Name | | | Acc# |
| potassium channel alpha subunit Kv2.2 | | | gp:XLU20342 | | | U20342 |
| Description | | | | | | |

Xenopus leavis potassium channel alpha subunit Kv2.2 (XShab12) mRNA, complete cds.

| ORF Name | NTID | AAID | NT Length | AA Length | Score | Probability |
|---|---|---|---|---|---|---|
| 12518961_c2_100 | 1360 | 6582 | 325 | 978 | 241 | 5.2e−28 |
| Protein name | | | Locus Name | | | Acc# |
| probable protoporphyrinogen oxidase (hemK) RP847 | | | pir:G71646 | | | G71646 |
| Description | | | | | | |

| ORF Name | NTID | AAID | NT Length | AA Length | Score | Probability |
|---|---|---|---|---|---|---|
| 14256430_f2_37 | 1361 | 6583 | 191 | 576 | 445 | 6.1e−42 |
| Protein name | | | Locus Name | | | Acc# |
| conserved hypothetical protein MTH700 | | | pir:E69193 | | | E69193 |
| Description | | | | | | |

| ORF Name | NTID | AAID | NT Length | AA Length | Score | Probability |
|---|---|---|---|---|---|---|
| 14508510_f3_76 | 1362 | 6584 | 62 | 186 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 15835436_c3_152 | 1363 | 6585 | 308 | 927 | 228 | 6.1e−19 |
| Protein name | | | Locus Name | | | Acc# |
| hypothetical protein yitL | | | pir:E69840 | | | E69840 |
| Description | | | | | | |

-continued

| ORF Name | NTID | AAID | NT Length | AA Length | Score | Probability |
|---|---|---|---|---|---|---|
| 16892517_c3_134 | 1364 | 6586 | 70 | 213 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 19953510_c2_102 | 1365 | 6587 | 457 | 1374 | 626 | 4.1e−61 |

| Protein name | | | | Locus Name | | Acc# |
|---|---|---|---|---|---|---|
| argininosuccinate lyase | | | | pir:D70419 | | D70419 |

Description

| ORF Name | NTID | AAID | NT Length | AA Length | Score | Probability |
|---|---|---|---|---|---|---|
| 23673455_c1_80 | 1366 | 6588 | 161 | 486 | 126 | 3.9e−08 |

| Protein name | | | | Locus Name | | Acc# |
|---|---|---|---|---|---|---|
| | | | | sp:RECX_PSEAE | | P37860 |

Description

REGULATORY PROTEIN RECX

| ORF Name | NTID | AAID | NT Length | AA Length | Score | Probability |
|---|---|---|---|---|---|---|
| 24026562_f3_59 | 1367 | 6589 | 415 | 1248 | 567 | 7.2e−55 |

| Protein name | | | | Locus Name | | Acc# |
|---|---|---|---|---|---|---|
| | | | | sp:ASSY_METJA | | Q60174 |

Description

LIGASE)

| ORF Name | NTID | AAID | NT Length | AA Length | Score | Probability |
|---|---|---|---|---|---|---|
| 24300018_c3_133 | 1368 | 6590 | 166 | 501 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24353376_f1_6 | 1369 | 6591 | 533 | 1602 | 1279 | 2.6e−130 |

| Protein name | | | | Locus Name | | Acc# |
|---|---|---|---|---|---|---|
| | | | | gp:AB024946 | | AB024946 |

Description

*Escherichia coli* plasmid pB171 DNA, complete sequence.

| ORF Name | NTID | AAID | NT Length | AA Length | Score | Probability |
|---|---|---|---|---|---|---|
| 25663952_f1_2 | 1370 | 6592 | 188 | 567 | 280 | 1.9e−24 |

| Protein name | | | | Locus Name | | Acc# |
|---|---|---|---|---|---|---|
| | | | | sp:MTGA_ACICA | | O24849 |

Description (EC 2.4.2.—) (MONOFUNCTIONAL TGASE)

| ORF Name | NTID | AAID | NT Length | AA Length | Score | Probability |
|---|---|---|---|---|---|---|
| 25975187_c3_153 | 1371 | 6593 | 221 | 666 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 26369087_f2_44 | 1372 | 6594 | 347 | 1044 | 554 | 1.7e−53 |

| Protein name | | | | Locus Name | | Acc# |
|---|---|---|---|---|---|---|
| riboflavin-specific deaminase | | | | pir:G72207 | | G72207 |

Description

| ORF Name | NTID | AAID | NT Length | AA Length | Score | Probability |
|---|---|---|---|---|---|---|
| 32228388_c2_122 | 1373 | 6595 | 252 | 759 | 113 | 0.0016 |

| Protein name | | | | Locus Name | | Acc# |
|---|---|---|---|---|---|---|
| | | | | sp:HEXA_BLADI | | Q17127 |

Description

HEXAMERIN PRECURSOR

| ORF Name | NTID | AAID | NT Length | AA Length | Score | Probability |
|---|---|---|---|---|---|---|
| 33367175_c3_131 | 1374 | 6596 | 163 | 492 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 36211443_f2_35 | 1375 | 6597 | 326 | 981 | 548 | 7.5e−53 |

| Protein name | | | | Locus Name | | Acc# |
|---|---|---|---|---|---|---|
| N-acetyl-gamma-glutamyl-phosphate reductase, | | | | pir:F69508 | | F69508 |

Description

-continued

| ORF Name | NTID | AAID | NT Length | AA Length | Score | Probability |
|---|---|---|---|---|---|---|
| 4007801_c2_121 | 1376 | 6598 | 228 | 687 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 4095050_f3_61 | 1377 | 6599 | 260 | 783 | 375 | 1.6e−34 |

| Protein name | | | | Locus Name | | Acc# |
|---|---|---|---|---|---|---|
| pyrroline-5-carboxylate reductase | | | | gp:CSAJ10739 | | AJ010739 |

Description

*Clostridium sticklandii* proC gene and 5' flanking region.

| ORF Name | NTID | AAID | NT Length | AA Length | Score | Probability |
|---|---|---|---|---|---|---|
| 4377005_c3_130 | 1378 | 6600 | 230 | 693 | 541 | 4.1e−52 |

| Protein name | | | | Locus Name | | Acc# |
|---|---|---|---|---|---|---|
| | | | | sp:PYRE_BACSU | | P25972 |

Description

OROTATE PHOSPHORIBOSYLTRANSFERASE, (OPRT) (OPRTASE)

| ORF Name | NTID | AAID | NT Length | AA Length | Score | Probability |
|---|---|---|---|---|---|---|
| 4801552_f2_45 | 1379 | 6601 | 458 | 1377 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 4804051_f2_34 | 1380 | 6602 | 203 | 612 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 4804813_f2_36 | 1381 | 6603 | 377 | 1134 | 670 | 8.8e−66 |

| Protein name | | | | Locus Name | | Acc# |
|---|---|---|---|---|---|---|
| | | | | sp:ARGD_BACSU | | P36839 |

Description

ACETYLORNITHINE AMINOTRANSFERASE, (ACOAT)

-continued

| ORF Name | NTID | AAID | NT Length | AA Length | Score | Probability |
|---|---|---|---|---|---|---|
| 5110712_c2_114 | 1382 | 6604 | 413 | 1242 | 398 | 1.3e−37 |

| Protein name | Locus Name | Acc# |
|---|---|---|
| sensory transduction histidine kinase slr2104:protein slr2104:protein slr2104 | pir:S75136 | S75136 |

Description

| ORF Name | NTID | AAID | NT Length | AA Length | Score | Probability |
|---|---|---|---|---|---|---|
| 5131925_c1_81 | 1383 | 6605 | 659 | 1980 | 108 | 0.033 |

| Protein name | Locus Name | Acc# |
|---|---|---|
| hypothetical protein F10M10.30 | pir:T04772 | T04772 |

Description

| ORF Name | NTID | AAID | NT Length | AA Length | Score | Probability |
|---|---|---|---|---|---|---|
| 5270050_f2_33 | 1384 | 6606 | 160 | 483 | 254 | 1.1e−21 |

| Protein name | Locus Name | Acc# |
|---|---|---|
| arginine repressor | gp:BSAJ10954 | AJ010954 |

Description

*Bacillus stearothermophilus* argR gene and partial recN gene.

| ORF Name | NTID | AAID | NT Length | AA Length | Score | Probability |
|---|---|---|---|---|---|---|
| 5270302_f1_11 | 1385 | 6607 | 554 | 1665 | 1248 | 5.0e−127 |

| Protein name | Locus Name | Acc# |
|---|---|---|
| acetyl-CoA synthetase related protein | pir:F69193 | F69193 |

Description

| ORF Name | NTID | AAID | NT Length | AA Length | Score | Probability |
|---|---|---|---|---|---|---|
| 994002_f3_53 | 1386 | 6608 | 334 | 1005 | 273 | 1.0e−23 |

| Protein name | Locus Name | Acc# |
|---|---|---|
| probable malate dehydrogenase, :2-ketoacid dehydrogenase:protein sll0891:2-ketoacid dehydrogenase:protein sll0891 | pir:S75735 | S75735 |

Description

| ORF Name | NTID | AAID | NT Length | AA Length | Score | Probability |
|---|---|---|---|---|---|---|
| 10345327_f2_103 | 1387 | 6609 | 760 | 2283 | 410 | 7.8e−40 |

| Protein name | Locus Name | Acc# |
|---|---|---|
| 115K outer membrane protein precursor:SusC protein | pir:JC6027 | JC6027 |

Description

-continued

| ORF Name | NTID | AAID | NT Length | AA Length | Score | Probability |
|---|---|---|---|---|---|---|
| 10580052_f3_183 | 1388 | 6610 | 114 | 345 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 10662877_c1_202 | 1389 | 6611 | 321 | 966 | 224 | 1.6e−18 |

| Protein name | | | | Locus Name | | Acc# |
|---|---|---|---|---|---|---|
| putative transposase | | | | gp:AF007429 | | AF007429 |

Description

*Heamophilus paragallinarum* IS-like putative transposase gene, complete cds.

| ORF Name | NTID | AAID | NT Length | AA Length | Score | Probability |
|---|---|---|---|---|---|---|
| 10725942_c3_342 | 1390 | 6612 | 60 | 183 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 10819681_c2_294 | 1391 | 6613 | 138 | 417 | 170 | 8.5e−13 |

| Protein name | | | | Locus Name | | Acc# |
|---|---|---|---|---|---|---|
| | | | | sp:MTGA_HAEIN | | P44890 |

Description (EC 2.4.2.—) (MONOFUNCTIONAL TGASE)

| ORF Name | NTID | AAID | NT Length | AA Length | Score | Probability |
|---|---|---|---|---|---|---|
| 11035088_c2_306 | 1392 | 6614 | 333 | 1002 | 1634 | 6.2e−168 |

| Protein name | | | | Locus Name | | Acc# |
|---|---|---|---|---|---|---|
| mobilization protein B | | | | gp:AF118242 | | AF118242 |

Description

*Bacteroides fragilis* mobilization protein B (mobB) gene, complete cds.

| ORF Name | NTID | AAID | NT Length | AA Length | Score | Probability |
|---|---|---|---|---|---|---|
| 1182332_f1_34 | 1393 | 6615 | 322 | 969 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 11881313_c3_349 | 1394 | 6616 | 288 | 867 | 113 | 0.0062 |

| Protein name | Locus Name | Acc# |
|---|---|---|
| transmembrane sensor | gp:AF060193 | AF060193 |

Description

*Pseudomonas aeruginosa* pigACDE operon, complete sequence; hypothetical PigB (pigB) gene, complete cds.

| ORF Name | NTID | AAID | NT Length | AA Length | Score | Probability |
|---|---|---|---|---|---|---|
| 12109558_c2_272 | 1395 | 6617 | 148 | 447 | 156 | 5.1e−11 |

| Protein name | Locus Name | Acc# |
|---|---|---|
| collagen-like protein | gp:BTU67921 | U67921 |

Description

*Bacillus thuringiensis* plasmid pTX14-1, MOB, REP, and collagen-like protein genes, complete sequence.

| ORF Name | NTID | AAID | NT Length | AA Length | Score | Probability |
|---|---|---|---|---|---|---|
| 1271010_c3_387 | 1396 | 6618 | 96 | 291 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 13071943_c1_216 | 1397 | 6619 | 466 | 1401 | 397 | 7.5e−37 |

| Protein name | Locus Name | Acc# |
|---|---|---|
| conserved hypothetical protein | pir:H72331 | H72331 |

Description

| ORF Name | NTID | AAID | NT Length | AA Length | Score | Probability |
|---|---|---|---|---|---|---|
| 13750800_c1_207 | 1398 | 6620 | 78 | 237 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 13806517_f2_85 | 1399 | 6621 | 401 | 1206 | 169 | 1.0e−09 |

| Protein name | Locus Name | Acc# |
|---|---|---|
| transposase | gp:AF038866 | AF038866 |

Description

*Bacteroides fragilis* transposon Tn5520 transposase (bipH) and mobilization protein BmpH (bmpH) genes, complete cds.

-continued

| ORF Name | NTID | AAID | NT Length | AA Length | Score | Probability |
|---|---|---|---|---|---|---|
| 14469691_c1_213 | 1400 | 6622 | 193 | 582 | 199 | 7.2e−16 |

| Protein name | Locus Name | Acc# |
|---|---|---|
| RNA polymerase sigma factor SigZ-like protein | gp:AF137263 | AF137263 |

Description

Bacteroides thetiaotaomicron 30S ribosomal protein S16-like protein, fucose
gene cluster, and RNA polymerase sigma factor SigZ-like protein (sigZ) genes, complete cds.

| ORF Name | NTID | AAID | NT Length | AA Length | Score | Probability |
|---|---|---|---|---|---|---|
| 14589067_f3_150 | 1401 | 6623 | 93 | 282 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 14663552_f2_77 | 1402 | 6624 | 296 | 891 | 116 | 0.00021 |

| Protein name | Locus Name | Acc# |
|---|---|---|
| | sp:LCRF_YERPE | P28808 |

Description

THERMOREGULATORY PROTEIN LCRF

| ORF Name | NTID | AAID | NT Length | AA Length | Score | Probability |
|---|---|---|---|---|---|---|
| 14723156_f2_132 | 1403 | 6625 | 123 | 372 | 83 | 0.029 |

| Protein name | Locus Name | Acc# |
|---|---|---|
| hypothetical protein aq_2087 | pir:H70478 | H70478 |

Description

| ORF Name | NTID | AAID | NT Length | AA Length | Score | Probability |
|---|---|---|---|---|---|---|
| 14875302_c1_267 | 1404 | 6626 | 162 | 489 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 15659758_f1_51 | 1405 | 6627 | 63 | 192 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 15671890_c3_394 | 1406 | 6628 | 428 | 1287 | 191 | 3.9e−12 |

| Protein name | Locus Name | Acc# |
|---|---|---|
| transposase | gp:AF038866 | AF038866 |

Description

*Bacteroides fragilis* transposon Tn5520 transposase (bipH) and mobilization protein BmpH (bmpH) genes, complete cds.

| ORF Name | NTID | AAID | NT Length | AA Length | Score | Probability |
|---|---|---|---|---|---|---|
| 15736057_f1_29 | 1407 | 6629 | 523 | 1572 | 2044 | 2.2e−211 |

| Protein name | Locus Name | Acc# |
|---|---|---|
| | sp:TRA2_BACFR | Q45119 |

Description

TRANSPOSASE FOR INSERTION SEQUENCE ELEMENT IS21-LIKE

| ORF Name | NTID | AAID | NT Length | AA Length | Score | Probability |
|---|---|---|---|---|---|---|
| 15829061_c1_200 | 1408 | 6630 | 478 | 1437 | 468 | 2.2e−44 |

| Protein name | Locus Name | Acc# |
|---|---|---|
| | sp:PPOX_MYXXA | P56601 |

Description

PROTOPORPHYRINOGEN OXIDASE, (PPO)

| ORF Name | NTID | AAID | NT Length | AA Length | Score | Probability |
|---|---|---|---|---|---|---|
| 16491593_c2_279 | 1409 | 6631 | 157 | 474 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 19531438_f1_49 | 1410 | 6632 | 88 | 267 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 19937637_f2_111 | 1411 | 6633 | 62 | 189 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 2145012_f3_156 | 1412 | 6634 | 67 | 204 | 95 | 0.00024 |

| Protein name | Locus Name | Acc# |
|---|---|---|
| hypothetical 26.8K protein | pir:JC2322 | JC2322 |

Description

| ORF Name | NTID | AAID | NT Length | AA Length | Score | Probability |
|---|---|---|---|---|---|---|
| 21683280_c3_350 | 1413 | 6635 | 527 | 1584 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 22459687_c3_347 | 1414 | 6636 | 187 | 564 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 22691552_c1_262 | 1415 | 6637 | 434 | 1305 | 140 | 2.7e−06 |

| Protein name | Locus Name | Acc# |
|---|---|---|
| immunoreactive 53 kD antigen PG123 | gp:AF144641 | AF144641 |

Description

*Porphyromonas gangavalis* strain W50 immunoreactive 53 kD antigen PG123 gene, complete cds.

| ORF Name | NTID | AAID | NT Length | AA Length | Score | Probability |
|---|---|---|---|---|---|---|
| 22692067_c1_233 | 1416 | 6638 | 324 | 975 | 445 | 6.1e−42 |

| Protein name | Locus Name | Acc# |
|---|---|---|
| | sp:HTPX_STRGC | O30795 |

Description

PUTATIVE HEAT SHOCK PROTEIN HTPX

| ORF Name | NTID | AAID | NT Length | AA Length | Score | Probability |
|---|---|---|---|---|---|---|
| 22836061_f2_82 | 1417 | 6639 | 133 | 402 | 97 | 0.00018 |

| Protein name | Locus Name | Acc# |
|---|---|---|
| MbpB | gp:BFU25716 | U25716 |

Description

*Bacteroides fragilis* mobilization protein MbpA (mbpA), MbpB (mbpB) and MbpC (mbpC) genes, complete cds.

-continued

| ORF Name | NTID | AAID | NT Length | AA Length | Score | Probability |
|---|---|---|---|---|---|---|
| 22933438_c3_397 | 1418 | 6640 | 322 | 969 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 22933438_f1_21 | 1419 | 6641 | 242 | 729 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 23495700_f2_138 | 1420 | 6642 | 67 | 204 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 23531265_f3_149 | 1421 | 6643 | 216 | 651 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 23648392_f2_86 | 1422 | 6644 | 431 | 1296 | 141 | 2.1e−06 |

| Protein name | | | | Locus Name | | Acc# |
|---|---|---|---|---|---|---|
| immunoreactive 53 kD antigen PG123 | | | | gp:AF144641 | | AF144641 |

Description

*Porphyromonas gingivalis* strain W50 immunoreactive 53 kD antigen PG123 gene, complete cds.

| ORF Name | NTID | AAID | NT Length | AA Length | Score | Probability |
|---|---|---|---|---|---|---|
| 23679510_c3_345 | 1423 | 6645 | 197 | 594 | 345 | 2.4e−31 |

| Protein name | | | | Locus Name | | Acc# |
|---|---|---|---|---|---|---|
| putative acetyltransferaese | | | | gp:SCF1 | | AL117322 |

Description

*Streptomyces coelicolor* cosmid F1.

-continued

| ORF Name | NTID | AAID | NT Length | AA Length | Score | Probability |
|---|---|---|---|---|---|---|
| 24026502_f1_27 | 1424 | 6646 | 88 | 267 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24259637_c3_336 | 1425 | 6647 | 690 | 2073 | 253 | 3.1e−37 |

| Protein name | | | | Locus Name | | Acc# |
|---|---|---|---|---|---|---|
| unknown | | | | gp:AF079317 | | AF079317 |

Description

*Sphingomonas aromaticivorans* plasmid pNL1, complete plasmid sequence.

| ORF Name | NTID | AAID | NT Length | AA Length | Score | Probability |
|---|---|---|---|---|---|---|
| 24332035_c1_197 | 1426 | 6648 | 83 | 252 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24407551_c2_293 | 1427 | 6649 | 231 | 696 | 427 | 5.0e−40 |

| Protein name | | | | Locus Name | | Acc# |
|---|---|---|---|---|---|---|
| immunogenic 23 kDa lipoprotein PG3 | | | | gp:AF145799 | | AF145799 |

Description

*Porphyromonas gingivalis* strain W50 immunogenic 23 KDa lipoprotein PG3 gene, complete cds.

| ORF Name | NTID | AAID | NT Length | AA Length | Score | Probability |
|---|---|---|---|---|---|---|
| 24415757_c3_348 | 1428 | 6650 | 424 | 1275 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24641061_f2_96 | 1429 | 6651 | 316 | 951 | 147 | 9.5e−08 |

| Protein name | | | | Locus Name | | Acc# |
|---|---|---|---|---|---|---|
| vrlE protein | | | | pir:T17384 | | T17384 |

Description

-continued

| ORF Name | NTID | AAID | NT Length | AA Length | Score | Probability |
|---|---|---|---|---|---|---|
| 24642137_f1_62 | 1430 | 6652 | 401 | 1206 | 176 | 2.9e−11 |

| Protein name | | | | Locus Name | | Acc# |
|---|---|---|---|---|---|---|
| putative outer membrane porin | | | | gp:AF030977 | | |

Description

*Vibrio cholerae* glutamyl tRNA synthetase (gltX) gene, partial cds; putative outer membrane porin (ompA), unknown protein, vibriobactin receptor precursor (viuA), and ViuB protein (viuB) genes, complete cds; and VibF (vibF) gene, partial cds.

| ORF Name | NTID | AAID | NT Length | AA Length | Score | Probability |
|---|---|---|---|---|---|---|
| 24642212_f2_110 | 1431 | 6653 | 301 | 906 | 631 | 1.2e−61 |

| Protein name | | | | Locus Name | | Acc# |
|---|---|---|---|---|---|---|
| | | | | sp:YBFH_BACSU | | O31448 |

Description

HYPOTHETICAL 33.8 KD PROTEIN IN GLPT-PURT INTERGENIC REGION

| ORF Name | NTID | AAID | NT Length | AA Length | Score | Probability |
|---|---|---|---|---|---|---|
| 24647826_f1_28 | 1432 | 6654 | 77 | 234 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24725380_c1_245 | 1433 | 6655 | 186 | 561 | 593 | 1.3e−57 |

| Protein name | | | | Locus Name | | Acc# |
|---|---|---|---|---|---|---|
| mobilization protein A | | | | gp:AF118241 | | AF118241 |

Description

*Bacteroides fragilis* mobilization protein A (mobA) gene, complete cds.

| ORF Name | NTID | AAID | NT Length | AA Length | Score | Probability |
|---|---|---|---|---|---|---|
| 24726592_c3_355 | 1434 | 6656 | 152 | 459 | 339 | 1.0e−30 |

| Protein name | | | | Locus Name | | Acc# |
|---|---|---|---|---|---|---|
| | | | | sp:MTGA_ECOLI | | P46022 |

Description (EC 2.4.2—) (MONOFUNCTIONAL TGASE)

| ORF Name | NTID | AAID | NT Length | AA Length | Score | Probability |
|---|---|---|---|---|---|---|
| 24803426_c1_210 | 1435 | 6657 | 204 | 615 | 120 | 1.9e−06 |

| Protein name | | | | Locus Name | | Acc# |
|---|---|---|---|---|---|---|
| hypothetical protein MTH847 | | | | pir:A69213 | | A69213 |

Description

-continued

| ORF Name | NTID | AAID | NT Length | AA Length | Score | Probability |
|---|---|---|---|---|---|---|
| 24847551_c2_302 | 1436 | 6658 | 92 | 279 | | |
| Protein name | | | | Locus Name | | Acc# |
| Description | | | | | | |
| NO-HIT | | | | | | |

| ORF Name | NTID | AAID | NT Length | AA Length | Score | Probability |
|---|---|---|---|---|---|---|
| 2538277_c2_282 | 1437 | 6659 | 105 | 318 | 120 | 1.7e−07 |
| Protein name | | | | Locus Name | | Acc# |
| hypothetical protein ydaT | | | | pir:C69770 | | C69770 |
| Description | | | | | | |

| ORF Name | NTID | AAID | NT Length | AA Length | Score | Probability |
|---|---|---|---|---|---|---|
| 25511052_c1_232 | 1438 | 6660 | 206 | 621 | 401 | 2.8e−37 |
| Protein name | | | | Locus Name | | Acc# |
| LemA | | | | gp:LMU66186 | | U66186 |
| Description | | | | | | |

*Listeria monocytogenes* LemA (lemA) gene, complete cds, and LemB (lemB) gene, partial cds.

| ORF Name | NTID | AAID | NT Length | AA Length | Score | Probability |
|---|---|---|---|---|---|---|
| 25527053_f1_22 | 1439 | 6661 | 436 | 1311 | | |
| Protein name | | | | Locus Name | | Acc# |
| Description | | | | | | |
| NO-HIT | | | | | | |

| ORF Name | NTID | AAID | NT Length | AA Length | Score | Probability |
|---|---|---|---|---|---|---|
| 26354518_f2_95 | 1440 | 6662 | 73 | 222 | | |
| Protein name | | | | Locus Name | | Acc# |
| Description | | | | | | |
| NO-HIT | | | | | | |

| ORF Name | NTID | AAID | NT Length | AA Length | Score | Probability |
|---|---|---|---|---|---|---|
| 2767137_c1_266 | 1441 | 6663 | 887 | 2664 | 128 | 0.00031 |
| Protein name | | | | Locus Name | | Acc# |
| hypothetical protein H02F09.3 | | | | pir:T33369 | | T33369 |
| Description | | | | | | |

| ORF Name | NTID | AAID | NT Length | AA Length | Score | Probability |
|---|---|---|---|---|---|---|
| 2792942_f2_70 | 1442 | 6664 | 87 | 264 | | |
| Protein name | | | | Locus Name | | Acc# |
| Description | | | | | | |
| NO-HIT | | | | | | |

-continued

| ORF Name | NTID | AAID | NT Length | AA Length | Score | Probability |
|---|---|---|---|---|---|---|
| 29713458_f2_83 | 1443 | 6665 | 67 | 204 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 31923438_c2_291 | 1444 | 6666 | 61 | 186 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 32213312_f3_163 | 1445 | 6667 | 171 | 516 | 237 | 6.8e−20 |

| Protein name | | | | Locus Name | | Acc# |
|---|---|---|---|---|---|---|
| putative ECF sigma factor RpoE1 | | | | gp:AF049107 | | AF049107 |

Description

*Myxococcus xanthus* response regulator FrzZ (frzZ) gene, partial cds; alanine dehydrogenase (aldA), putative ECF sigma factor RpoE1 (rpoE1), and response regulator homolog (frzS) genes, complete cds; and unknown genes.

| ORF Name | NTID | AAID | NT Length | AA Length | Score | Probability |
|---|---|---|---|---|---|---|
| 33214538_f3_155 | 1446 | 6668 | 744 | 2235 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 33486716_c2_276 | 1447 | 6669 | 497 | 1494 | 793 | 8.2e−79 |

| Protein name | | | | Locus Name | | Acc# |
|---|---|---|---|---|---|---|
| | | | | sp:HEMN_AQUAE | | O67886 |

Description

OXYGEN-INDEPENDENT COPROPORPHYRINOGEN II

| ORF Name | NTID | AAID | NT Length | AA Length | Score | Probability |
|---|---|---|---|---|---|---|
| 33632692_c1_229 | 1448 | 6670 | 71 | 216 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 34181502_f2_122 | 1449 | 6671 | 426 | 1281 | 134 | 6.9e-06 |
| Protein name | | | Locus Name | | Acc# | |
| probable carboxy-terminal proteinase, D1 | | | pir:T05975 | | T05975 | |

Description

| ORF Name | NTID | AAID | NT Length | AA Length | Score | Probability |
|---|---|---|---|---|---|---|
| 35302_f1_52 | 1450 | 6672 | 203 | 612 | | |
| Protein name | | | Locus Name | | Acc# | |

Description

NO-HIT

| ORF Name | NTID | AAID | NT Length | AA Length | Score | Probability |
|---|---|---|---|---|---|---|
| 3942130_c1_264 | 1451 | 6673 | 388 | 1167 | 86 | 0.0055 |
| Protein name | | | Locus Name | | Acc# | |
| integrase | | | gp:HIVU69223 | | U69223 | |

Description

HIV-1 strain CMR273 from Cameroon integrase (pol) gene, partial cds.

| ORF Name | NTID | AAID | NT Length | AA Length | Score | Probability |
|---|---|---|---|---|---|---|
| 3954762_f3_187 | 1452 | 6674 | 291 | 876 | 111 | 6.4e-06 |
| Protein name | | | Locus Name | | Acc# | |
| transcription regulator homolog:hypothetical 137 protein | | | pir:PC4110 | | PC4110 | |

Description

| ORF Name | NTID | AAID | NT Length | AA Length | Score | Probability |
|---|---|---|---|---|---|---|
| 4114055_c3_337 | 1453 | 6675 | 415 | 1248 | 288 | 5.0e-24 |
| Protein name | | | Locus Name | | Acc# | |
| hypothetical protein | | | gp:AF149851 | | AF149851 | |

Description

*Pseudomonas* sp. KC hypothetical proteins, methallothionein-like protein, MoeB-like protein, putative proteins, hypothetical protein, putative oxidoreductase, and putative AMP ligase (entE) genes, complete cds; and putative receptor gene, partial cds.

| ORF Name | NTID | AAID | NT Length | AA Length | Score | Probability |
|---|---|---|---|---|---|---|
| 4720187_f2_99 | 1454 | 6676 | 283 | 852 | 954 | 7.1e-96 |
| Protein name | | | Locus Name | | Acc# | |
| | | | sp:ISTB_BACFR | | Q45120 | |

Description

INSERTION SEQUENCE IS21-LIKE PUTATIVE ATP-BINDING PROTEIN

| ORF Name | NTID | AAID | NT Length | AA Length | Score | Probability |
|---|---|---|---|---|---|---|
| 4822751_f2_101 | 1455 | 6677 | 594 | 1785 | 370 | 1.8e−48 |

| Protein name | Locus Name | Acc# |
|---|---|---|
| oxaloacetate decarboxylase, subunit alpha (oadA) homolog | pir:C69406 | C69406 |

Description

| ORF Name | NTID | AAID | NT Length | AA Length | Score | Probability |
|---|---|---|---|---|---|---|
| 4864702_f2_124 | 1456 | 6678 | 152 | 459 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 4879635_f1_61 | 1457 | 6679 | 772 | 2319 | 214 | 4.6e−14 |

| Protein name | Locus Name | Acc# |
|---|---|---|
| collagen | gp:AB008933 | AB008933 |

Description

*Hydra vulgaris* HT2 mRNA for collagen, partial cds.

| ORF Name | NTID | AAID | NT Length | AA Length | Score | Probability |
|---|---|---|---|---|---|---|
| 5177517_f2_88 | 1458 | 6680 | 182 | 549 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 5285692_c2_281 | 1459 | 6681 | 86 | 261 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 5321932_f1_53 | 1460 | 6682 | 234 | 705 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 564037_c3_346 | 1461 | 6683 | 282 | 849 | 229 | 4.8e−19 |

| Protein name | Locus Name | Acc# |
|---|---|---|
| hypothetical protein | pir:B72308 | B72308 |

Description

| ORF Name | NTID | AAID | NT Length | AA Length | Score | Probability |
|---|---|---|---|---|---|---|
| 5970252_c2_316 | 1462 | 6684 | 61 | 186 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 6025010_c3_333 | 1463 | 6685 | 74 | 225 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 6046907_f1_35 | 1464 | 6686 | 636 | 1911 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 6775438_c3_401 | 1465 | 6687 | 124 | 375 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 785322_f1_64 | 1466 | 6688 | 584 | 1752 | 220 | 2.7e−20 |

| Protein name | Locus Name | Acc# |
|---|---|---|
| | sp:FECA_ECOLI | P13036 |

Description

IRON(III) DICITRATE TRANSPORT PROTEIN FECA PRECURSOR

| ORF Name | NTID | AAID | NT Length | AA Length | Score | Probability |
|---|---|---|---|---|---|---|
| 15808290_c1_33 | 1467 | 6689 | 61 | 186 | 99 | 2.8e−05 |

| Protein name | Locus Name | Acc# |
|---|---|---|
| glycine-rich protein (clone w10-1) | pir:S14982 | S14982 |

Description

-continued

| ORF Name | NTID | AAID | NT Length | AA Length | Score | Probability |
|---|---|---|---|---|---|---|
| 19659503_c1_32 | 1468 | 6690 | 383 | 1152 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 26367141_c1_30 | 1469 | 6691 | 292 | 879 | 130 | 3.5e−05 |

| Protein name | | | Locus Name | | | Acc# |
|---|---|---|---|---|---|---|
| membrane glycoprotein | | | gp:D88733 | | | D88733 |

Description

Equine herpes virus 1 DNA for membrane glycoprotein, complete cds.

| ORF Name | NTID | AAID | NT Length | AA Length | Score | Probability |
|---|---|---|---|---|---|---|
| 26425336_c2_38 | 1470 | 6692 | 250 | 753 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 34666302_c3_43 | 1471 | 6693 | 495 | 1488 | 213 | 1.3e−20 |

| Protein name | | | Locus Name | | | Acc# |
|---|---|---|---|---|---|---|
| immunoreactive 53 kD antigen PG123 | | | gp:AF144641 | | | AF144641 |

Description

*Porphyromonas gingivalis* strain W50 immunoreactive 53 kD antigen PG123 gene, complete cds.

| ORF Name | NTID | AAID | NT Length | AA Length | Score | Probability |
|---|---|---|---|---|---|---|
| 807033_c1_29 | 1472 | 6694 | 112 | 339 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 11063391_c2_40 | 1473 | 6695 | 344 | 1035 | 452 | 1.1e−42 |

| Protein name | | | Locus Name | | | Acc# |
|---|---|---|---|---|---|---|
| | | | sp:YF23_HAEIN | | | P44243 |

Description

HYPOTHETICAL PROTEIN HI1523

-continued

| ORF Name | NTID | AAID | NT Length | AA Length | Score | Probability |
|---|---|---|---|---|---|---|
| 14348958_f2_14 | 1474 | 6696 | 87 | 264 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 14650012_f3_26 | 1475 | 6697 | 145 | 435 | 73 | 0.022 |

| Protein name | | | | Locus Name | | Acc# |
|---|---|---|---|---|---|---|
| glucosidase II beta-subunit | | | | gp:AF066061 | | AF066061 |

Description

*Mus musculus* glucosidase II beta-subunit gene, alternatively spliced products, partial cds.

| ORF Name | NTID | AAID | NT Length | AA Length | Score | Probability |
|---|---|---|---|---|---|---|
| 15835261_c1_28 | 1476 | 6698 | 116 | 351 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 23472832_c1_31 | 1477 | 6699 | 366 | 1101 | 454 | 6.8e−43 |

| Protein name | | | | Locus Name | | Acc# |
|---|---|---|---|---|---|---|
| | | | | sp:CBH_CLOPE | | P54965 |

Description

HYDROLASE) (CBAH) (BILE SALT HYRDOLASE)

| ORF Name | NTID | AAID | NT Length | AA Length | Score | Probability |
|---|---|---|---|---|---|---|
| 24337962_f1_6 | 1478 | 6700 | 62 | 189 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24798401_f1_2 | 1479 | 6701 | 141 | 426 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 30355305_f3_24 | 1480 | 6702 | 271 | 816 | 409 | 4.0e−38 |

| Protein name | Locus Name | Acc# |
|---|---|---|
| | sp:SOJ_BACSU | P37522 |

Description

SOJ PROTEIN

| ORF Name | NTID | AAID | NT Length | AA Length | Score | Probability |
|---|---|---|---|---|---|---|
| 33882837_f3_25 | 1481 | 6703 | 97 | 294 | 80 | 0.024 |

| Protein name | Locus Name | Acc# |
|---|---|---|
| hypothetical protein F20D10.230 | pir:T05638 | T05638 |

Description

| ORF Name | NTID | AAID | NT Length | AA Length | Score | Probability |
|---|---|---|---|---|---|---|
| 4407575_f2_12 | 1482 | 6704 | 522 | 1569 | 115 | 2.8e−10 |

| Protein name | Locus Name | Acc# |
|---|---|---|
| endo-xylanase homolog PCZA361.14 | pir:T17480 | T17480 |

Description

| ORF Name | NTID | AAID | NT Length | AA Length | Score | Probability |
|---|---|---|---|---|---|---|
| 5869167_f1_7 | 1483 | 6705 | 73 | 222 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 6838437_f1_1 | 1484 | 6706 | 422 | 1269 | 100 | 0.0024 |

| Protein name | Locus Name | Acc# |
|---|---|---|
| outer membrane protein | gp:BNROMPB | L77614 |

Description

Bactericides thetiaotaomicron outer membrane protein (susD) gene, complete cds.

| ORF Name | NTID | AAID | NT Length | AA Length | Score | Probability |
|---|---|---|---|---|---|---|
| 10547256_f2_6 | 1485 | 6707 | 81 | 246 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 11126552_c2_14 | 1486 | 6708 | 152 | 459 | 95 | 7.5e−05 |

| Protein name | Locus Name | Acc# |
|---|---|---|
| hypothetical protein aq_1018 | pir:H70387 | H70387 |

Description

| ORF Name | NTID | AAID | NT Length | AA Length | Score | Probability |
|---|---|---|---|---|---|---|
| 2117841_f1_1 | 1487 | 6709 | 749 | 2250 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 26682828_c3_19 | 1488 | 6710 | 136 | 411 | 93 | 0.023 |

| Protein name | Locus Name | Acc# |
|---|---|---|
| surface exclusion protein sep1 precursor | pir:S72375 | S72375 |

Description

| ORF Name | NTID | AAID | NT Length | AA Length | Score | Probability |
|---|---|---|---|---|---|---|
| 31417187_c1_10 | 1489 | 6711 | 261 | 786 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 6035687_c2_18 | 1490 | 6712 | 265 | 795 | 1378 | 8.3e−141 |

| Protein name | Locus Name | Acc# |
|---|---|---|
| fructanase | pir:A36915 | A36915 |

Description

| ORF Name | NTID | AAID | NT Length | AA Length | Score | Probability |
|---|---|---|---|---|---|---|
| 85912_c1_11 | 1491 | 6713 | 790 | 2373 | 2229 | 5.5e−231 |

| Protein name | Locus Name | Acc# |
|---|---|---|
| | gp:BNRSCRL | M83774 |

Description

*Bacteroides fragilis* levanase (scrL) gene, complete cds.

| ORF Name | NTID | AAID | NT Length | AA Length | Score | Probability |
|---|---|---|---|---|---|---|
| 14333277_c1_10 | 1492 | 6714 | 127 | 384 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 15735882__f3__5 | 1493 | 6715 | 400 | 1203 | 696 | 1.5e−68 |

| Protein name | Locus Name | Acc# |
|---|---|---|
| renin-binding protein-related protein:protein slr1975:protein slr1975 | pir:S75649 | S75649 |

Description

| ORF Name | NTID | AAID | NT Length | AA Length | Score | Probability |
|---|---|---|---|---|---|---|
| 26819566__f3__4 | 1494 | 6716 | 73 | 222 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 31381__f3__6 | 1495 | 6717 | 417 | 1254 | 280 | 8.7e−23 |

| Protein name | Locus Name | Acc# |
|---|---|---|
| hexuronate transporter homolog yjmG | pir:A69853 | A69853 |

Description

| ORF Name | NTID | AAID | NT Length | AA Length | Score | Probability |
|---|---|---|---|---|---|---|
| 3956707__f1__1 | 1496 | 6718 | 149 | 450 | 126 | 1.4e−07 |

| Protein name | Locus Name | Acc# |
|---|---|---|
| N-acetylneuraminate lyase | gp:CPNANA | Y12876 |

Description

*C. perfringens* gene encoding N-acetylneuraminate lyase and two partial open reading frames.

| ORF Name | NTID | AAID | NT Length | AA Length | Score | Probability |
|---|---|---|---|---|---|---|
| 5117337__f2__3 | 1497 | 6719 | 150 | 453 | 201 | 4.4e−16 |

| Protein name | Locus Name | Acc# |
|---|---|---|
| | sp:YNCH__HAEIN | P44583 |

Description

HYPOTHETICAL PROTEIN HI0227

| ORF Name | NTID | AAID | NT Length | AA Length | Score | Probability |
|---|---|---|---|---|---|---|
| 781932__f3__7 | 1498 | 6720 | 698 | 2094 | 543 | 3.1e−53 |

| Protein name | Locus Name | Acc# |
|---|---|---|
| 115K outer membrane protein precursor:SusC protein | pir:JC6027 | JC6027 |

Description

-continued

| ORF Name | NTID | AAID | NT Length | AA Length | Score | Probability |
|---|---|---|---|---|---|---|
| 11209542_c3_31 | 1499 | 6721 | 73 | 222 | | |

| Protein name | | Locus Name | Acc# |
|---|---|---|---|
| | | | |

Description

NO-HIT

| ORF Name | NTID | AAID | NT Length | AA Length | Score | Probability |
|---|---|---|---|---|---|---|
| 24023442_c3_32 | 1500 | 6722 | 329 | 990 | 630 | 1.5e−61 |

| Protein name | | Locus Name | Acc# |
|---|---|---|---|
| metabolite transporter homolog yfnA | | pir:D69814 | D69814 |

Description

| ORF Name | NTID | AAID | NT Length | AA Length | Score | Probability |
|---|---|---|---|---|---|---|
| 25433212_f1_2 | 1501 | 6723 | 116 | 351 | 193 | 5.1e−14 |

| Protein name | | Locus Name | Acc# |
|---|---|---|---|
| alpha-N-acetylglucosaminidase | | gp:NTA18209 | Y18209 |

Description

Nicotiana tabacum mRNA for alpha-N-acetylglucosaminidase.

| ORF Name | NTID | AAID | NT Length | AA Length | Score | Probability |
|---|---|---|---|---|---|---|
| 26681533_c2_26 | 1502 | 6724 | 202 | 609 | 327 | 3.5e−29 |

| Protein name | | Locus Name | Acc# |
|---|---|---|---|
| probable cationic amino acid transporter | | pir:T34694 | T34694 |

Description

| ORF Name | NTID | AAID | NT Length | AA Length | Score | Probability |
|---|---|---|---|---|---|---|
| 29931309_c1_18 | 1503 | 6725 | 432 | 1299 | 195 | 1.9e−12 |

| Protein name | | Locus Name | Acc# |
|---|---|---|---|
| immunoreactive 52 kD antigen PG41 | | gp:AF175716 | AF175716 |

Description

*Porphyromonas gingivalis* strain W50 immunoreactive 52 kD antigen PG41 gene, complete cds.

| ORF Name | NTID | AAID | NT Length | AA Length | Score | Probability |
|---|---|---|---|---|---|---|
| 30516442_f1_1 | 1504 | 6726 | 446 | 1341 | 618 | 2.9e−60 |

| Protein name | | Locus Name | Acc# |
|---|---|---|---|
| | | sp:ANAG_HUMAN | P54802 |

Description

GLUCOSAMINIDASE) (NAG)

-continued

| ORF Name | NTID | AAID | NT Length | AA Length | Score | Probability |
|---|---|---|---|---|---|---|
| 10580062_c2_93 | 1505 | 6727 | 301 | 903 | 279 | 8.0e−24 |

| Protein name | Locus Name | Acc# |
|---|---|---|
| 60 kDa protein | gp:AB004560 | AB004560 |

Description

*Porphyromonas gingivalis* DNA for 60 kDa protein, complete cds.

| ORF Name | NTID | AAID | NT Length | AA Length | Score | Probability |
|---|---|---|---|---|---|---|
| 13175950_c2_91 | 1506 | 6728 | 72 | 219 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 13869000_c2_78 | 1507 | 6729 | 999 | 3000 | 886 | 1.6e−109 |

| Protein name | Locus Name | Acc# |
|---|---|---|
| 115K outer membrane protein precursor:SusC protein | pir:JC6027 | JC6027 |

Description

| ORF Name | NTID | AAID | NT Length | AA Length | Score | Probability |
|---|---|---|---|---|---|---|
| 14347666_f2_26 | 1508 | 6730 | 68 | 207 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 14647808_f2_20 | 1509 | 6731 | 287 | 864 | 126 | 4.3e−06 |

| Protein name | Locus Name | Acc# |
|---|---|---|
| | sp:YDIP_ECOLI | P77402 |

Description

HYPOTHETICAL TRANSCRIPTIONAL REGULATOR IN AROD-PPS INTERGENIC REGION

| ORF Name | NTID | AAID | NT Length | AA Length | Score | Probability |
|---|---|---|---|---|---|---|
| 14660892_c1_74 | 1510 | 6732 | 207 | 624 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 15835062_f1_18 | 1511 | 6733 | 96 | 291 | 78 | 0.0048 |

| Protein name | Locus Name | Acc# |
|---|---|---|
| hypothetical protein c04005 | pir:S75372 | S75372 |

Description

| ORF Name | NTID | AAID | NT Length | AA Length | Score | Probability |
|---|---|---|---|---|---|---|
| 20007812_c3_102 | 1512 | 6734 | 467 | 1404 | 195 | 1.7e−12 |

| Protein name | Locus Name | Acc# |
|---|---|---|
| transposase | gp:AF038866 | AF038866 |

Description

*Bacteroides fragilis* transposon Tn5520 transposase (bipH) and mobilization protein BmpH (bmpH) genes, complete cds.

| ORF Name | NTID | AAID | NT Length | AA Length | Score | Probability |
|---|---|---|---|---|---|---|
| 22683287_f3_56 | 1513 | 6735 | 486 | 1461 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24492177_c2_88 | 1514 | 6736 | 342 | 1029 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24895165_f1_13 | 1515 | 6737 | 65 | 198 | 47 | 0.029 |

| Protein name | Locus Name | Acc# |
|---|---|---|
| hypothetical protein T11B7.2 | pir:T24826 | T24826 |

Description

| ORF Name | NTID | AAID | NT Length | AA Length | Score | Probability |
|---|---|---|---|---|---|---|
| 26771041_c3_94 | 1516 | 7838 | 260 | 783 | 417 | 5.7e−39 |

| Protein name | Locus Name | Acc# |
|---|---|---|
| hypothetical protein C33G8.2 | pir:T34137 | T34137 |

Description

-continued

| ORF Name | NTID | AAID | NT Length | AA Length | Score | Probability |
|---|---|---|---|---|---|---|
| 33772811_f3_47 | 1517 | 6739 | 109 | 330 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 34510418_c1_63 | 1518 | 6749 | 259 | 780 | 424 | 1.0e−39 |

| Protein name | | | | Locus Name | | Acc# |
|---|---|---|---|---|---|---|
| hypothetical protein F36H12.3 | | | | pir:T33457 | | T33457 |

Description

| ORF Name | NTID | AAID | NT Length | AA Length | Score | Probability |
|---|---|---|---|---|---|---|
| 35734500_c2_79 | 1519 | 6741 | 512 | 1539 | 202 | 7.9e−13 |

| Protein name | | | | Locus Name | | Acc# |
|---|---|---|---|---|---|---|
| unknown | | | | gp:U96771 | | U96771 |

Description

*Prevotella bryantii* putative polygalacturonase, B-1,4-endoglucanase, and mannanase genes, complete cds; and unknown genes.

| ORF Name | NTID | AAID | NT Length | AA Length | Score | Probability |
|---|---|---|---|---|---|---|
| 36198958_c2_76 | 1520 | 6742 | 278 | 837 | 430 | 2.4e−40 |

| Protein name | | | | Locus Name | | Acc# |
|---|---|---|---|---|---|---|
| hypothetical protein C33G8.2 | | | | pir:T34137 | | T34137 |

Description

| ORF Name | NTID | AAID | NT Length | AA Length | Score | Probability |
|---|---|---|---|---|---|---|
| 36574092_c2_80 | 1521 | 6743 | 430 | 1293 | 545 | 3.1e−59 |

| Protein name | | | | Locus Name | | Acc# |
|---|---|---|---|---|---|---|
| | | | | sp:YBDN_ECOLI | | P77216 |

Description

HYPOTHETICAL 47.8 KD PROTEIN IN CSTA-DSBG INTERGENIC REGION

| ORF Name | NTID | AAID | NT Length | AA Length | Score | Probability |
|---|---|---|---|---|---|---|
| 397175_c2_77 | 1522 | 6744 | 176 | 531 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 4062906_c3_101 | 1523 | 6745 | 785 | 2358 | 130 | 1.3e−08 |

| Protein name | | | Locus Name | | Acc# | |
|---|---|---|---|---|---|---|
| | | | sp:FYUA_YEREN | | P46360 | |

Description

PESTICIN RECEPTOR PRECURSOR (IRPC) (IPR65)

| ORF Name | NTID | AAID | NT Length | AA Length | Score | Probability |
|---|---|---|---|---|---|---|
| 4969091_c3_97 | 1524 | 6746 | 138 | 417 | | |

| Protein name | | | Locus Name | | Acc# | |
|---|---|---|---|---|---|---|

Description

NO-HIT

| ORF Name | NTID | AAID | NT Length | AA Length | Score | Probability |
|---|---|---|---|---|---|---|
| 5900377_c1_66 | 1525 | 6747 | 177 | 534 | 351 | 5.6e−32 |

| Protein name | | | Locus Name | | Acc# | |
|---|---|---|---|---|---|---|
| | | | sp:YBDM_ECOLI | | P77174 | |

Description

HYPOTHETICAL 23.9 KD PROTEIN IN CSTA-DSBG INTERGENIC REGION

| ORF Name | NTID | AAID | NT Length | AA Length | Score | Probability |
|---|---|---|---|---|---|---|
| 6485055_c2_89 | 1526 | 6748 | 92 | 279 | | |

| Protein name | | | Locus Name | | Acc# | |
|---|---|---|---|---|---|---|

Description

NO-HIT

| ORF Name | NTID | AAID | NT Length | AA Length | Score | Probability |
|---|---|---|---|---|---|---|
| 103287_f3_99 | 1527 | 6749 | 501 | 1506 | 479 | 1.5e−45 |

| Protein name | | | Locus Name | | Acc# | |
|---|---|---|---|---|---|---|
| immunoreactive 51 kD antigen PG52 | | | gp:AF175719 | | AF175719 | |

Description

*Porphyromonas gingivalis* strain W50 immunoreactive 51 kD antigen PG52 gene, complete cds.

| ORF Name | NTID | AAID | NT Length | AA Length | Score | Probability |
|---|---|---|---|---|---|---|
| 11976562_c3_189 | 1528 | 6750 | 61 | 186 | | |

| Protein name | | | Locus Name | | Acc# | |
|---|---|---|---|---|---|---|

Description

NO-HIT

-continued

| ORF Name | NTID | AAID | NT Length | AA Length | Score | Probability |
|---|---|---|---|---|---|---|
| 12304718_f1_2 | 1529 | 6751 | 518 | 1557 | 139 | 3.1e−13 |

| Protein name | Locus Name | Acc# |
|---|---|---|
| | sp:BGAL_THEET | P77989 |

Description

BETA-GALACTOSIDASE, (LACTASE)

| ORF Name | NTID | AAID | NT Length | AA Length | Score | Probability |
|---|---|---|---|---|---|---|
| 13704552_c1_129 | 1530 | 6752 | 496 | 1491 | 1403 | 1.9e−143 |

| Protein name | Locus Name | Acc# |
|---|---|---|
| | sp:6PGD_TREPA | O83351 |

Description

6-PHOSPHOGLUCONATE DEHYDROGENASE, DECARBOXYLATING,

| ORF Name | NTID | AAID | NT Length | AA Length | Score | Probability |
|---|---|---|---|---|---|---|
| 13758530_c3_190 | 1531 | 6753 | 136 | 411 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 13907312_c3_186 | 1532 | 6754 | 74 | 225 | 77 | 0.0096 |

| Protein name | Locus Name | Acc# |
|---|---|---|
| putative signal transduction protein GarA | gp:AF173844 | AF173844 |

Description

*Mycobacterium smegmatis* garA-containing gene cluster, partial sequence.

| ORF Name | NTID | AAID | NT Length | AA Length | Score | Probability |
|---|---|---|---|---|---|---|
| 13962757_c2_175 | 1533 | 6755 | 383 | 1152 | 350 | 7.2e−32 |

| Protein name | Locus Name | Acc# |
|---|---|---|
| cytochrome d oxidase subunit II | gp:AF001503 | AF001503 |

Description

*Salmonella typhimurium* cytochrome d oxidase subunit I (cydA) and cytochrome d oxidase subunit II (cydB) genes, complete cds.

| ORF Name | NTID | AAID | NT Length | AA Length | Score | Probability |
|---|---|---|---|---|---|---|
| 1444627_c1_132 | 1534 | 6756 | 62 | 189 | 58 | 0.039 |

| Protein name | Locus Name | Acc# |
|---|---|---|
| ribosomal protein S5 | gp:U87145 | U87145 |

Description

*Toxoplasma gondii* chloroplast, complete genome.

-continued

| ORF Name | NTID | AAID | NT Length | AA Length | Score | Probability |
|---|---|---|---|---|---|---|
| 16441305_f3_103 | 1535 | 6757 | 236 | 711 | 244 | 1.2e−20 |

| Protein name | Locus Name | Acc# |
|---|---|---|
| hypothetical protein b2381 | pir:B65012 | B65012 |

Description

| ORF Name | NTID | AAID | NT Length | AA Length | Score | Probability |
|---|---|---|---|---|---|---|
| 16517156_f3_101 | 1536 | 6758 | 450 | 1353 | 717 | 9.2e−71 |

| Protein name | Locus Name | Acc# |
|---|---|---|
| hypothetical protein | pir:S76946 | S76946 |

Description

| ORF Name | NTID | AAID | NT Length | AA Length | Score | Probability |
|---|---|---|---|---|---|---|
| 19687836_f3_87 | 1538 | 6760 | 429 | 1290 | 945 | 6.4e−95 |

| Protein name | Locus Name | Acc# |
|---|---|---|
| | sp:YCAJ_HAEIN | P45262 |

Description

HYPOTHETICAL PROTEIN HI1590

| ORF Name | NTID | AAID | NT Length | AA Length | Score | Probability |
|---|---|---|---|---|---|---|
| 2068766_c1_143 | 1539 | 6761 | 525 | 1578 | 1098 | 3.9e−111 |

| Protein name | Locus Name | Acc# |
|---|---|---|
| | sp:CYDA_AZOVI | Q09049 |

Description

CYTOCHROME D UBIQUINOL OXIDASE SUBUNIT I,

| ORF Name | NTID | AAID | NT Length | AA Length | Score | Probability |
|---|---|---|---|---|---|---|
| 20735878_c2_163 | 1540 | 6762 | 142 | 429 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 2204377_f2_70 | 1541 | 6763 | 446 | 1341 | 911 | 2.6e−91 |

| Protein name | Locus Name | Acc# |
|---|---|---|
| RumB(R391) | gp:XXU13633 | U13633 |

Description

IncJ plasmid R391 rumA(R391) and rumB(R391) genes, complete cds.

-continued

| ORF Name | NTID | AAID | NT Length | AA Length | Score | Probability |
|---|---|---|---|---|---|---|
| 22273312_c1_131 | 1542 | 6764 | 287 | 864 | 271 | 1.7e−23 |

| Protein name | Locus Name | Acc# |
|---|---|---|
| urea transport protein | gp:AF167577 | AF167577 |

Description

*Actinobacillus pleuropneumoniae* transcriptional regulator (apuR) gene, partial cds; and putative periplasmic binding protein (cbiK), putative cytoplasmic membrane protein (cbiL), cobalt membrane transport protein homolog (cbiM), cobalt membrane transport protein homolog (cbiQ), cobalt transport ATP-binding protein homolog (cbiO), and urea transport protein

| ORF Name | NTID | AAID | NT Length | AA Length | Score | Probability |
|---|---|---|---|---|---|---|
| 22535925_c2_176 | 1543 | 6765 | 359 | 1080 | 184 | 2.2e−12 |

| Protein name | Locus Name | Acc# |
|---|---|---|
| molybdate metabolism regulator | pir:B64979 | B64979 |

Description

| ORF Name | NTID | AAID | NT Length | AA Length | Score | Probability |
|---|---|---|---|---|---|---|
| 22941306_f2_62 | 1544 | 6766 | 258 | 777 | 651 | 9.1e−64 |

| Protein name | Locus Name | Acc# |
|---|---|---|
| ABC transporter, ATP-binding protein | pir:H72385 | H72385 |

Description

| ORF Name | NTID | AAID | NT Length | AA Length | Score | Probability |
|---|---|---|---|---|---|---|
| 23985880_f1_26 | 1545 | 6767 | 105 | 318 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24100265_c3_188 | 1546 | 6768 | 505 | 1518 | 1300 | 1.5e−132 |

| Protein name | Locus Name | Acc# |
|---|---|---|
| | sp:G6PD_ACTAC | P77809 |

Description

GLUCOSE-6-PHOSPHATE 1-DEHYDROGENASE, (G6PD)

| ORF Name | NTID | AAID | NT Length | AA Length | Score | Probability |
|---|---|---|---|---|---|---|
| 24229800_f3_98 | 1547 | 6769 | 79 | 240 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 24647180_c3_191 | 1548 | 6770 | 690 | 2073 | 101 | 0.0017 |

| Protein name | Locus Name | Acc# |
|---|---|---|
| hypothetical protein MTH357 | pir:A69146 | A69146 |

Description

| ORF Name | NTID | AAID | NT Length | AA Length | Score | Probability |
|---|---|---|---|---|---|---|
| 25517013_f1_1 | 1549 | 6771 | 297 | 894 | 392 | 3.8e−35 |

| Protein name | Locus Name | Acc# |
|---|---|---|
| putative secreted beta-galactosidase | gp:SCF81 | AL133171 |

Description

*Streptomyces coelicolor* cosmid F81.

| ORF Name | NTID | AAID | NT Length | AA Length | Score | Probability |
|---|---|---|---|---|---|---|
| 25667675_c3_205 | 1550 | 6772 | 341 | 1026 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 25970016_f3_100 | 1551 | 6773 | 411 | 1236 | 326 | 2.5e−29 |

| Protein name | Locus Name | Acc# |
|---|---|---|
| probable membrane protein b0878 | pir:F64826 | F64826 |

Description

| ORF Name | NTID | AAID | NT Length | AA Length | Score | Probability |
|---|---|---|---|---|---|---|
| 31769537_f1_24 | 1552 | 6774 | 206 | 621 | 222 | 2.0e−17 |

| Protein name | Locus Name | Acc# |
|---|---|---|
| | sp:YEHU_ECOLI | |

Description

HYPOTHETICAL 62.1 KD PROTEIN IN MOLR-BGLX INTERGENIC REGION PRECURSOR

| ORF Name | NTID | AAID | NT Length | AA Length | Score | Probability |
|---|---|---|---|---|---|---|
| 31886308_c2_159 | 1553 | 6775 | 259 | 780 | 387 | 8.6e−36 |

| Protein name | Locus Name | Acc# |
|---|---|---|
| probable glucose-6-phosphate 1-dehydrogenase | pir:C71319 | C71319 |

Description

-continued

| ORF Name | NTID | AAID | NT Length | AA Length | Score | Probability |
|---|---|---|---|---|---|---|
| 3257635_c1_134 | 1554 | 6776 | 426 | 1281 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 34382687_c3_193 | 1555 | 6777 | 419 | 1260 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 3945257_f3_102 | 1556 | 6778 | 158 | 477 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 4103890_c1_147 | 1557 | 6779 | 515 | 1548 | 145 | 9.4e−08 |

| Protein name | | | | Locus Name | | Acc# |
|---|---|---|---|---|---|---|
| conserved hypothetical protein AF0444 | | | | pir:D69305 | | D69305 |

Description

| ORF Name | NTID | AAID | NT Length | AA Length | Score | Probability |
|---|---|---|---|---|---|---|
| 4737662_f1_39 | 1558 | 6780 | 395 | 1188 | 578 | 4.9e−56 |

| Protein name | | | | Locus Name | | Acc# |
|---|---|---|---|---|---|---|
| probable glutamate/aspartate transporter | | | | pir:G71309 | | G71309 |

Description

| ORF Name | NTID | AAID | NT Length | AA Length | Score | Probability |
|---|---|---|---|---|---|---|
| 5117762_f3_106 | 1559 | 6781 | 149 | 450 | 304 | 5.4e−27 |

| Protein name | | | | Locus Name | | Acc# |
|---|---|---|---|---|---|---|
| RumA(R391) | | | | gp:XXU13633 | | U13633 |

Description

IncJ plasmid R391 rumA(R391) and rumB(R391) genes, complete cds.

-continued

| ORF Name | NTID | AAID | NT Length | AA Length | Score | Probability |
|---|---|---|---|---|---|---|
| 5275250_f2_47 | 1560 | 6782 | 319 | 960 | 554 | 1.7e−53 |

| Protein name | Locus Name | Acc# |
|---|---|---|
| | sp:DHGY_METEX | Q59516 |

Description (REDUCTASE) (HPR-A)

| ORF Name | NTID | AAID | NT Length | AA Length | Score | Probability |
|---|---|---|---|---|---|---|
| 7287787_c1_133 | 1561 | 6783 | 267 | 804 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 9770137_c1_145 | 1562 | 6784 | 287 | 864 | 109 | 5.1e−09 |

| Protein name | Locus Name | Acc# |
|---|---|---|
| | gp:AB016260 | |

Description

*Agrobacterium tumefaciens* plasmid pTi-SAKURA, complete sequence.

| ORF Name | NTID | AAID | NT Length | AA Length | Score | Probability |
|---|---|---|---|---|---|---|
| 9922057_c3_206 | 1563 | 6785 | 432 | 1299 | 293 | 8.0e−26 |

| Protein name | Locus Name | Acc# |
|---|---|---|
| coproporphyrinogen oxidase, III, oxygen-independent hemN | pir:B69640 | B69640 |

Description

| ORF Name | NTID | AAID | NT Length | AA Length | Score | Probability |
|---|---|---|---|---|---|---|
| 13869003_f3_21 | 1564 | 6786 | 535 | 1608 | 123 | 0.0010 |

| Protein name | Locus Name | Acc# |
|---|---|---|
| glycoprotein Vp260-like protein A18L | pir:T17508 | T17508 |

Description

| ORF Name | NTID | AAID | NT Length | AA Length | Score | Probability |
|---|---|---|---|---|---|---|
| 23864381_c2_38 | 1565 | 6787 | 474 | 1425 | 747 | 6.1e−74 |

| Protein name | Locus Name | Acc# |
|---|---|---|
| metabolite transport protein homolog ywtG | pir:E70070 | E70070 |

Description

-continued

| ORF Name | NTID | AAID | NT Length | AA Length | Score | Probability |
|---|---|---|---|---|---|---|
| 25632943_c1_29 | 1566 | 6788 | 184 | 555 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 26364040_f1_6 | 1567 | 6789 | 61 | 186 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 33400260_f3_23 | 1568 | 6790 | 503 | 1512 | 124 | 0.00028 |

| Protein name | | | | Locus Name | | Acc# |
|---|---|---|---|---|---|---|
| STARP antigen | | | | gp:PFSTARP | | Z26314 |

Description

*P. falciparum* gene for STARP antigen.

| ORF Name | NTID | AAID | NT Length | AA Length | Score | Probability |
|---|---|---|---|---|---|---|
| 791406_c3_44 | 1569 | 6791 | 70 | 213 | 77 | 0.026 |

| Protein name | | | | Locus Name | | Acc# |
|---|---|---|---|---|---|---|
| | | | | sp:ATP6_ACACA | | Q37385 |

Description

ATP SYNTHASE A CHAIN, (PROTEIN 6)

| ORF Name | NTID | AAID | NT Length | AA Length | Score | Probability |
|---|---|---|---|---|---|---|
| 9862501_c3_41 | 1570 | 6792 | 109 | 330 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 14664052_f3_7 | 1571 | 6793 | 205 | 618 | 545 | 1.6e−52 |

| Protein name | | | | Locus Name | | Acc# |
|---|---|---|---|---|---|---|
| | | | | gp:PGPGAAGEN | | X95938 |

Description

*P. gingivalis* rnhB & pgaA genes & orfs 150, 197, 202 & 199.

-continued

| ORF Name | NTID | AAID | NT Length | AA Length | Score | Probability |
|---|---|---|---|---|---|---|
| 34406512_f1_4 | 1572 | 6794 | 311 | 936 | 663 | 4.9e−65 |

| Protein name | Locus Name | Acc# |
|---|---|---|
| 2,3-bisphosphoglycerate-independent | gp:AF120090 | AF120090 |

Description

*Bacillus megaterium* 2,3-bisphosphoglycerate-independentphosphoglycerate mutase (pgm) gene, complete cds.

| ORF Name | NTID | AAID | NT Length | AA Length | Score | Probability |
|---|---|---|---|---|---|---|
| 36135311_c1_9 | 1573 | 6795 | 315 | 948 | 444 | 7.8e−42 |

| Protein name | Locus Name | Acc# |
|---|---|---|
| probable transport protein | pir:A75272 | A75272 |

Description

| ORF Name | NTID | AAID | NT Length | AA Length | Score | Probability |
|---|---|---|---|---|---|---|
| 36330175_f1_5 | 1574 | 6796 | 62 | 186 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 15039156_f3_6 | 1575 | 6797 | 192 | 579 | 398 | 4.7e−36 |

| Protein name | Locus Name | Acc# |
|---|---|---|
| putative large secreted protein | gp:SCF12 | AL117669 |

Description

*Streptomyces coelicolor* cosmid F12.

| ORF Name | NTID | AAID | NT Length | AA Length | Score | Probability |
|---|---|---|---|---|---|---|
| 15117192_f2_5 | 1576 | 6798 | 89 | 270 | 79 | 0.042 |

| Protein name | Locus Name | Acc# |
|---|---|---|
| | gp:PFMAL3P7 | |

Description

*Plasmodium falciparum* MAL3P7, complete sequence.

| ORF Name | NTID | AAID | NT Length | AA Length | Score | Probability |
|---|---|---|---|---|---|---|
| 24343756_c1_7 | 1577 | 6799 | 62 | 189 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 4860650_f1_3 | 1578 | 6800 | 95 | 288 | 75 | 0.0099 |

| Protein name | Locus Name | Acc# |
|---|---|---|
| ct602 hypothetical protein | pir:F72036 | F72036 |

Description

| ORF Name | NTID | AAID | NT Length | AA Length | Score | Probability |
|---|---|---|---|---|---|---|
| 10660763_c3_339 | 1579 | 6801 | 387 | 1164 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 1176302_f1_16 | 1580 | 6802 | 799 | 2400 | 150 | 3.0e−14 |

| Protein name | Locus Name | Acc# |
|---|---|---|
| putative TonB-dependent outer membrane receptor | gp:AF048749 | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 12117076_c1_211 | 1581 | 6803 | 67 | 204 | | |

| Protein | Locus Name | Acc# |
|---|---|---|
| | | |

Description

NO-HIT

| ORF Name | NTID | AAID | NT Length | AA Length | Score | Probability |
|---|---|---|---|---|---|---|
| 12506402_f1_15 | 1582 | 6804 | 954 | 2865 | 249 | 4.1e−17 |

| Protein | Locus Name | Acc# |
|---|---|---|
| putative histidine protein kinase | gp:RUE82564 | U82564 |

Description hydrogenase-like protein small subunit (hoxB) gene, hydrogenase-like protein large subunit (hoxC) gene, and putative histidine protein kinase (hoxJ) gene, complete cds, and nickel permease (hoxN) gene, partial cds.

| ORF Name | NTID | AAID | NT Length | AA Length | Score | Probability |
|---|---|---|---|---|---|---|
| 12540880_c3_343 | 1583 | 6805 | 343 | 1032 | 361 | 4.9e−33 |

| Protein name | Locus Name | Acc# |
|---|---|---|
| capsular polysaccharide biosynthesis homolog yveT | pir:A70037 | A70037 |

Description

-continued

| ORF Name | NTID | AAID | NT Length | AA Length | Score | Probability |
|---|---|---|---|---|---|---|
| 12714062_c3_354 | 1584 | 6806 | 76 | 231 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 1290933_f3_136 | 1585 | 6807 | 143 | 432 | 165 | 2.9e−12 |

| Protein name | | | | Locus Name | | Acc# |
|---|---|---|---|---|---|---|
| hypothetical protein slr1861 | | | | pir:S77097 | | S77097 |

Description

| ORF Name | NTID | AAID | NT Length | AA Length | Score | Probability |
|---|---|---|---|---|---|---|
| 12923260_c2_271 | 1586 | 6808 | 516 | 1551 | 207 | 1.6e−13 |

| Protein name | | | | Locus Name | | Acc# |
|---|---|---|---|---|---|---|
| putative flippase | | | | gp:AF125164 | | AF125164 |

Description

*Bacteroides fragilis* 638R polysaccharide B (PS B2) biosynthesislocus, complete sequence; and unknown genes.

| ORF Name | NTID | AAID | NT Length | AA Length | Score | Probability |
|---|---|---|---|---|---|---|
| 14070180_c1_202 | 1587 | 6809 | 150 | 453 | 175 | 2.5e−13 |

| Protein name | | | | Locus Name | | Acc# |
|---|---|---|---|---|---|---|
| hypothetical protein 1 | | | | pir:S28678 | | S28678 |

Description

| ORF Name | NTID | AAID | NT Length | AA Length | Score | Probability |
|---|---|---|---|---|---|---|
| 1448442_c1_203 | 1588 | 6810 | 354 | 1065 | 599 | 2.9e−58 |

| Protein name | | | | Locus Name | | Acc# |
|---|---|---|---|---|---|---|
| mannose-1-phosphate guanylyltransferase | | | | pir:H72303 | | H72303 |

Description

| ORF Name | NTID | AAID | NT Length | AA Length | Score | Probability |
|---|---|---|---|---|---|---|
| 14567135_c1_201 | 1589 | 6811 | 369 | 1110 | 118 | 0.00040 |

| Protein name | | | | Locus Name | | Acc# |
|---|---|---|---|---|---|---|
| immunoreactive 43 kD antigen PG32 | | | | gp:AF175714 | | AF175714 |

Description

*Porphyromonas gingivalis* strain W50 immunoreactive 43 kD antigen PG32 gene, complete cds.

-continued

| ORF Name | NTID | AAID | NT Length | AA Length | Score | Probability |
|---|---|---|---|---|---|---|
| 14658342_f2_65 | 1590 | 6812 | 583 | 1752 | 139 | 2.5e−06 |

| Protein name | Locus Name | Acc# |
|---|---|---|
| hypothetical protein SPAC17G6.19c | pir:T37851 | T37851 |

Description

| ORF Name | NTID | AAID | NT Length | AA Length | Score | Probability |
|---|---|---|---|---|---|---|
| 14726512_f1_11 | 1591 | 6813 | 105 | 318 | 161 | 7.6e−12 |

| Protein name | Locus Name | Acc# |
|---|---|---|
| hypothetical protein slr1856 | pir:S77093 | S77093 |

Description

| ORF Name | NTID | AAID | NT Length | AA Length | Score | Probability |
|---|---|---|---|---|---|---|
| 15628390_f1_9 | 1592 | 6814 | 647 | 1944 | 979 | 1.6e−98 |

| Protein name | Locus Name | Acc# |
|---|---|---|
| | sp:CAPD_STAAU | P39853 |

Description

CAPD PROTEIN

| ORF Name | NTID | AAID | NT Length | AA Length | Score | Probability |
|---|---|---|---|---|---|---|
| 15797007_c2_274 | 1593 | 6815 | 383 | 1152 | 322 | 6.6e−29 |

| Protein name | Locus Name | Acc# |
|---|---|---|
| Cps1K | gp:AF155804 | AF155804 |

Description

*Streptococcus suis* strain 6555 Cps1E (cps1E) gene, partial cds; Cps2F (cps2F), Cps1G (cps1G), Cps1H (cps1H), Cps1I (cps1I), and Cps1J (cps1J) genes, complete cds; and Cps1K (cps1K) gene, partial cds.

| ORF Name | NTID | AAID | NT Length | AA Length | Score | Probability |
|---|---|---|---|---|---|---|
| 15822807_f1_2 | 1594 | 6816 | 549 | 1650 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 171902_f1_31 | 1595 | 6817 | 67 | 204 | 49 | 0.037 |

| Protein name | Locus Name | Acc# |
|---|---|---|
| probable RNA-directed DNA polymerase,:reverse transcriptase | pir:S20016 | S20016 |

Description

-continued

| ORF Name | NTID | AAID | NT Length | AA Length | Score | Probability |
|---|---|---|---|---|---|---|
| 19710937_f2_123 | 1596 | 6818 | 490 | 1473 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 19728412_c3_391 | 1597 | 6819 | 459 | 1380 | 472 | 9.2e−54 |

| Protein name | Locus Name | Acc# |
|---|---|---|
| folylpolyglutamate synthase/dihydrofolate synthase | pir:D72411 | D72411 |

Description

| ORF Name | NTID | AAID | NT Length | AA Length | Score | Probability |
|---|---|---|---|---|---|---|
| 2032137_c1_213 | 1598 | 6820 | 88 | 267 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 21651557_c3_338 | 1599 | 6821 | 354 | 1065 | 128 | 2.2e−05 |

| Protein name | Locus Name | Acc# |
|---|---|---|
| hypothetical protein RP338 | pir:D71690 | D71690 |

Description

| ORF Name | NTID | AAID | NT Length | AA Length | Score | Probability |
|---|---|---|---|---|---|---|
| 23455077_c3_348 | 1600 | 6822 | 421 | 1266 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 23594641_c1_195 | 1601 | 6823 | 250 | 753 | 316 | 2.9e−28 |

| Protein name | Locus Name | Acc# |
|---|---|---|
| putative UDP-N-acetyl-D-mannosamine transferase | gp:SPU09239 | U09239 |

Description

*Streptococcus pneumoniae* type 19F capsular polysaccharide biosynthesis operon, (cps19fABCDEFGHIJKLMNO) genes, complete cds, and aliA gene, partial cds.

-continued

| ORF Name | NTID | AAID | NT Length | AA Length | Score | Probability |
|---|---|---|---|---|---|---|
| 23632802_f3_146 | 1602 | 6824 | 270 | 813 | 412 | 1.9e−38 |

| Protein name | | | | Locus Name | | Acc# |
|---|---|---|---|---|---|---|
| | | | | gp:AB008550 | | AB008550 |

Description

*Pseudomonas aeruginosa* phage phi CTX, complete genome sequence.

| ORF Name | NTID | AAID | NT Length | AA Length | Score | Probability |
|---|---|---|---|---|---|---|
| 2377092_f3_153 | 1603 | 6825 | 64 | 195 | 219 | 1.3e−17 |

| Protein name | | | | Locus Name | | Acc# |
|---|---|---|---|---|---|---|
| putative aminotransferase | | | | gp:AF125164 | | AF125164 |

Description

*Bacteroides fragilis* 638R polysaccharide B (PS B2) biosynthesis locus, complete sequence; and unknown genes.

| ORF Name | NTID | AAID | NT Length | AA Length | Score | Probability |
|---|---|---|---|---|---|---|
| 24038512_f3_134 | 1604 | 6826 | 251 | 756 | 375 | 1.6e−34 |

| Protein name | | | | Locus Name | | Acc# |
|---|---|---|---|---|---|---|
| | | | | sp:YACO_BACSU | | Q06753 |

Description

HYPOTHETICAL TRNA/RRNA METHYLTRANSFERASE YACO,

| ORF Name | NTID | AAID | NT Length | AA Length | Score | Probability |
|---|---|---|---|---|---|---|
| 24412537_f1_20 | 1605 | 6827 | 276 | 831 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24413887_c1_200 | 1606 | 6828 | 178 | 537 | 72 | 0.048 |

| Protein name | | | | Locus Name | | Acc# |
|---|---|---|---|---|---|---|
| | | | | sp:Y235_METJA | | Q57687 |

Description

HYPOTHETICAL PROTEIN MJ0235

| ORF Name | NTID | AAID | NT Length | AA Length | Score | Probability |
|---|---|---|---|---|---|---|
| 24417550_f2_120 | 1607 | 6829 | 63 | 192 | 71 | 0.026 |

| Protein name | | | | Locus Name | | Acc# |
|---|---|---|---|---|---|---|
| | | | | sp:FLIT_BACSU | | P39740 |

Description

FLAGELLAR PROTEIN FLIT

-continued

| ORF Name | NTID | AAID | NT Length | AA Length | Score | Probability |
|---|---|---|---|---|---|---|
| 24475937_c3_328 | 1608 | 6830 | 80 | 243 | | |

| Protein name | | | Locus Name | | Acc# | |
|---|---|---|---|---|---|---|

Description

NO-HIT

| ORF Name | NTID | AAID | NT Length | AA Length | Score | Probability |
|---|---|---|---|---|---|---|
| 24506692_c1_243 | 1609 | 6831 | 201 | 606 | | |

| Protein name | | | Locus Name | | Acc# | |
|---|---|---|---|---|---|---|

Description

NO-HIT

| ORF Name | NTID | AAID | NT Length | AA Length | Score | Probability |
|---|---|---|---|---|---|---|
| 24642837_f3_145 | 1610 | 6832 | 114 | 345 | | |

| Protein name | | | Locus Name | | Acc# | |
|---|---|---|---|---|---|---|

Description

NO-HIT

| ORF Name | NTID | AAID | NT Length | AA Length | Score | Probability |
|---|---|---|---|---|---|---|
| 24647535_f1_59 | 1611 | 6833 | 323 | 972 | | |

| Protein name | | | Locus Name | | Acc# | |
|---|---|---|---|---|---|---|

Description

NO-HIT

| ORF Name | NTID | AAID | NT Length | AA Length | Score | Probability |
|---|---|---|---|---|---|---|
| 24651502_c1_218 | 1612 | 6834 | 81 | 246 | | |

| Protein name | | | Locus Name | | Acc# | |
|---|---|---|---|---|---|---|

Description

NO-HIT

| ORF Name | NTID | AAID | NT Length | AA Length | Score | Probability |
|---|---|---|---|---|---|---|
| 24694187_c1_198 | 1613 | 6835 | 449 | 1350 | 128 | 0.00060 |

| Protein name | | | Locus Name | | Acc# | |
|---|---|---|---|---|---|---|
| lacunin | | | gp:AF078161 | | AF078161 | |

Description

*Manduca sexta* lacunin mRNA, complete cds.

| ORF Name | NTID | AAID | NT Length | AA Length | Score | Probability |
|---|---|---|---|---|---|---|
| 24864003_f3_131 | 1614 | 6836 | 403 | 1212 | 842 | 5.2e−84 |

| Protein name | Locus Name | Acc# |
|---|---|---|
| pantothenate metabolism flavoprotein dfp homolog yloI:probable aspartate 1-decarboxylase activase | pir:D69878 | D69878 |

Description

| ORF Name | NTID | AAID | NT Length | AA Length | Score | Probability |
|---|---|---|---|---|---|---|
| 25517305_c3_352 | 1615 | 6837 | 455 | 1368 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 25578390_f1_30 | 1616 | 6838 | 418 | 1257 | 862 | 4.0e−86 |

| Protein name | Locus Name | Acc# |
|---|---|---|
| methylmalonyl-CoA decarboxylase, beta-subunit | gp:PMAJ2015 | AJ002015 |

Description

*Propionigenium modestum* mmdD, mmdC, mmdB genes and partial mmdA gene.

| ORF Name | NTID | AAID | NT Length | AA Length | Score | Probability |
|---|---|---|---|---|---|---|
| 25625438_c1_190 | 1617 | 6839 | 398 | 1197 | 109 | 0.0069 |

| Protein name | Locus Name | Acc# |
|---|---|---|
| transmembrane protein | gp:YSCPTM | L11895 |

Description

*Saccharomyces cerevisiae* putative transmembrane protein (PTM1) gene, complete cds.

| ORF Name | NTID | AAID | NT Length | AA Length | Score | Probability |
|---|---|---|---|---|---|---|
| 26210302_f1_10 | 1618 | 6840 | 393 | 1182 | 252 | 3.3e−36 |

| Protein name | Locus Name | Acc# |
|---|---|---|
| sensory transduction system regulatory protein slr1983:protein slr1983:protein slr1983 | pir:S75664 | S75664 |

Description

| ORF Name | NTID | AAID | NT Length | AA Length | Score | Probability |
|---|---|---|---|---|---|---|
| 26366312_c2_287 | 1619 | 6841 | 159 | 480 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 26369000_f2_81 | 1620 | 6842 | 134 | 405 | 91 | 0.0067 |

| Protein name | Locus Name | Acc# |
|---|---|---|
| positive regulator for virulence factors | gp:CLOORF1 | D14877 |

Description

*Clostridium perfringens* virR gene for positive regulator for virulence factors, complete cds.

| ORF Name | NTID | AAID | NT Length | AA Length | Score | Probability |
|---|---|---|---|---|---|---|
| 26595260_f2_82 | 1621 | 6843 | 206 | 621 | 120 | 5.9e−06 |

| Protein name | Locus Name | Acc# |
|---|---|---|
| hypothetical protein AF0417 | pir:A69302 | A69302 |

Description

| ORF Name | NTID | AAID | NT Length | AA Length | Score | Probability |
|---|---|---|---|---|---|---|
| 26687791_f3_144 | 1622 | 6844 | 193 | 582 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 26815891_c1_187 | 1623 | 6845 | 190 | 573 | 213 | 2.4e−17 |

| Protein name | Locus Name | Acc# |
|---|---|---|
| unknown | gp:AF048749 | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 2767217_f2_89 | 1624 | 6846 | 549 | 1650 | 428 | 3.3e−39 |

| Protein name | Locus Name | Acc# |
|---|---|---|
| 2', 3'-cuclic nucleotide 2'-phosphodiesterase | gp:AB028630 | AB028630 |

Description

*Clostridium perfringens* hyp27, bacH, ptp, cpd genes for hypothetical protein, bacterial hemoglobin, protein-tyrosine phosphatase, 2', 3'-cuclic nucleotide 2'-phosphodiesterase, partial and complete cds.

| ORF Name | NTID | AAID | NT Length | AA Length | Score | Probability |
|---|---|---|---|---|---|---|
| 2848255_f2_124 | 1625 | 6847 | 75 | 228 | 106 | 1.1e−05 |

| Protein name | Locus Name | Acc# |
|---|---|---|
| GlyA | gp:AF136495 | AF136495 |

Description

*Campylobacter lari* GlyA (glyA) gene, partial cds.

-continued

| ORF Name | NTID | AAID | NT Length | AA Length | Score | Probability |
|---|---|---|---|---|---|---|
| 2931557_f1_4 | 1626 | 6848 | 258 | 777 | 217 | 8.9e−18 |

| Protein name | Locus Name | Acc# |
|---|---|---|
| probable DNA pol III epsilon chain | pir:B71536 | B71536 |

Description

| ORF Name | NTID | AAID | NT Length | AA Length | Score | Probability |
|---|---|---|---|---|---|---|
| 29563916_c3_345 | 1627 | 6849 | 368 | 1107 | 366 | 1.4e−33 |

| Protein name | Locus Name | Acc# |
|---|---|---|
| galactosyl transferase | gp:SPN239004 | AJ239004 |

Description

*Streptococcus pneumoniae* type 8 capsular gene cluster.

| ORF Name | NTID | AAID | NT Length | AA Length | Score | Probability |
|---|---|---|---|---|---|---|
| 31423265_c2_276 | 1628 | 6850 | 378 | 1137 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 31849128_f3_133 | 1629 | 6851 | 298 | 897 | 420 | 2.7e−39 |

| Protein name | Locus Name | Acc# |
|---|---|---|
| DNA repair protein | pir:A75391 | A75391 |

Description

| ORF Name | NTID | AAID | NT Length | AA Length | Score | Probability |
|---|---|---|---|---|---|---|
| 32040875_f3_132 | 1630 | 6852 | 263 | 792 | 394 | 1.6e−36 |

| Protein name | Locus Name | Acc# |
|---|---|---|
| | sp:RECN_ECOLI | |

Description

DNA REPAIR PROTEIN RECN (RECOMBINATION PROTEIN N)

| ORF Name | NTID | AAID | NT Length | AA Length | Score | Probability |
|---|---|---|---|---|---|---|
| 32681627_f1_3 | 1631 | 6853 | 151 | 456 | 128 | 2.4e−08 |

| Protein name | Locus Name | Acc# |
|---|---|---|
| | sp:DP3B_VIBHA | P52620 |

Description

DNA POLYMERASE III, BETA CHAIN, (FRAGMENT)

-continued

| ORF Name | NTID | AAID | NT Length | AA Length | Score | Probability |
|---|---|---|---|---|---|---|
| 3322152_c1_199 | 1632 | 6854 | 192 | 579 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 33788882_c1_212 | 1633 | 6855 | 228 | 687 | 395 | 1.2e−36 |

| Protein name | | | | Locus Name | | Acc# |
|---|---|---|---|---|---|---|
| conserved hypothetical protein aq_274 | | | | pir:C70325 | | C70325 |

Description

| ORF Name | NTID | AAID | NT Length | AA Length | Score | Probability |
|---|---|---|---|---|---|---|
| 34070311_c1_191 | 1634 | 6856 | 347 | 1044 | 132 | 7.0e−06 |

| Protein name | | | | Locus Name | | Acc# |
|---|---|---|---|---|---|---|
| transmembrane protein | | | | gp:SPAJ6986 | | AJ006986 |

Description

*Streptococcus pneumoniae* type 33F DNA, capsular gene cluster.

| ORF Name | NTID | AAID | NT Length | AA Length | Score | Probability |
|---|---|---|---|---|---|---|
| 35784765_f2_61 | 1635 | 6857 | 316 | 951 | 593 | 1.3e−57 |

| Protein name | | | | Locus Name | | Acc# |
|---|---|---|---|---|---|---|
| UDP-N-acetylenolpyruvoylglucosamine reductase | | | | gp:BPE238308 | | AJ238308 |

Description

*Bordetella pertussis* partial gene for putative thioesterase, tRNA-Gly, murB, dapB, omlA genes and partial fur gene.

| ORF Name | NTID | AAID | NT Length | AA Length | Score | Probability |
|---|---|---|---|---|---|---|
| 3914642_f2_80 | 1636 | 6858 | 300 | 903 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 3943802_f2_66 | 1637 | 6859 | 133 | 402 | 343 | 4.0e−31 |

| Protein name | | | | Locus Name | | Acc# |
|---|---|---|---|---|---|---|
| YjgF | | | | gp:AF095578 | | AF095578 |

Description

*Salmonella typhimurium* YjgF (yjgF) gene, complete cds; and unknown gene.

-continued

| ORF Name | NTID | AAID | NT Length | AA Length | Score | Probability |
|---|---|---|---|---|---|---|
| 3944687_f3_143 | 1638 | 6860 | 294 | 885 | 221 | 3.3e−18 |
| Protein name | | | Locus Name | | | Acc# |
| hypothetical protein AF0417 | | | pir:A69302 | | | A69302 |
| Description | | | | | | |

| ORF Name | NTID | AAID | NT Length | AA Length | Score | Probability |
|---|---|---|---|---|---|---|
| 4064000_f1_29 | 1639 | 6861 | 88 | 267 | 83 | 0.0014 |
| Protein name | | | Locus Name | | | Acc# |
| probable integral membrane protein | | | pir:T37050 | | | T37050 |
| Description | | | | | | |

| ORF Name | NTID | AAID | NT Length | AA Length | Score | Probability |
|---|---|---|---|---|---|---|
| 4101561_c2_277 | 1640 | 6862 | 392 | 1179 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 4104636_c1_192 | 1641 | 6863 | 191 | 576 | 199 | 7.2e−16 |
| Protein name | | | Locus Name | | | Acc# |
| serine acetyltransferase | | | pir:G72349 | | | G72349 |
| Description | | | | | | |

| ORF Name | NTID | AAID | NT Length | AA Length | Score | Probability |
|---|---|---|---|---|---|---|
| 4149067_c3_341 | 1642 | 6864 | 194 | 585 | 230 | 3.7e−19 |
| Protein name | | | Locus Name | | | Acc# |
| serine acetyltransferase | | | pir:G72349 | | | G72349 |
| Description | | | | | | |

| ORF Name | NTID | AAID | NT Length | AA Length | Score | Probability |
|---|---|---|---|---|---|---|
| 4330032_f2_73 | 1643 | 6865 | 536 | 1611 | 135 | 4.6e−05 |
| Protein name | | | Locus Name | | | Acc# |
| | | | sp:Y143_SYNY3 | | | P74442 |
| Description | | | | | | |

HYPOTHETICAL WD-REPEAT PROTEIN SLR0143

| ORF Name | NTID | AAID | NT Length | AA Length | Score | Probability |
|---|---|---|---|---|---|---|
| 4690675_f3_152 | 1644 | 6866 | 225 | 678 | | |
| Protein name | | | Locus Name | | | Acc# |
| Description | | | | | | |

NO-HIT

-continued

| ORF Name | NTID | AAID | NT Length | AA Length | Score | Probability |
|---|---|---|---|---|---|---|
| 4710902_f1_17 | 1645 | 6867 | 813 | 2442 | 756 | 5.2e−74 |

| Protein name | | | | Locus Name | | Acc# |
|---|---|---|---|---|---|---|
| | | | | sp:BACA_BACLI | | O68006 |

Description

| ORF Name | NTID | AAID | NT Length | AA Length | Score | Probability |
|---|---|---|---|---|---|---|
| 4773261_c1_196 | 1646 | 6868 | 237 | 714 | 103 | 0.017 |

| Protein name | | | | Locus Name | | Acc# |
|---|---|---|---|---|---|---|
| | | | | sp:YJBH_ECOLI | | P32689 |

Description

PRECURSOR

| ORF Name | NTID | AAID | NT Length | AA Length | Score | Probability |
|---|---|---|---|---|---|---|
| 4802168_c3_406 | 1647 | 6869 | 206 | 621 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 4882192_c1_194 | 1648 | 6870 | 409 | 1230 | 162 | 1.4e−09 |

| Protein name | | | | Locus Name | | Acc# |
|---|---|---|---|---|---|---|
| probable lipopolysaccharide N-acetylglucosaminyltransferase, rfbU | | | | pir:F64500 | | F64500 |

Description

| ORF Name | NTID | AAID | NT Length | AA Length | Score | Probability |
|---|---|---|---|---|---|---|
| 4898450_f2_62 | 1649 | 6871 | 255 | 768 | 458 | 2.6e−43 |

| Protein name | | | | Locus Name | | Acc# |
|---|---|---|---|---|---|---|
| phnP protein (phnP) homolog | | | | pir:D70166 | | D70166 |

Description

| ORF Name | NTID | AAID | NT Length | AA Length | Score | Probability |
|---|---|---|---|---|---|---|
| 4954380_f2_90 | 1650 | 6872 | 620 | 1863 | 357 | 4.4e−47 |

| Protein name | | | | Locus Name | | Acc# |
|---|---|---|---|---|---|---|
| oxaloacetate decarboxylase, subunit alpha (oadA) homolog | | | | pir:C69406 | | C69406 |

Description

-continued

| ORF Name | NTID | AAID | NT Length | AA Length | Score | Probability |
|---|---|---|---|---|---|---|
| 4957965_f3_130 | 1651 | 6873 | 265 | 798 | 300 | 1.4e−26 |

| Protein name | Locus Name | Acc# |
|---|---|---|
| | sp:DP3B_PSEPU | P13455 |

Description

DNA POLYMERASE III, BETA CHAIN,

| ORF Name | NTID | AAID | NT Length | AA Length | Score | Probability |
|---|---|---|---|---|---|---|
| 5086537_f2_76 | 1652 | 6874 | 282 | 849 | 251 | 8.3e−21 |

| Protein name | Locus Name | Acc# |
|---|---|---|
| putative histidine protein kinase | gp:REU82564 | U82564 |

Description hydrogenase-like protein small subunit (hoxB) gene, hydrogenase-like protein large subunit (hoxC) gene, and putative histidine protein kinase (hoxJ) gene, complete cds, and nickel permease (hoxN) gene, partial cds.

| ORF Name | NTID | AAID | NT Length | AA Length | Score | Probability |
|---|---|---|---|---|---|---|
| 5260957_c1_193 | 1653 | 6875 | 440 | 1323 | 108 | 2.8e−05 |

| Protein name | Locus Name | Acc# |
|---|---|---|
| | sp:FER_METBA | P00202 |

Description

FERREDOXIN

| ORF Name | NTID | AAID | NT Length | AA Length | Score | Probability |
|---|---|---|---|---|---|---|
| 5272656_c2_275 | 1654 | 6876 | 332 | 999 | 443 | 1.0e−41 |

| Protein name | Locus Name | Acc# |
|---|---|---|
| ss-1,4-galactosyltransferase | gp:SPCPS14E | X85787 |

Description

*S. pneumoniae* cps14 locus.

| ORF Name | NTID | AAID | NT Length | AA Length | Score | Probability |
|---|---|---|---|---|---|---|
| 6048452_f1_21 | 1655 | 6877 | 78 | 237 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 6414677_c1_188 | 1656 | 6878 | 405 | 1218 | 149 | 1.5e−07 |

| Protein name | Locus Name | Acc# |
|---|---|---|
| NADH dehydrogenase (ubiquinone),, 39 kDa subunit homolog | pir:H69478 | H69478 |

Description

-continued

| ORF Name | NTID | AAID | NT Length | AA Length | Score | Probability |
|---|---|---|---|---|---|---|
| 6694425_c3_365 | 1657 | 6879 | 307 | 924 | 420 | 2.7e−39 |

| Protein name | Locus Name | Acc# |
|---|---|---|
| hypothetical protein sll0744 | pir:S77079 | S77079 |

Description

| ORF Name | NTID | AAID | NT Length | AA Length | Score | Probability |
|---|---|---|---|---|---|---|
| 6742762_f1_28 | 1658 | 6880 | 61 | 186 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 6834387_f1_19 | 1659 | 6881 | 120 | 363 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 6845277_c2_288 | 1660 | 6882 | 64 | 195 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 819433_c3_340 | 1661 | 6883 | 371 | 1116 | 339 | 1.0e−30 |

| Protein name | Locus Name | Acc# |
|---|---|---|
| capsular polysaccharide biosynthesis homolog yveT | pir:A70037 | A70037 |

Description

| ORF Name | NTID | AAID | NT Length | AA Length | Score | Probability |
|---|---|---|---|---|---|---|
| 960825_f2_69 | 1662 | 6884 | 465 | 1398 | 771 | 1.7e−76 |

| Protein name | Locus Name | Acc# |
|---|---|---|
| phosphate starvation inducible protein homolog ylaK | pir:A69873 | A69873 |

Description

| ORF Name | NTID | AAID | NT Length | AA Length | Score | Probability |
|---|---|---|---|---|---|---|
| 9773281_f2_125 | 1663 | 6885 | 70 | 210 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 10573830_c1_296 | 1664 | 6886 | 168 | 507 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 10664128_c3_491 | 1665 | 6887 | 214 | 645 | 125 | 1.8e−11 |
| Protein name | | | Locus Name | | | Acc# |
| ribonuclease H, 1 | | | pir:JC5787 | | | JC5787 |
| Description | | | | | | |

| ORF Name | NTID | AAID | NT Length | AA Length | Score | Probability |
|---|---|---|---|---|---|---|
| 10720337_f1_75 | 1666 | 6888 | 211 | 636 | 258 | 4.0e−22 |
| Protein name | | | Locus Name | | | Acc# |
| | | | sp:YC08_YEAST | | | P37261 |
| Description | | | | | | |
| HYPOTHETICAL 21.1 KD PROTEIN IN FUS1-AGP1 INTERGENIC REGION | | | | | | |

| ORF Name | NTID | AAID | NT Length | AA Length | Score | Probability |
|---|---|---|---|---|---|---|
| 10986288_f3_169 | 1667 | 6889 | 406 | 1221 | 149 | 2.2e−07 |
| Protein name | | | Locus Name | | | Acc# |
| hypothetical protein BBI16 | | | pir:G70241 | | | G70241 |
| Description | | | | | | |

| ORF Name | NTID | AAID | NT Length | AA Length | Score | Probability |
|---|---|---|---|---|---|---|
| 10988261_f1_7 | 1668 | 6890 | 714 | 2145 | 1016 | 1.9e−102 |
| Protein name | | | Locus Name | | | Acc# |
| DNA topoisomerase III topB | | | pir:H69724 | | | H69724 |
| Description | | | | | | |

| ORF Name | NTID | AAID | NT Length | AA Length | Score | Probability |
|---|---|---|---|---|---|---|
| 11910250_f2_102 | 1669 | 6891 | 159 | 480 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 11924205_c3_539 | 1670 | 6892 | 110 | 333 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 1212762_c2_390 | 1671 | 6893 | 300 | 903 | 354 | 2.7e−32 |

| Protein name | Locus Name | Acc# |
|---|---|---|
| | gp:AB012957 | AB012957 |

Description

*Vibrio cholerae* genes for o-antigen synthesis, strain O22, complete cds.

| ORF Name | NTID | AAID | NT Length | AA Length | Score | Probability |
|---|---|---|---|---|---|---|
| 12298425_c2_391 | 1672 | 6894 | 300 | 903 | 219 | 5.5e−18 |

| Protein name | Locus Name | Acc# |
|---|---|---|
| putative glycosyl transferase | gp:AF048749 | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 12501087_f2_116 | 1673 | 6895 | 168 | 507 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 12691280_c3_510 | 1674 | 6896 | 1022 | 3069 | 726 | 1.3e−81 |

| Protein name | Locus Name | Acc# |
|---|---|---|
| probable swf/snf helicase | pir:E71481 | E71481 |

Description

| ORF Name | NTID | AAID | NT Length | AA Length | Score | Probability |
|---|---|---|---|---|---|---|
| 13885212_f3_220 | 1675 | 6897 | 388 | 1167 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 14116635_f2_158 | 1676 | 6898 | 416 | 1251 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 14736262_c3_545 | 1677 | 6899 | 427 | 1284 | 241 | 7.6e−20 |

| Protein name | Locus Name | Acc# |
|---|---|---|
| MocB (Tn4399) | pir:B48487 | B48487 |

Description

| ORF Name | NTID | AAID | NT Length | AA Length | Score | Probability |
|---|---|---|---|---|---|---|
| 15017287_f3_252 | 1678 | 6900 | 837 | 2514 | 391 | 2.2e−32 |

| Protein name | Locus Name | Acc# |
|---|---|---|
| enhanced entry protein EnhC | gp:AF057704 | AF057704 |

Description

*Legionella pneumophila* EnhA (enhA), EnhB (enhB), and enhanced entry protein EnhC (enhC) genes, complete cds.

| ORF Name | NTID | AAID | NT Length | AA Length | Score | Probability |
|---|---|---|---|---|---|---|
| 16135886_f3_193 | 1679 | 6901 | 103 | 312 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 16229025_f2_124 | 1680 | 6902 | 280 | 843 | 105 | 0.00081 |

| Protein name | Locus Name | Acc# |
|---|---|---|
| | sp:YS21_BORBU | |

Description

HYPOTHETICAL PROTEIN BBD21

| ORF Name | NTID | AAID | NT Length | AA Length | Score | Probability |
|---|---|---|---|---|---|---|
| 16829717_f3_188 | 1681 | 6903 | 1951 | 5856 | 1011 | 1.5e−118 |

| Protein name | Locus Name | Acc# |
|---|---|---|
| | gp:AB016260 | |

Description

*Agrobacterium tumefaciens* plasmid pTi-SAKURA, complete sequence.

| ORF Name | NTID | AAID | NT Length | AA Length | Score | Probability |
|---|---|---|---|---|---|---|
| 16832885_f2_168 | 1682 | 6904 | 450 | 1353 | 1713 | 2.6e−176 |

| Protein name | Locus Name | Acc# |
|---|---|---|
| hypothetical protein | pir:JQ1020 | JQ1020 |

Description

| ORF Name | NTID | AAID | NT Length | AA Length | Score | Probability |
|---|---|---|---|---|---|---|
| 19562660_f2_134 | 1683 | 6905 | 478 | 1437 | 113 | 0.0074 |

| Protein name | Locus Name | Acc# |
|---|---|---|
| ES/130 | gP:AF006751 | AF006751 |

Description

*Homo sapiens* ES/130 mRNA, complete cds.

| ORF Name | NTID | AAID | NT Length | AA Length | Score | Probability |
|---|---|---|---|---|---|---|
| 197131_f1_35 | 1684 | 6906 | 335 | 1008 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 19945402_f1_57 | 1685 | 6907 | 375 | 1128 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 1995941_f2_89 | 1686 | 6908 | 427 | 1284 | 1049 | 6.1e-106 |

| Protein name | Locus Name | Acc# |
|---|---|---|
| transposase | gp:AF038866 | AF038866 |

Description

*Bacteroides fragilis* transposon Tn5520 transposase (bipH) and mobilization protein BmpH (bmpH) genes, complete cds.

| ORF Name | NTID | AAID | NT Length | AA Length | Score | Probability |
|---|---|---|---|---|---|---|
| 20213132_c2_406 | 1687 | 6909 | 61 | 186 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 2036268_c3_584 | 1688 | 6910 | 84 | 255 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 2053887_f2_143 | 1689 | 6911 | 114 | 345 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 214526_c3_517 | 1690 | 6912 | 66 | 201 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 21484662_f1_6 | 1691 | 6913 | 532 | 1599 | 144 | 9.4e-07 |

| Protein name | | | | Locus Name | | Acc# |
|---|---|---|---|---|---|---|
| | | | | sp:M49_STRPY | | P16947 |

Description

M PROTEIN, SEROTYPE 49 PRECURSOR

| ORF Name | NTID | AAID | NT Length | AA Length | Score | Probability |
|---|---|---|---|---|---|---|
| 21515632_f1_17 | 1692 | 6914 | 785 | 2358 | 3809 | 0.0 |

| Protein name | | | | Locus Name | | Acc# |
|---|---|---|---|---|---|---|
| tetracycline resistance element regulator RteA | | | | pir:A41860 | | A41860 |

Description

| ORF Name | NTID | AAID | NT Length | AA Length | Score | Probability |
|---|---|---|---|---|---|---|
| 21526437_f2_130 | 1693 | 6915 | 138 | 417 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 21601625_c1_295 | 1694 | 6916 | 133 | 402 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 21679626_f1_45 | 1695 | 6917 | 174 | 525 | | |

| Protein name | | Locus Name | Acc# |
|---|---|---|---|
| | | | |

Description

NO-HIT

| ORF Name | NTID | AAID | NT Length | AA Length | Score | Probability |
|---|---|---|---|---|---|---|
| 22459443_c3_486 | 1696 | 6918 | 150 | 453 | 130 | 1.5e-08 |

| Protein name | | Locus Name | Acc# |
|---|---|---|---|
| | | gP:APU72238 | U72238 |

Description

*Anabaena* PCC7120 ORFR1, ORFR2, ORFR3, ORFR4, and ORFR5 genes, complete sequences.

| ORF Name | NTID | AAID | NT Length | AA Length | Score | Probability |
|---|---|---|---|---|---|---|
| 22687625_c3_523 | 1697 | 6919 | 433 | 1302 | 95 | 4.3e-05 |

| Protein name | | Locus Name | Acc# |
|---|---|---|---|
| phage abortive infection protein | | pir:T30326 | T30326 |

Description

| ORF Name | NTID | AAID | NT Length | AA Length | Score | Probability |
|---|---|---|---|---|---|---|
| 22689031_c2_386 | 1698 | 6920 | 386 | 1161 | 1201 | 4.7e-122 |

| Protein name | | Locus Name | Acc# |
|---|---|---|---|
| UDP-galactopyranose mutase | | gp:SPAJ6986 | AJ006986 |

Description

*Streptococcus pneumoniae* type 33F DNA, capsular gene cluster.

| ORF Name | NTID | AAID | NT Length | AA Length | Score | Probability |
|---|---|---|---|---|---|---|
| 22774087_f2_126 | 1699 | 6921 | 246 | 741 | 85 | 0.0034 |

| Protein name | | Locus Name | Acc# |
|---|---|---|---|
| non-structural 5a protein | | gp:HCU56570 | U56570 |

Description

Hepatitis C virus isolate 925821 non-structural 5a (NS5a) gene, partial cds.

| ORF Name | NTID | AAID | NT Length | AA Length | Score | Probability |
|---|---|---|---|---|---|---|
| 22860128_f3_258 | 1700 | 6922 | 83 | 252 | 64 | 0.031 |

| Protein name | | Locus Name | Acc# |
|---|---|---|---|
| | | sp:SPRC_XENLA | P36378 |

Description (OSTEONECTIN) (ON) (BASEMENT MEMBRANE PROTEIN BM-40)

-continued

| ORF Name | NTID | AAID | NT Length | AA Length | Score | Probability |
|---|---|---|---|---|---|---|
| 22892905_f2_115 | 1701 | 6923 | 452 | 1359 | 2093 | 1.4e-216 |

| Protein name | Locus Name | Acc# |
|---|---|---|
| | gp:BNRRTEAB | |

Description

*Bacteroides thetaiotaomicron* rteA and rtaB genes involved inproduction of plasmid-like forms, complete cds, and tetQ gene, 3' end.

| ORF Name | NTID | AAID | NT Length | AA Length | Score | Probability |
|---|---|---|---|---|---|---|
| 23443750_f2_148 | 1702 | 6924 | 433 | 1302 | 160 | 2.4e-08 |

| Protein name | Locus Name | Acc# |
|---|---|---|
| actin binding protein MAYVEN | gp:AF059569 | AF059569 |

Description

*Homo sapiens* actin binding protein MAYVEN mRNA, complete cds.

| ORF Name | NTID | AAID | NT Length | AA Length | Score | Probability |
|---|---|---|---|---|---|---|
| 23492786_f2_162 | 1703 | 6925 | 85 | 258 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 23596911_f2_139 | 1704 | 6926 | 77 | 234 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 23644552_f1_31 | 1705 | 6927 | 941 | 2826 | 537 | 8.3e-85 |

| Protein name | Locus Name | Acc# |
|---|---|---|
| | gp:BFU63096 | U63096 |

Description

*Bacteroides fragilis* (bctA) gene, complete cds.

| ORF Name | NTID | AAID | NT Length | AA Length | Score | Probability |
|---|---|---|---|---|---|---|
| 23710777_c1_327 | 1706 | 6928 | 146 | 441 | 81 | 0.029 |

| Protein name | Locus Name | Acc# |
|---|---|---|
| hypothetical protein | gp:AF036485 | |

Description

Plasmid pNZ4000, complete sequence.

-continued

| ORF Name | NTID | AAID | NT Length | AA Length | Score | Probability |
|---|---|---|---|---|---|---|
| 24251937_f1_1 | 1707 | 6929 | 94 | 285 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24259442_f3_246 | 1708 | 6930 | 313 | 942 | 370 | 5.4e-34 |

| Protein name | | | | Locus Name | | Acc# |
|---|---|---|---|---|---|---|
| | | | | sp:GSPA_BACSU | | P25148 |

Description

GENERAL STRESS PROTEIN A

| ORF Name | NTID | AAID | NT Length | AA Length | Score | Probability |
|---|---|---|---|---|---|---|
| 24347090_f1_34 | 1709 | 6931 | 198 | 597 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24410812_f1_58 | 1710 | 6932 | 269 | 810 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24415885_f3_171 | 1711 | 6933 | 80 | 243 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24491255_c3_506 | 1712 | 6934 | 299 | 900 | 283 | 9.0e-25 |

| Protein name | | | | Locus Name | | Acc# |
|---|---|---|---|---|---|---|
| ribonuclease III (rnc) homolog | | | | pir:H70187 | | H70187 |

Description

| ORF Name | NTID | AAID | NT Length | AA Length | Score | Probability |
|---|---|---|---|---|---|---|
| 24609762_c3_576 | 1713 | 6935 | 101 | 306 | 82 | 0.0018 |

| Protein name | | | | Locus Name | | Acc# |
|---|---|---|---|---|---|---|
| vrlI protein | | | | pir:T17388 | | T17388 |

Description

-continued

| ORF Name | NTID | AAID | NT Length | AA Length | Score | Probability |
|---|---|---|---|---|---|---|
| 24632687_f3_256 | 1714 | 6936 | 637 | 1914 | 1505 | 2.9e-154 |

| Protein name | Locus Name | Acc# |
|---|---|---|
| arginine decarboxylase, 2:protein slr0662:protein slr0662 | pir:S76771 | S76771 |

Description

| ORF Name | NTID | AAID | NT Length | AA Length | Score | Probability |
|---|---|---|---|---|---|---|
| 24640876_f3_248 | 1715 | 6937 | 488 | 1467 | 125 | 0.00018 |

| Protein name | Locus Name | Acc# |
|---|---|---|
| complement C9 precursor | pir:C9HU | |

Description

| ORF Name | NTID | AAID | NT Length | AA Length | Score | Probability |
|---|---|---|---|---|---|---|
| 24644056_c2_395 | 1716 | 6938 | 350 | 1053 | 698 | 9.5e-69 |

| Protein name | Locus Name | Acc# |
|---|---|---|
| | sp:PDXB_ECOLI | P05459 |

Description

ERYTHRONATE-4-PHOSPHATE DEHYDROGENASE,

| ORF Name | NTID | AAID | NT Length | AA Length | Score | Probability |
|---|---|---|---|---|---|---|
| 24645461_f1_19 | 1717 | 6939 | 207 | 624 | 889 | 5.5e-89 |

| Protein name | Locus Name | Acc# |
|---|---|---|
| tetracycline resistance element mobilization regulatory protein rteC | pir:A36927 | A36927 |

Description

| ORF Name | NTID | AAID | NT Length | AA Length | Score | Probability |
|---|---|---|---|---|---|---|
| 24647250_f1_84 | 1718 | 6940 | 263 | 792 | 377 | 9.9e-35 |

| Protein name | Locus Name | Acc# |
|---|---|---|
| acetylglutamate kinase | pir:F69111 | F69111 |

Description

| ORF Name | NTID | AAID | NT Length | AA Length | Score | Probability |
|---|---|---|---|---|---|---|
| 24647942_c1_284 | 1719 | 6941 | 505 | 1518 | 198 | 6.1e-22 |

| Protein name | Locus Name | Acc# |
|---|---|---|
| auxin-responsive GH3-like protein | gp:ATAC005396 | AC005396 |

Description

*Arabidopsis thaliana* chromosome II BAC T26I20 genomic sequence, complete sequence -continued

| ORF Name | NTID | AAID | NT Length | AA Length | Score | Probability |
|---|---|---|---|---|---|---|
| 24650067_f3_257 | 1720 | 6942 | 173 | 522 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24695282_f3_176 | 1721 | 6943 | 136 | 411 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24782036_f3_198 | 1722 | 6944 | 599 | 1800 | 161 | 2.2e-15 |

| Protein name | | | | Locus Name | | Acc# |
|---|---|---|---|---|---|---|
| | | | | sp:REP_BUCAP | | O51889 |

Description

ATP-DEPENDENT DNA HELICASE REP,

| ORF Name | NTID | AAID | NT Length | AA Length | Score | Probability |
|---|---|---|---|---|---|---|
| 25398427_f1_68 | 1723 | 6945 | 489 | 1470 | 416 | 7.3e-39 |

| Protein name | | | | Locus Name | | Acc# |
|---|---|---|---|---|---|---|
| unknown | | | | gp:AF144879 | | AP144879 |

Description

*Leptospira interrogans* rfb locus, complete sequence.

| ORF Name | NTID | AAID | NT Length | AA Length | Score | Probability |
|---|---|---|---|---|---|---|
| 25578201_f1_70 | 1724 | 6946 | 343 | 1032 | 537 | 1.1e-51 |

| Protein name | | | | Locus Name | | Acc# |
|---|---|---|---|---|---|---|
| | | | | sp:LPSA_BACNO | | P39907 |

Description

LPSA PROTEIN

| ORF Name | NTID | AAID | NT Length | AA Length | Score | Probability |
|---|---|---|---|---|---|---|
| 259837_f2_111 | 1725 | 6947 | 658 | 1977 | 3380 | 0.0 |

| Protein name | | | | Locus Name | | Acc# |
|---|---|---|---|---|---|---|
| tetracycline resistance protein tetQ:tetA(Q)2 | | | | pir:I40188 | | |

Description

-continued

| ORF Name | NTID | AAID | NT Length | AA Length | Score | Probability |
|---|---|---|---|---|---|---|
| 2617942_c2_450 | 1726 | 6948 | 703 | 2112 | 309 | 1.6e-24 |
| Protein name | | | Locus Name | | | Acc# |
| mobilization protein C | | | gp:AF118243 | | | AF118243 |
| Description | | | | | | |

*Bacteroides fragilis* mobilization protein C (mobC) gene, comlete cds.

| ORF Name | NTID | AAID | NT Length | AA Length | Score | Probability |
|---|---|---|---|---|---|---|
| 26462933_f3_255 | 1727 | 6949 | 249 | 750 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 26571900_f3_173 | 1728 | 6950 | 233 | 702 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 26584437_f1_81 | 1729 | 6951 | 599 | 1800 | 216 | 3.4e-25 |
| Protein name | | | Locus Name | | | Acc# |
| | | | sp:HS90_PODAN | | | O43109 |
| Description | | | | | | |

INCOMPATIBILITY MOD-E)

| ORF Name | NTID | AAID | NT Length | AA Length | Score | Probability |
|---|---|---|---|---|---|---|
| 26600927_f2_132 | 1730 | 6952 | 209 | 630 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 26759678_f3_249 | 1731 | 6953 | 612 | 1839 | 872 | 4.6e-91 |
| Protein name | | | Locus Name | | | Acc# |
| ABC transporter (ATP-binding protein) homolog ygad | | | pir:G69815 | | | G69815 |
| Description | | | | | | |

-continued

| ORF Name | NTID | AAID | NT Length | AA Length | Score | Probability |
|---|---|---|---|---|---|---|
| 26818752_c2_422 | 1732 | 6954 | 135 | 408 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 2923125_f3_254 | 1733 | 6955 | 119 | 360 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 29344216_c1_317 | 1734 | 6956 | 474 | 1425 | 80 | 0.032 |

| Protein name | | | Locus Name | | | Acc# |
|---|---|---|---|---|---|---|
| M protein precursor | | | pir:S60858 | | | S60858 |

Description

| ORF Name | NTID | AAID | NT Length | AA Length | Score | Probability |
|---|---|---|---|---|---|---|
| 2947141_f2_94 | 1735 | 6957 | 117 | 354 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 29573763_f3_197 | 1736 | 6958 | 409 | 1230 | 252 | 2.4e-19 |

| Protein name | | | Locus Name | | | Acc# |
|---|---|---|---|---|---|---|
| hypothetical protein Rv0597c | | | pir:H70908 | | | H70908 |

Description

| ORF Name | NTID | AAID | NT Length | AA Length | Score | Probability |
|---|---|---|---|---|---|---|
| 29869676_f1_44 | 1737 | 6959 | 296 | 891 | 149 | 2.7e-09 |

| Protein name | | | Locus Name | | | Acc# |
|---|---|---|---|---|---|---|
| | | | sp:PRIM_LISMO | | | P47762 |

Description

DNA PRIMASE,

| ORF Name | NTID | AAID | NT Length | AA Length | Score | Probability |
|---|---|---|---|---|---|---|
| 31736291_f2_93 | 1738 | 6960 | 177 | 534 | | |

| Protein name | | | Locus Name | | | Acc# |
|---|---|---|---|---|---|---|

Description

NO-HIT

-continued

| ORF Name | NTID | AAID | NT Length | AA Length | Score | Probability |
|---|---|---|---|---|---|---|
| 31814442_c3_526 | 1739 | 6961 | 266 | 801 | | |
| Protein name | | | Locus Name | | Acc# | |

Description

NO-HIT

| ORF Name | NTID | AAID | NT Length | AA Length | Score | Probability |
|---|---|---|---|---|---|---|
| 31885192_f3_195 | 1740 | 6962 | 68 | 207 | | |
| Protein name | | | Locus Name | | Acc# | |

Description

NO-HIT

| ORF Name | NTID | AAID | NT Length | AA Length | Score | Probability |
|---|---|---|---|---|---|---|
| 31892650_c1_351 | 1741 | 6963 | 807 | 2424 | | |
| Protein name | | | Locus Name | | Acc# | |

Description

NO-HIT

| ORF Name | NTID | AAID | NT Length | AA Length | Score | Probability |
|---|---|---|---|---|---|---|
| 33245255_c2_378 | 1742 | 6964 | 74 | 225 | | |
| Protein name | | | Locus Name | | Acc# | |

Description

NO-HIT

| ORF Name | NTID | AAID | NT Length | AA Length | Score | Probability |
|---|---|---|---|---|---|---|
| 33399058_f2_118 | 1743 | 6965 | 653 | 1962 | 172 | 1.5e-10 |
| Protein name | | | Locus Name | | Acc# | |
| | | | sp:VOLD_BPP2 | | P13520 | |

Description

OVERCOMING LYSOGENIZATION DEFECT PROTEIN

| ORF Name | NTID | AAID | NT Length | AA Length | Score | Probability |
|---|---|---|---|---|---|---|
| 33706251_f2_167 | 1744 | 6966 | 180 | 543 | 185 | 2.2e-14 |
| Protein name | | | Locus Name | | Acc# | |
| putative RNA polymerase sigma factor (ECF | | | gp:SCE46 | | AL133252 | |

Description

*Streptomyces coelicolor* cosmid E46.

-continued

| ORF Name | NTID | AAID | NT Length | AA Length | Score | Probability |
|---|---|---|---|---|---|---|
| 34037503_f3_170 | 1745 | 6967 | 99 | 300 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 34063441_f2_138 | 1746 | 6968 | 198 | 597 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 34178438_f3_244 | 1747 | 6969 | 272 | 819 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 34183402_f1_28 | 1748 | 6970 | 116 | 351 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 34199183_f3_212 | 1749 | 6971 | 627 | 1884 | 1219 | 5.9e-124 |

| Protein name | | | | Locus Name | | Acc# |
|---|---|---|---|---|---|---|
| maturase-related protein (intL intron) | | | | pir:S77648 | | S77648 |

Description

| ORF Name | NTID | AAID | NT Length | AA Length | Score | Probability |
|---|---|---|---|---|---|---|
| 34268878_f1_27 | 1750 | 6972 | 160 | 483 | 81 | 0.0034 |

| Protein name | | | | Locus Name | | Acc# |
|---|---|---|---|---|---|---|
| glucosidase II beta-subunit | | | | gp:AF066061 | | AF066061 |

Description

*Mus musculus* glucosidase II beta-subunit gene, alternatively spliced products, partial cds.

| ORF Name | NTID | AAID | NT Length | AA Length | Score | Probability |
|---|---|---|---|---|---|---|
| 35171937_c1_350 | 1751 | 6973 | 439 | 1320 | | |

| Protein name | | | | Locus Name | | Acc# |
|---|---|---|---|---|---|---|

Description

NO-HIT

-continued

| ORF Name | NTID | AAID | NT Length | AA Length | Score | Probability |
|---|---|---|---|---|---|---|
| 35352031_c2_420 | 1752 | 6974 | 179 | 540 | | |

| Protein name | | | Locus Name | | Acc# | |
|---|---|---|---|---|---|---|

Description

NO-HIT

| ORF Name | NTID | AAID | NT Length | AA Length | Score | Probability |
|---|---|---|---|---|---|---|
| 35725786_c1_300 | 1753 | 6975 | 152 | 459 | | |

| Protein name | | | Locus Name | | Acc# | |
|---|---|---|---|---|---|---|

Description

NO-HIT

| ORF Name | NTID | AAID | NT Length | AA Length | Score | Probability |
|---|---|---|---|---|---|---|
| 3933375_c3_520 | 1754 | 6976 | 430 | 1293 | 82 | 0.017 |

| Protein name | | | Locus Name | | Acc# | |
|---|---|---|---|---|---|---|
| hypothetical protein | | | pir:B72242 | | B72242 | |

Description

| ORF Name | NTID | AAID | NT Length | AA Length | Score | Probability |
|---|---|---|---|---|---|---|
| 4007635_c3_521 | 1755 | 6977 | 93 | 282 | | |

| Protein name | | | Locus Name | | Acc# | |
|---|---|---|---|---|---|---|

Description

NO-HIT

| ORF Name | NTID | AAID | NT Length | AA Length | Score | Probability |
|---|---|---|---|---|---|---|
| 414687_f1_55 | 1756 | 6978 | 232 | 699 | 479 | 1.5e-45 |

| Protein name | | | Locus Name | | Acc# | |
|---|---|---|---|---|---|---|
| | | | sp:YLCA_ECOLI | | P77380 | |

Description

PROBABLE TRANSCRIPTIONAL REGULATORY PROTEIN YLCA

| ORF Name | NTID | AAID | NT Length | AA Length | Score | Probability |
|---|---|---|---|---|---|---|
| 4192500_f2_150 | 1757 | 6979 | 367 | 1104 | 510 | 7.9e-49 |

| Protein name | | | Locus Name | | Acc# | |
|---|---|---|---|---|---|---|
| conserved hypothetical protein aq_1224 | | | pir:G70405 | | G70405 | |

Description

| ORF Name | NTID | AAID | NT Length | AA Length | Score | Probability |
|---|---|---|---|---|---|---|
| 422552_f1_76 | 1758 | 6980 | 190 | 573 | 259 | 3.1e-22 |

| Protein name | | | Locus Name | | Acc# | |
|---|---|---|---|---|---|---|
| shikimate kinase | | | pir:A70487 | | A70487 | |

Description

-continued

| ORF Name | NTID | AAID | NT Length | AA Length | Score | Probability |
|---|---|---|---|---|---|---|
| 4298525__c2__397 | 1759 | 6981 | 425 | 1278 | 1152 | 7.4e-117 |
| Protein name | | | Locus Name | | | Acc# |
| synthase, | | | pir:G69842 | | | G69842 |
| Description | | | | | | |

| ORF Name | NTID | AAID | NT Length | AA Length | Score | Probability |
|---|---|---|---|---|---|---|
| 4307136__f3__231 | 1760 | 6982 | 89 | 270 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 4707750__f1__72 | 1761 | 6983 | 311 | 936 | 288 | 2.9e-37 |
| Protein name | | | Locus Name | | | Acc# |
| hypothetical protein PH0424 | | | pir:A71153 | | | A71153 |
| Description | | | | | | |

| ORF Name | NTID | AAID | NT Length | AA Length | Score | Probability |
|---|---|---|---|---|---|---|
| 475002__f3__189 | 1762 | 6984 | 63 | 192 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 4876592__f1__85 | 1763 | 6985 | 162 | 489 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 4884628__f3__232 | 1764 | 6986 | 456 | 1371 | 334 | 4.2e-30 |
| Protein name | | | Locus Name | | | Acc# |
| copper resistance sensor kinase pcoS:copper sensor | | | pir:S52258 | | | |
| Description | | | | | | |

-continued

| ORF Name | NTID | AAID | NT Length | AA Length | Score | Probability |
|---|---|---|---|---|---|---|
| 5272917_f3_233 | 1765 | 6987 | 887 | 2664 | 2321 | 9.8e-241 |

| Protein name | | | | Locus Name | | Acc# |
|---|---|---|---|---|---|---|
| | | | | sp:ATMA_ECOLI | | P39168 |

Description

MG(2+) TRANSPORT ATPASE, P-TYPE 1,

| ORF Name | NTID | AAID | NT Length | AA Length | Score | Probability |
|---|---|---|---|---|---|---|
| 6429200_f2_147 | 1766 | 6988 | 62 | 189 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 6500_c1_275 | 1767 | 6989 | 64 | 195 | 73 | 0.031 |

| Protein name | | | | Locus Name | | Acc# |
|---|---|---|---|---|---|---|
| | | | | sp:YGEG_ECOLI | | Q46787 |

Description

HYPOTHETICAL 19.1 KD PROTEIN IN KDUI-LYSS INTERGENIC REGION

| ORF Name | NTID | AAID | NT Length | AA Length | Score | Probability |
|---|---|---|---|---|---|---|
| 6532501_c2_461 | 1768 | 6990 | 438 | 1317 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 6814017_f1_30 | 1769 | 6991 | 126 | 381 | 70 | 0.033 |

| Protein name | | | | Locus Name | | Acc# |
|---|---|---|---|---|---|---|
| 41kd antigen | | | | gp:A13461 | | A13461 |

Description

*P. falciparum* gene for 41 kd antigen, clone 41-7.

| ORF Name | NTID | AAID | NT Length | AA Length | Score | Probability |
|---|---|---|---|---|---|---|
| 6828312_c2_396 | 1770 | 6992 | 82 | 249 | 266 | 5.7e-23 |

| Protein name | | | | Locus Name | | Acc# |
|---|---|---|---|---|---|---|
| acyl carrier protein (ACP) | | | | gp:ABACPF | | X82399 |

Description

*A. brasilense* acpF gene.

-continued

| ORF Name | NTID | AAID | NT Length | AA Length | Score | Probability |
|---|---|---|---|---|---|---|
| 78126_f2_152 | 1771 | 6993 | 351 | 1056 | 710 | 5.1e-70 |

| Protein name | Locus Name | Acc# |
|---|---|---|
| | sp:K6PF_SYNY3 | P72830 |

Description (PHOSPHOHEXOKINASE)

| ORF Name | NTID | AAID | NT Length | AA Length | Score | Probability |
|---|---|---|---|---|---|---|
| 783410_f3_172 | 1772 | 6994 | 391 | 1176 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 85827_f2_155 | 1773 | 6995 | 207 | 624 | 371 | 4.3e-34 |

| Protein name | Locus Name | Acc# |
|---|---|---|
| phosphoribosylglycinamide formyltransferase | gp:ATPUR3 | X74767 |

Description

*Arabictopsis thaliana* mRNA tor phosphoribosylglycinamideformyltransferase encoded by PUR3 gene.

| ORF Name | NTID | AAID | NT Length | AA Length | Score | Probability |
|---|---|---|---|---|---|---|
| 9787906_f2_121 | 1774 | 6996 | 80 | 243 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 9923130_c3_577 | 1775 | 6997 | 111 | 336 | 85 | 0.00086 |

| Protein name | Locus Name | Acc# |
|---|---|---|
| hypothetical protein SCE68.26c | pir:T36276 | T36276 |

Description

| ORF Name | NTID | AAID | NT Length | AA Length | Score | Probability |
|---|---|---|---|---|---|---|
| 14176629_c2_6 | 1776 | 6998 | 68 | 207 | 113 | 9.3e-07 |

| Protein name | Locus Name | Acc# |
|---|---|---|
| hypothetical protein Rv3069 | pir:F70650 | F70650 |

Description

-continued

| ORF Name | NTID | AAID | NT Length | AA Length | Score | Probability |
|---|---|---|---|---|---|---|
| 4978886_f3_2 | 1777 | 6999 | 217 | 654 | 628 | 2.5e-61 |

| Protein name | Locus Name | Acc# |
|---|---|---|
| hypothetical protein | pir:JQ1020 | JQ1020 |

Description

| ORF Name | NTID | AAID | NT Length | AA Length | Score | Probability |
|---|---|---|---|---|---|---|
| 12697201_c2_20 | 1778 | 7000 | 599 | 1797 | 340 | 2.0e-27 |

| Protein name | Locus Name | Acc# |
|---|---|---|
| 115K outer membrane protein precursor:SusC protein | pir:JC6027 | JC6027 |

Description

| ORF Name | NTID | AAID | NT Length | AA Length | Score | Probability |
|---|---|---|---|---|---|---|
| 19532637_c3_23 | 1779 | 7001 | 96 | 291 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24218762_c1_18 | 1780 | 7002 | 137 | 414 | 64 | 0.015 |

| Protein name | Locus Name | Acc# |
|---|---|---|
| ribosomal protein L5 | gp:U17009 | U17009 |

Description

*Phytophthora infestans* mitochondrion, complete genome.

| ORF Name | NTID | AAID | NT Length | AA Length | Score | Probability |
|---|---|---|---|---|---|---|
| 3163438_c2_19 | 1781 | 7003 | 406 | 1221 | 148 | 1.4e-07 |

| Protein name | Locus Name | Acc# |
|---|---|---|
| transmembrane sensor | gp:AF051691 | AF051691 |

Description

*Pseudomonas aeruginosa* stress factor A (psfA), ECF sigma factor(fiuI), transmembrane sensor (fiuR), and hydroxamate-type ferrisiderophore receptor (fiuA) genes, complete cds.

| ORF Name | NTID | AAID | NT Length | AA Length | Score | Probability |
|---|---|---|---|---|---|---|
| 4806337_c3_21 | 1782 | 7004 | 93 | 282 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 6445306_f2_8 | 1783 | 7005 | 212 | 639 | 186 | 1.7e-14 |

| Protein name | Locus Name | Acc# |
|---|---|---|
| RNA polymerase sigma factor SigZ-like protein | gp:AF137263 | AF137263 |

Description

Bacteroides thetaiotaomicron 30S ribosomal protein S16-like protein, fucose
gene cluster, and RNA polymerase sigma factor SigZ-like protein (sigZ) genes, complete cds.

| ORF Name | NTID | AAID | NT Length | AA Length | Score | Probability |
|---|---|---|---|---|---|---|
| 13065655_f3_2 | 1784 | 7006 | 67 | 201 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 1050026_f2_4 | 1785 | 7007 | 129 | 390 | 69 | 0.044 |

| Protein name | Locus Name | Acc# |
|---|---|---|
| transcription regulator, PbsX family | pir:H75270 | H75270 |

Description

| ORF Name | NTID | AAID | NT Length | AA Length | Score | Probability |
|---|---|---|---|---|---|---|
| 14652161_f3_17 | 1786 | 7008 | 77 | 234 | 191 | 2.6e-14 |

| Protein name | Locus Name | Acc# |
|---|---|---|
| hypothetical protein | pir:JQ1020 | JQ1020 |

Description

| ORF Name | NTID | AAID | NT Length | AA Length | Score | Probability |
|---|---|---|---|---|---|---|
| 16832885_f2_11 | 1787 | 7009 | 115 | 348 | 428 | 3.9e-40 |

| Protein name | Locus Name | Acc# |
|---|---|---|
| hypothetical protein | pir:JQ1020 | JQ1020 |

Description

| ORF Name | NTID | AAID | NT Length | AA Length | Score | Probability |
|---|---|---|---|---|---|---|
| 22860128_f3_16 | 1788 | 7010 | 83 | 252 | 64 | 0.031 |

| Protein name | Locus Name | Acc# |
|---|---|---|
| | sp:SPRC_XENLA | P36378 |

Description (OSTEONECTIN) (ON) (BASEMENT MEMBRANE PROTEIN BM-40)

| ORF Name | NTID | AAID | NT Length | AA Length | Score | Probability |
|---|---|---|---|---|---|---|
| 24615625_c3_24 | 1789 | 7011 | 725 | 2178 | 2793 | 9.5e-291 |

| Protein name | Locus Name | Acc# |
|---|---|---|
| alpha-glucosidase | gp:BTU66897 | U66897 |

Description

Bacteroides thetaiotaomicron neopullulanase (susA) and alpha-glucosidase (susB) genes, complete cds.

| ORF Name | NTID | AAID | NT Length | AA Length | Score | Probability |
|---|---|---|---|---|---|---|
| 34382842_f1_3 | 1790 | 7012 | 113 | 342 | 170 | 5.1e-12 |

| Protein name | Locus Name | Acc# |
|---|---|---|
| hypothetical protein | pir:JQ1020 | JQ1020 |

Description

| ORF Name | NTID | AAID | NT Length | AA Length | Score | Probability |
|---|---|---|---|---|---|---|
| 10644652_c3_306 | 1791 | 7013 | 628 | 1887 | 1058 | 6.8e-107 |

| Protein name | Locus Name | Acc# |
|---|---|---|
|  | sp:YFBS_ECOLI |  |

Description

HYPOTHETICAL 65.9 KD PROTEIN IN LRHA-ACKA INTERGENIC REGION

| ORF Name | NTID | AAID | NT Length | AA Length | Score | Probability |
|---|---|---|---|---|---|---|
| 1070311_c3_324 | 1792 | 7014 | 355 | 1068 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 10727040_c1_204 | 1793 | 7015 | 345 | 1038 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 10968955_f3_167 | 1794 | 7016 | 237 | 714 | 546 | 1.2e-52 |

| Protein name | Locus Name | Acc# |
|---|---|---|
|  | sp:PDXH_SYNY3 | P74211 |

Description

PYRIDOXAMINE 5'-PHOSPHATE OXIDASE, (PNP/PMP OXIDASE)

-continued

| ORF Name | NTID | AAID | NT Length | AA Length | Score | Probability |
|---|---|---|---|---|---|---|
| 11190877_c3_317 | 1795 | 7017 | 406 | 1221 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 1214075_c2_259 | 1796 | 7018 | 215 | 648 | 364 | 2.4e-33 |

| Protein name | | | Locus Name | | | Acc# |
|---|---|---|---|---|---|---|
| O-acetyl transferase | | | gp:SAU77308 | | | U77308 |

Description

*Staphylococcus aureus* O-acetyl transferase (cap5H) gene, complete cds.

| ORF Name | NTID | AAID | NT Length | AA Length | Score | Probability |
|---|---|---|---|---|---|---|
| 12985802_f2_99 | 1797 | 7019 | 245 | 738 | 84 | 0.0053 |

| Protein name | | | Locus Name | | | Acc# |
|---|---|---|---|---|---|---|
| | | | gP:D84670 | | | D84670 |

Description

*Pyrococcus furiosus* gene tor DNA polymerase II subunit 1, DNA polymerase II subunit 2, complete cds.

| ORF Name | NTID | AAID | NT Length | AA Length | Score | Probability |
|---|---|---|---|---|---|---|
| 13851552_f3_168 | 1798 | 7020 | 363 | 1092 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 13937556_c3_325 | 1799 | 7021 | 182 | 549 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 14463512_f1_57 | 1800 | 7022 | 60 | 183 | | |

| Protein name | | | Locus Name | | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 14570327_f3_149 | 1801 | 7023 | 157 | 474 | 263 | 1.2e-22 |

| Protein name | Locus Name | Acc# |
|---|---|---|
| orfX | gp:AB014440 | AB014440 |

Description

*Staphylococcus aureus* genes for orf1, orfX, orf2, orf3, partial and complete cds.

| ORF Name | NTID | AAID | NT Length | AA Length | Score | Probability |
|---|---|---|---|---|---|---|
| 16112682_f3_192 | 1802 | 7024 | 961 | 2886 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 16223432_c2_284 | 1803 | 7025 | 198 | 597 | 187 | 1.3e-14 |

| Protein name | Locus Name | Acc# |
|---|---|---|
| RNA polymerase ECF-type sigma factor homolog ylaC | pir:A69872 | A69872 |

Description

| ORF Name | NTID | AAID | NT Length | AA Length | Score | Probability |
|---|---|---|---|---|---|---|
| 1957187_c3_315 | 1804 | 7026 | 195 | 588 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 19726375_c1_207 | 1805 | 7027 | 161 | 486 | 233 | 1.8e-19 |

| Protein name | Locus Name | Acc# |
|---|---|---|
| unknown | gp:AF048749 | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 20505007_c3_305 | 1806 | 7028 | 60 | 183 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 2187550_f3_143 | 1807 | 7029 | 112 | 339 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 22469452_c3_298 | 1808 | 7030 | 172 | 519 | 149 | 1.4e-10 |
| Protein name | | | Locus Name | | | Acc# |
| unknown | | | gp:AF048749 | | | AF048749 |
| Description | | | | | | |

*Bacteroides fragilis* capsular polysaccharide biosynthesis operon, complete sequence.

| ORF Name | NTID | AAID | NT Length | AA Length | Score | Probability |
|---|---|---|---|---|---|---|
| 23625302_c1_213 | 1809 | 7031 | 434 | 1305 | 1720 | 4.8e-177 |
| Protein name | | | Locus Name | | | Acc# |
| putative UDP-galactose-6 dehydrogenase | | | gp:AF048749 | | | AF048749 |
| Description | | | | | | |

*Bacteroides fragilis* capsular polysaccharide biosynthesis operon, complete sequence.

| ORF Name | NTID | AAID | NT Length | AA Length | Score | Probability |
|---|---|---|---|---|---|---|
| 2361637_f3_163 | 1810 | 7032 | 342 | 1029 | 902 | 2.3e-90 |
| Protein name | | | Locus Name | | | Acc# |
| D-2-hydroxy-acid dehydrogenase, | | | pir:S76782 | | | S76782 |
| Description | | | | | | |

| ORF Name | NTID | AAID | NT Length | AA Length | Score | Probability |
|---|---|---|---|---|---|---|
| 23944510_f1_48 | 1811 | 7033 | 104 | 315 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 24022212_c1_236 | 1812 | 7034 | 330 | 993 | 588 | 4.3e-57 |
| Protein name | | | Locus Name | | | Acc# |
| conserved hypothetical protein | | | pir:A72335 | | | A72335 |
| Description | | | | | | |

-continued

| ORF Name | NTID | AAID | NT Length | AA Length | Score | Probability |
|---|---|---|---|---|---|---|
| 24415952_c1_231 | 1813 | 7035 | 220 | 663 | 712 | 3.1e-70 |

| Protein name | | | | Locus Name | | Acc# |
|---|---|---|---|---|---|---|
| ykvJ protein | | | | pir:A69868 | | A69868 |

Description

| ORF Name | NTID | AAID | NT Length | AA Length | Score | Probability |
|---|---|---|---|---|---|---|
| 24416062_c2_258 | 1814 | 7036 | 386 | 1161 | 117 | 0.00067 |

| Protein name | | | | Locus Name | | Acc# |
|---|---|---|---|---|---|---|
| MURF1 | | | | gP:AF079967 | | AF079967 |

Description

*Phytomonas serpens* 12S Large subunit ribosomal RNA and 9S small subunit ribosomal RNA, partial sequence; NADH dehydrogenase subunit8 (ND8) cryptogene, NAPH dehydrogenase subunit 9 (ND9) cryptogene, NADH dehydrogenase subunit 7 (ND7) cryptogene, ATPase subunit 6(AG) cryptogene, G3 cryptogene, complete sequence; and MURF1 (MURF1) and MURF1 (MURF1) genes, complete cds.

| ORF Name | NTID | AAID | NT Length | AA Length | Score | Probability |
|---|---|---|---|---|---|---|
| 24640887_c3_301 | 1815 | 7037 | 351 | 1056 | 615 | 5.9e-60 |

| Protein name | | | | Locus Name | | Acc# |
|---|---|---|---|---|---|---|
| N-acetylneuraminic acid condensing enzyme | | | | gp:LPN7311 | | AJ007311 |

Description

*Legionella pneumophilia* serogroup 1 lipopolysaccharide biosynthesisgene cluster.

| ORF Name | NTID | AAID | NT Length | AA Length | Score | Probability |
|---|---|---|---|---|---|---|
| 24641925_c1_214 | 1816 | 7038 | 388 | 1167 | 128 | 3.3e-05 |

| Protein name | | | | Locus Name | | Acc# |
|---|---|---|---|---|---|---|
| probable lipopolysaccharide N-acetylglucosaminyltransferase, rfbU | | | | pir:F64500 | | F64500 |

Description

| ORF Name | NTID | AAID | NT Length | AA Length | Score | Probability |
|---|---|---|---|---|---|---|
| 24642125_c3_304 | 1817 | 7039 | 442 | 1329 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24642813_c1_217 | 1818 | 7040 | 200 | 603 | 189 | 8.2e-15 |

| Protein name | | | | Locus Name | | Acc# |
|---|---|---|---|---|---|---|
| thiol:disulfide interchange protein | | | | pir:F75549 | | F75549 |

Description

-continued

| ORF Name | NTID | AAID | NT Length | AA Length | Score | Probability |
|---|---|---|---|---|---|---|
| 24647126_f1_19 | 1819 | 7041 | 431 | 1296 | 78 | 0.045 |

| Protein name | Locus Name | Acc# |
|---|---|---|
| | sp:RS10_METTH | O27133 |

Description

30S RIBOSOMAL PROTEIN S10P

| ORF Name | NTID | AAID | NT Length | AA Length | Score | Probability |
|---|---|---|---|---|---|---|
| 24648510_c1_211 | 1820 | 7042 | 343 | 1032 | 424 | 1.0e-39 |

| Protein name | Locus Name | Acc# |
|---|---|---|
| unknown | gp:AF144879 | AF144879 |

Description

*Leptospira interrogans* rfb locus, complete sequence.

| ORF Name | NTID | AAID | NT Length | AA Length | Score | Probability |
|---|---|---|---|---|---|---|
| 24806575_c3_300 | 1821 | 7043 | 281 | 846 | 159 | 2.6e-09 |

| Protein name | Locus Name | Acc# |
|---|---|---|
| galactosyl transferase | gp:AF030373 | AF030373 |

Description

*Streptococcus pneumoniae* strain SP264 alpha, 1-6-glucosidase(deXB) gene, complete cds; capsular polysaccharide biosyntheticlocus, complete sequence; and oligopeptide binding protein (aliA)gene, complete cds.

| ORF Name | NTID | AAID | NT Length | AA Length | Score | Probability |
|---|---|---|---|---|---|---|
| 25431551_c1_212 | 1822 | 7044 | 238 | 717 | 289 | 2.1e-25 |

| Protein name | Locus Name | Acc# |
|---|---|---|
| acetyltransferase, vatB | pir:T10903 | T10903 |

Description

| ORF Name | NTID | AAID | NT Length | AA Length | Score | Probability |
|---|---|---|---|---|---|---|
| 25815961_c2_248 | 1823 | 7045 | 647 | 1944 | | |

| Protein name | Locus Name | Acc# |
|---|---|---|
| | | |

Description
NO-HIT

| ORF Name | NTID | AAID | NT Length | AA Length | Score | Probability |
|---|---|---|---|---|---|---|
| 25900252_c2_282 | 1824 | 7046 | 152 | 459 | 591 | 2.1e-57 |

| Protein name | Locus Name | Acc# |
|---|---|---|
| conserved hypothetical protein ykvM | pir:D69868 | D69868 |

Description

| ORF Name | NTID | AAID | NT Length | AA Length | Score | Probability |
|---|---|---|---|---|---|---|
| 26847025_f2_134 | 1825 | 7047 | 167 | 504 | 843 | 4.1e-84 |

| Protein name | Locus Name | Acc# |
|---|---|---|
| | sp:FLP_YEAST | P03870 |

Description

RECOMBINASE FLP PROTEIN (PROTEIN ABLE)

| ORF Name | NTID | AAID | NT Length | AA Length | Score | Probability |
|---|---|---|---|---|---|---|
| 26847025_f3_195 | 1826 | 7048 | 167 | 504 | 843 | 4.1e-84 |

| Protein name | Locus Name | Acc# |
|---|---|---|
| | sp:FLP_YEAST | P03870 |

Description

RECOMBINASE FLP PROTEIN (PROTEIN ABLE)

| ORF Name | NTID | AAID | NT Length | AA Length | Score | Probability |
|---|---|---|---|---|---|---|
| 29484452_c1_216 | 1827 | 7049 | 433 | 1302 | 933 | 1.2e-93 |

| Protein name | Locus Name | Acc# |
|---|---|---|
| Cps7G | gP:AF164515 | AF164515 |

Description

*Streptococcus suis* putative glycosyltransferase Cps7E (cps7E) gene, partial cds; putative glycosyltransferase Cps7F (cps7F) and Cps7G (cps7G) genes, complete cds; and putative glycosyltransferase Cps7H (cps7H) gene, partial cds.

| ORF Name | NTID | AAID | NT Length | AA Length | Score | Probability |
|---|---|---|---|---|---|---|
| 29506500_c2_257 | 1828 | 7050 | 481 | 1446 | 275 | 2.0e-21 |

| Protein name | Locus Name | Acc# |
|---|---|---|
| Cps2J | gp:AF026471 | AF026471 |

Description

*Streptococcus pneumoniae* DexB (dexB) gene, partial cds; putative transposase gene, complete cds; type 2 capsular polysaccharidebiosynthesis operon, complete sequence; and AliA (aliA) gene, partial cds.

| ORF Name | NTID | AAID | NT Length | AA Length | Score | Probability |
|---|---|---|---|---|---|---|
| 30509375_c1_198 | 1829 | 7051 | 246 | 741 | 117 | 0.00037 |

| Protein name | Locus Name | Acc# |
|---|---|---|
| STARP antigen | gp:AF209925 | AF209925 |

Description

*Plasmodium falciparum* STARP antigen (STARP) gene, complete cds.

-continued

| ORF Name | NTID | AAID | NT Length | AA Length | Score | Probability |
|---|---|---|---|---|---|---|
| 31287_c2_255 | 1830 | 7052 | 236 | 711 | 347 | 1.5e-31 |

| Protein name | Locus Name | Acc# |
|---|---|---|
| CMP-N-acetlyneuraminic acid synthetase | gp:LPN7311 | AJ007311 |

Description

*Legionella pneumophila* serogroup 1 lipopolysaccharide biosynthesis gene cluster.

| ORF Name | NTID | AAID | NT Length | AA Length | Score | Probability |
|---|---|---|---|---|---|---|
| 31593_c2_243 | 1831 | 7053 | 62 | 189 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 34019812_c2_283 | 1832 | 7054 | 272 | 819 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 34180437_c2_280 | 1833 | 7055 | 172 | 519 | 209 | 6.3e-17 |

| Protein name | Locus Name | Acc# |
|---|---|---|
| putative ECF sigma factor RpoE1 | gp:AF049107 | AF049107 |

Description

*Myxococcus xanthus* response regulator FrzZ (frzZ) gene, partial cds; alanine dehydrogenase (aldA), putative ECF sigma factor RpoE1 (rpoE1), and response regulator homolog (frzS) genes, complete cds; and unknown genes.

| ORF Name | NTID | AAID | NT Length | AA Length | Score | Probability |
|---|---|---|---|---|---|---|
| 34562591_c3_296 | 1834 | 7056 | 352 | 1059 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 34572201_c1_235 | 1835 | 7057 | 283 | 852 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 35166265_c2_254 | 1836 | 7058 | 214 | 645 | 291 | 1.3e-25 |

| Protein name | Locus Name | Acc# |
|---|---|---|
| putative acetyl transferase | gp:LPN7311 | AJ007311 |

Description

*Legionella pneumophila* serogroup 1 lipopolysaccharide biosynthesis gene cluster.

| ORF Name | NTID | AAID | NT Length | AA Length | Score | Probability |
|---|---|---|---|---|---|---|
| 36135887_c1_219 | 1837 | 7059 | 68 | 207 | 73 | 0.016 |

| Protein name | Locus Name | Acc# |
|---|---|---|
| water-stress inducible protein | gp:AF010584 | AF010584 |

Description

*Oryza sativa* water-stress inducible protein (WSI) mRNA, complete cds.

| ORF Name | NTID | AAID | NT Length | AA Length | Score | Probability |
|---|---|---|---|---|---|---|
| 39067_c2_256 | 1838 | 7060 | 443 | 1332 | 81 | 0.023 |

| Protein name | Locus Name | Acc# |
|---|---|---|
| | sp:RK23_EUGGR | P19167 |

Description

CHLOROPLAST 50S RIBOSOMAL PROTEIN L23

| ORF Name | NTID | AAID | NT Length | AA Length | Score | Probability |
|---|---|---|---|---|---|---|
| 391003_f2_101 | 1839 | 7061 | 311 | 936 | 129 | 5.6e-06 |

| Protein name | Locus Name | Acc# |
|---|---|---|
| ubiquinone/menaquinone biosynthesis methyltransferase-related protein | pir:F72262 | F72262 |

Description

| ORF Name | NTID | AAID | NT Length | AA Length | Score | Probability |
|---|---|---|---|---|---|---|
| 3912637_f1_28 | 1840 | 7062 | 244 | 735 | 428 | 3.9e-40 |

| Protein name | Locus Name | Acc# |
|---|---|---|
| hypothetical protein sll1773 | pir:S77110 | S77110 |

Description

| ORF Name | NTID | AAID | NT Length | AA Length | Score | Probability |
|---|---|---|---|---|---|---|
| 392802_c2_261 | 1841 | 7063 | 198 | 597 | 541 | 4.1e-52 |

| Protein name | Locus Name | Acc# |
|---|---|---|
| ORF8S | gP:AB028134 | AB028134 |

Description

*Shigella sonnei* O-antigen gene cluster tor ORF6S, ORF7S, ORF8S, ORF9S, ORF10S, partial and complete cds.

-continued

| ORF Name | NTID | AAID | NT Length | AA Length | Score | Probability |
|---|---|---|---|---|---|---|
| 3957767_f2_69 | 1842 | 7064 | 372 | 1119 | 1076 | 8.4e-109 |

| Protein name | Locus Name | Acc# |
|---|---|---|
| alanine dehydrogenase | gp:AF070716 | AF070716 |

Description

*Vibrio proteolyticus* alanine dehydrogenase (ald) gene, complete cds.

| ORF Name | NTID | AAID | NT Length | AA Length | Score | Probability |
|---|---|---|---|---|---|---|
| 4071052_c2_242 | 1843 | 7065 | 250 | 753 | 312 | 7.6e-28 |

| Protein name | Locus Name | Acc# |
|---|---|---|
| Tou1 | gp:AF058689 | AF058689 |

Description

*Neisseria meningitidis* strain Z2491, genomic sequence.

| ORF Name | NTID | AAID | NT Length | AA Length | Score | Probability |
|---|---|---|---|---|---|---|
| 4117802_c1_225 | 1844 | 7066 | 608 | 1827 | 181 | 3.6e-09 |

| Protein name | Locus Name | Acc# |
|---|---|---|
| hypothetical protein | pir:S75991 | S75991 |

Description

| ORF Name | NTID | AAID | NT Length | AA Length | Score | Probability |
|---|---|---|---|---|---|---|
| 4407580_c1_215 | 1845 | 7067 | 261 | 786 | 761 | 2.0e-75 |

| Protein name | Locus Name | Acc# |
|---|---|---|
| putative glycosyl transferase | gp:AF048749 | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 4457808_c2_287 | 1846 | 7068 | 490 | 1470 | 189 | 3.8e-12 |

| Protein name | Locus Name | Acc# |
|---|---|---|
| conserved hypothetical protein | pir:B72224 | B72224 |

Description

| ORF Name | NTID | AAID | NT Length | AA Length | Score | Probability |
|---|---|---|---|---|---|---|
| 4789052_c3_321 | 1847 | 7069 | 282 | 849 | 609 | 2.6e-59 |

| Protein name | Locus Name | Acc# |
|---|---|---|
| quinolinate phosphoribosyl transferase | pir:B70375 | B70375 |

Description

-continued

| ORF Name | NTID | AAID | NT Length | AA Length | Score | Probability |
|---|---|---|---|---|---|---|
| 4975937_c2_281 | 1848 | 7070 | 230 | 693 | 266 | 5.7e-23 |

| Protein name | Locus Name | Acc# |
|---|---|---|
| conserved hypothetical protein | pir:B72334 | B72334 |

Description

| ORF Name | NTID | AAID | NT Length | AA Length | Score | Probability |
|---|---|---|---|---|---|---|
| 585312_f1_34 | 1849 | 7071 | 132 | 399 | 154 | 4.2e-11 |

| Protein name | Locus Name | Acc# |
|---|---|---|
|  | sp:LGUL_NEIME | O33393 |

Description (S-D-LACTOYLGLUTATHIONE METHYLGLYOXAL LYASE)

| ORF Name | NTID | AAID | NT Length | AA Length | Score | Probability |
|---|---|---|---|---|---|---|
| 598150_f2_113 | 1850 | 7072 | 61 | 186 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 625933_c1_196 | 1851 | 7073 | 92 | 279 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 6679812_c2_273 | 1852 | 7074 | 147 | 444 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 7293_c3_288 | 1853 | 7075 | 85 | 258 | 263 | 1.2e-22 |

| Protein name | Locus Name | Acc# |
|---|---|---|
|  | sp:REP1_YEAST | P03871 |

Description

TRANS-ACTING FACTOR B (REP1) (PROTEIN BAKER)

-continued

| ORF Name | NTID | AAID | NT Length | AA Length | Score | Probability |
|---|---|---|---|---|---|---|
| 907575_c1_208 | 1854 | 7076 | 412 | 1239 | 319 | 1.8e−30 |

| Protein name | | | | Locus Name | | Acc# |
|---|---|---|---|---|---|---|
| putative epimerase/dehydratase WbiI | | | | gp:AF064070 | | AF064070 |

Description

*Burkholderia pseudomallei* putative dihydroorotase (pyrC) gene, partial cds; putative 1-acyl-sn-glycerol-3-phosphateacyltransferase (plsC), putative diadenosine tetraphosphatase (apaH), complete cds; type II O-antigen biosynthesis gene cluster, complete sequence; putative undecaprenyl phosphateN-acetylglucosaminyltransferase, and putative

| ORF Name | NTID | AAID | NT Length | AA Length | Score | Probability |
|---|---|---|---|---|---|---|
| 977202_c1_226 | 1855 | 7077 | 501 | 1506 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 9859712_c3_299 | 1856 | 7078 | 406 | 1221 | 544 | 1.0e−56 |

| Protein name | Locus Name | Acc# |
|---|---|---|
| aminotransferase homolog | gp:AF001497 | AF001497 |

Description

*Campylobacter jejuni* polysaccharide biosynthesis protein homolog gene, partial cds, galactosyl transferase homolog, UDP-galactosephosphate transferase homolog, acetyl transferase homolog and aminotransferase homolog genes, complete cds, and polysaccharidebiosynthesis enzyme homolog gene, partial cds.

| ORF Name | NTID | AAID | NT Length | AA Length | Score | Probability |
|---|---|---|---|---|---|---|
| 14722075_f1_6 | 1857 | 7079 | 77 | 234 | 137 | 2.7e−09 |

| Protein name | Locus Name | Acc# |
|---|---|---|
| ribosomal protein L30 | pir:B72248 | B72248 |

Description

| ORF Name | NTID | AAID | NT Length | AA Length | Score | Probability |
|---|---|---|---|---|---|---|
| 14868817_f1_12 | 1858 | 7080 | 113 | 342 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 157552_c1_36 | 1859 | 7081 | 616 | 1851 | 266 | 3.1e−22 |

| Protein name | Locus Name | Acc# |
|---|---|---|
| | sp:MUTS_AQUPY | P70755 |

Description

DNA MISMATCH REPAIR PROTEIN MUTS

-continued

| ORF Name | NTID | AAID | NT Length | AA Length | Score | Probability |
|---|---|---|---|---|---|---|
| 16595463_f1_4 | 1860 | 7082 | 193 | 582 | 458 | 2.6e−43 |

| Protein name | | | | Locus Name | | Acc# |
|---|---|---|---|---|---|---|
| ribosomal protein L6 | | | | pir:E72248 | | E72248 |

Description

| ORF Name | NTID | AAID | NT Length | AA Length | Score | Probability |
|---|---|---|---|---|---|---|
| 16836062_f1_11 | 1861 | 7083 | 203 | 612 | 504 | 3.4e−48 |

| Protein name | | | | Locus Name | | Acc# |
|---|---|---|---|---|---|---|
| | | | | sp:RS4_BACST | | P81288 |

Description

30S RIBOSOMAL PROTEIN S4

| ORF Name | NTID | AAID | NT Length | AA Length | Score | Probability |
|---|---|---|---|---|---|---|
| 22540937_f3_29 | 1862 | 7084 | 162 | 489 | 318 | 1.8e−28 |

| Protein name | | | | Locus Name | | Acc# |
|---|---|---|---|---|---|---|
| | | | | sp:RL17_PSEAE | | O52761 |

Description

50S RIBOSOMAL PROTEIN L17

| ORF Name | NTID | AAID | NT Length | AA Length | Score | Probability |
|---|---|---|---|---|---|---|
| 23475302_f3_28 | 1863 | 7085 | 335 | 1008 | 634 | 5.8e−62 |

| Protein name | | | | Locus Name | | Acc# |
|---|---|---|---|---|---|---|
| | | | | sp:RPOA_BACHD | | O50634 |

Description

ALPHA CHAIN) (RNA POLYMERASE ALPHA SUBUNIT)

| ORF Name | NTID | AAID | NT Length | AA Length | Score | Probability |
|---|---|---|---|---|---|---|
| 235677_f1_3 | 1864 | 7086 | 149 | 450 | 373 | 2.6e−34 |

| Protein name | | | | Locus Name | | Acc# |
|---|---|---|---|---|---|---|
| | | | | gp:AB017508 | | AB017508 |

Description

*Bacillus halodurans* C-125 genomic DNA, 32 kb fragment, complete cds.

| ORF Name | NTID | AAID | NT Length | AA Length | Score | Probability |
|---|---|---|---|---|---|---|
| 23712803_f1_1 | 1865 | 7087 | 186 | 561 | 524 | 2.6e−50 |

| Protein name | | | | Locus Name | | Acc# |
|---|---|---|---|---|---|---|
| | | | | sp:RL5_BACSU | | P12877 |

Description

50S RIBOSOMAL PROTEIN L5 (BL6)

-continued

| ORF Name | NTID | AAID | NT Length | AA Length | Score | Probability |
|---|---|---|---|---|---|---|
| 24353377_f1_2 | 1866 | 7088 | 100 | 303 | 274 | 8.1e−24 |

| Protein name | Locus Name | Acc# |
|---|---|---|
| ribosomal protein S14 | pir:R3EC14 | |

Description

| ORF Name | NTID | AAID | NT Length | AA Length | Score | Probability |
|---|---|---|---|---|---|---|
| 24353385_f1_10 | 1867 | 7089 | 73 | 222 | 287 | 3.4e−25 |

| Protein name | Locus Name | Acc# |
|---|---|---|
| initiation factor IF1 | gp:AF115283 | AF115283 |

Description

*Leptospira interrogans* S10-spc-alpha locus, complete sequence.

| ORF Name | NTID | AAID | NT Length | AA Length | Score | Probability |
|---|---|---|---|---|---|---|
| 25437550_f1_7 | 1868 | 7090 | 158 | 477 | 354 | 2.7e−32 |

| Protein name | Locus Name | Acc# |
|---|---|---|
| ribosomal protein L15 | pir:A72248 | A72248 |

Description

| ORF Name | NTID | AAID | NT Length | AA Length | Score | Probability |
|---|---|---|---|---|---|---|
| 3019182_f3_30 | 1869 | 7091 | 148 | 447 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 3939377_f1_5 | 1870 | 7092 | 118 | 357 | 332 | 5.8e−30 |

| Protein name | Locus Name | Acc# |
|---|---|---|
| | sp:RL18_BACSU | |

Description

50S RIBOSOMAL PROTEIN L18

| ORF Name | NTID | AAID | NT Length | AA Length | Score | Probability |
|---|---|---|---|---|---|---|
| 4040885_f3_26 | 1871 | 7093 | 127 | 384 | 413 | 1.5e−38 |

| Protein name | Locus Name | Acc# |
|---|---|---|
| ribosomal protein S13 | gp:AF115283 | AF115283 |

Description

*Leptospira interrogans* S10-spc-alpha locus, complete sequence.

-continued

| ORF Name | NTID | AAID | NT Length | AA Length | Score | Probability |
|---|---|---|---|---|---|---|
| 4334377_f3_25 | 1872 | 7094 | 176 | 531 | 443 | 1.0e−41 |

| Protein name | Locus Name | Acc# |
|---|---|---|
| | gp:AB017508 | AB017508 |

Description

*Bacillus halodurans* C-125 genomic DNA, 32 kb fragment, complete cds.

| ORF Name | NTID | AAID | NT Length | AA Length | Score | Probability |
|---|---|---|---|---|---|---|
| 5117303_f1_9 | 1873 | 7095 | 267 | 804 | 673 | 4.2e−66 |

| Protein name | Locus Name | Acc# |
|---|---|---|
| | gp:AB017508 | AB017508 |

Description

*Bacillus halodurans* C-125 genomic DNA, 32 kb fragment, complete cds.

| ORF Name | NTID | AAID | NT Length | AA Length | Score | Probability |
|---|---|---|---|---|---|---|
| 578213_f3_31 | 1874 | 7096 | 215 | 648 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 5897177_f2_20 | 1875 | 7097 | 134 | 405 | 392 | 2.5e−36 |

| Protein name | Locus Name | Acc# |
|---|---|---|
| | sp:RS11_STRCO | P72403 |

Description

30S RIBOSOMAL PROTEIN S11

| ORF Name | NTID | AAID | NT Length | AA Length | Score | Probability |
|---|---|---|---|---|---|---|
| 9969412_f2_18 | 1876 | 7098 | 452 | 1359 | 913 | 1.6e−91 |

| Protein name | Locus Name | Acc# |
|---|---|---|
| preprotein translocase SecY | gp:AF1115283 | AF115283 |

Description

*Leptospira interrogans* S10-spc-alpha locus, complete sequence.

| ORF Name | NTID | AAID | NT Length | AA Length | Score | Probability |
|---|---|---|---|---|---|---|
| 10742027_c1_170 | 1877 | 7099 | 61 | 186 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 12533408_c1_171 | 1878 | 7100 | 177 | 534 | | |
| Protein name | | | Locus Name | | | Acc# |

Description

NO-HIT

| ORF Name | NTID | AAID | NT Length | AA Length | Score | Probability |
|---|---|---|---|---|---|---|
| 13941932_f1_14 | 1879 | 7107 | 759 | 2280 | 1022 | 4.4e−103 |
| Protein name | | | Locus Name | | | Acc# |
| immunoreactive 89 kD antigen PG87 | | | gp:AF175722 | | | AF175722 |

Description

*Porphyromonas gingivalis* strain W50 immunoreactive 89 kD antigen PG87 gene, complete cds.

| ORF Name | NTID | AAID | NT Length | AA Length | Score | Probability |
|---|---|---|---|---|---|---|
| 14105438_f2_49 | 1880 | 7102 | 802 | 2409 | 991 | 8.5e−100 |
| Protein name | | | Locus Name | | | Acc# |
| hypothetical protein Rv0584 | | | pir:G70934 | | | G70934 |

Description

| ORF Name | NTID | AAID | NT Length | AA Length | Score | Probability |
|---|---|---|---|---|---|---|
| 1453553_c2_174 | 1881 | 7103 | 1220 | 3663 | 1910 | 4.3e−222 |
| Protein name | | | Locus Name | | | Acc# |
| beta-galactosidase | | | gp:AF055482 | | | AF055482 |

Description

*Thermotoga neapolitana* galactose utilization operon, complete sequence.

| ORF Name | NTID | AAID | NT Length | AA Length | Score | Probability |
|---|---|---|---|---|---|---|
| 22445937_f1_28 | 1882 | 7104 | 378 | 1137 | 146 | 4.2e−07 |
| Protein name | | | Locus Name | | | Acc# |
| hypothetical protein | | | pir:A75327 | | | A75327 |

Description

| ORF Name | NTID | AAID | NT Length | AA Length | Score | Probability |
|---|---|---|---|---|---|---|
| 24301306_c2_179 | 1883 | 7105 | 64 | 195 | | |
| Protein name | | | Locus Name | | | Acc# |

Description

NO-HIT

-continued

| ORF Name | NTID | AAID | NT Length | AA Length | Score | Probability |
|---|---|---|---|---|---|---|
| 24414007_f1_22 | 1884 | 7106 | 234 | 705 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24415930_f2_56 | 1885 | 7107 | 736 | 2211 | 430 | 6.3e−38 |

| Protein name | | | | Locus Name | | Acc# |
|---|---|---|---|---|---|---|
| 115 K outer membrane protein precursor:SusC protein | | | | pir:JC6027 | | JC6027 |

Description

| ORF Name | NTID | AAID | NT Length | AA Length | Score | Probability |
|---|---|---|---|---|---|---|
| 24422510_c3_237 | 1886 | 7108 | 347 | 1044 | 305 | 5.5e−27 |

| Protein name | | | | Locus Name | | Acc# |
|---|---|---|---|---|---|---|
| hypothetical protein RP407 | | | | pir:F71698 | | F71698 |

Description

| ORF Name | NTID | AAID | NT Length | AA Length | Score | Probability |
|---|---|---|---|---|---|---|
| 24490937_f3_113 | 1887 | 7109 | 135 | 408 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24820301_c2_202 | 1888 | 7110 | 126 | 378 | 121 | 1.3e−07 |

| Protein name | | | | Locus Name | | Acc# |
|---|---|---|---|---|---|---|
| | | | | sp:YHI4_RHOCA | | P30791 |

Description

HYPOTHETICAL PROTEIN IN HIMA 3'REGION (FRAGMENT)

| ORF Name | NTID | AAID | NT Length | AA Length | Score | Probability |
|---|---|---|---|---|---|---|
| 24823562_c3_230 | 1889 | 7111 | 66 | 201 | | |

| Protein name | | | | Locus Name | | Acc# |
|---|---|---|---|---|---|---|

Description

NO-HIT

-continued

| ORF Name | NTID | AAID | NT Length | AA Length | Score | Probability |
|---|---|---|---|---|---|---|
| 2616636_f1_23 | 1890 | 7112 | 183 | 552 | 222 | 2.6e−18 |

| Protein name | Locus Name | Acc# |
|---|---|---|
| conserved hypothetical protein ylbH | pir:E69874 | E69874 |

Description

| ORF Name | NTID | AAID | NT Length | AA Length | Score | Probability |
|---|---|---|---|---|---|---|
| 26351577_c2_177 | 1891 | 7113 | 389 | 1170 | 422 | 3.5e−38 |

| Protein name | Locus Name | Acc# |
|---|---|---|
| sensory transduction histidine kinase slr2098:protein slr2098:protein slr2098 | pir:S75130 | S75130 |

Description

| ORF Name | NTID | AAID | NT Length | AA Length | Score | Probability |
|---|---|---|---|---|---|---|
| 272078_f3_112 | 1892 | 7114 | 375 | 1128 | 449 | 2.3e−42 |

| Protein name | Locus Name | Acc# |
|---|---|---|
| 3-dehydroquinate synthase PAB0298 | pir:C75161 | C75161 |

Description

| ORF Name | NTID | AAID | NT Length | AA Length | Score | Probability |
|---|---|---|---|---|---|---|
| 29332532_c2_196 | 1893 | 7115 | 294 | 885 | 156 | 5.2e−09 |

| Protein name | Locus Name | Acc# |
|---|---|---|
| pobR regulator | gp:PSEY18527 | Y18527 |

Description

*Pseudomonas* sp. pobA, pobR, pcaQ, pcaH and pcaG genes.

| ORF Name | NTID | AAID | NT Length | AA Length | Score | Probability |
|---|---|---|---|---|---|---|
| 29412805_f1_12 | 1894 | 7116 | 199 | 600 | 204 | 2.1e−16 |

| Protein name | Locus Name | Acc# |
|---|---|---|
| RNA polymerase sigma factor SigZ-like protein | gp:AF137263 | AF137263 |

Description

*Bacteroides thetaiotaomicron* 30S ribosomal protein S16-like protein, fucose gene cluster, and RNA polymerase sigma factor SigZ-like protein (sigZ) genes, complete cds.

| ORF Name | NTID | AAID | NT Length | AA Length | Score | Probability |
|---|---|---|---|---|---|---|
| 31328126_c1_149 | 1895 | 7117 | 478 | 1437 | 144 | 4.2e−12 |

| Protein name | Locus Name | Acc# |
|---|---|---|
| hypothetical protein MJ1519 | pir:F64489 | F64489 |

Description

-continued

| ORF Name | NTID | AAID | NT Length | AA Length | Score | Probability |
|---|---|---|---|---|---|---|
| 31408525_f3_121 | 1896 | 7118 | 65 | 198 | | |

| Protein name | Locus Name | ACC# |
|---|---|---|
| | | |

Description

NO-HIT

| ORF Name | NTID | AAID | NT Length | AA Length | Score | Probability |
|---|---|---|---|---|---|---|
| 33366385_f1_15 | 1897 | 7119 | 766 | 2301 | 2410 | 3.6e−250 |

| Protein name | Locus Name | Acc# |
|---|---|---|
| immunoreactive 89 kD antigen PG87 | gp:AF175722 | AF175722 |

Description

*Porphyromonas gingivalis* strain W50 immunoreactive 89 kD antigen PG87 gene, complete cds.

| ORF Name | NTID | AAID | NT Length | AA Length | Score | Probability |
|---|---|---|---|---|---|---|
| 34179592_f2_74 | 1898 | 7120 | 430 | 1293 | 526 | 1.9e−61 |

| Protein name | Locus Name | Acc# |
|---|---|---|
| 3-phosphoshikimate 1-carboxyvinyltransferase,:5-enolpyruvylshikimate-3-phosphate synthase | pir:JN0758 | |

Description

| ORF Name | NTID | AAID | NT Length | AA Length | Score | Probability |
|---|---|---|---|---|---|---|
| 34251302_f3_83 | 1899 | 7121 | 876 | 2631 | 1368 | 3.2e−193 |

| Protein name | Locus Name | Acc# |
|---|---|---|
| alanyl-tRNA synthetase | gp:AF027500 | AF027500 |

Description

*Aquifex pyrophilus* alanyl-tRNA synthetase (alaS) gene, complete cds; and ATP-dependent Clp protease regulatory subunit (clpA) gene, partial cds.

| ORF Name | NTID | AAID | NT Length | AA Length | Score | Probability |
|---|---|---|---|---|---|---|
| 4039063_c2_183 | 1900 | 7122 | 146 | 441 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4113941_c3_208 | 1901 | 7123 | 656 | 1971 | 379 | 3.2e−32 |

| Protein name | Locus Name | Acc# |
|---|---|---|
| lacto-N-biosidase precursor | gp:SSU40488 | U40488 |

Description

*Streptomyces* sp. lacto-N-biosidase precursor gene, complete cds.

-continued

| ORF Name | NTID | AAID | NT Length | AA Length | Score | Probability |
|---|---|---|---|---|---|---|
| 4173192_f2_57 | 1902 | 7124 | 196 | 591 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 4692208_c2_173 | 1903 | 7125 | 499 | 1500 | 264 | 2.6e−49 |

| Protein name | | | | Locus Name | | Acc# |
|---|---|---|---|---|---|---|
| alpha-1,3/4-fucosidase precursor | | | | gp:SSU39394 | | U39394 |

Description

*Streptomyces* sp. alpha-1,3/4-fucosidase precursor gene, complete cds.

| ORF Name | NTID | AAID | NT Length | AA Length | Score | Probability |
|---|---|---|---|---|---|---|
| 4964055_f2_48 | 1904 | 7126 | 402 | 1209 | 598 | 3.8e−58 |

| Protein name | | | | Locus Name | | Acc# |
|---|---|---|---|---|---|---|
| putative membrane transport protein. | | | | gp:SCC75A | | AL133220 |

Description

*Streptomyces coelicolor* cosmid C75A.

| ORF Name | NTID | AAID | NT Length | AA Length | Score | Probability |
|---|---|---|---|---|---|---|
| 5162628_f2_60 | 1905 | 7127 | 281 | 846 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 5319637_f2_58 | 1906 | 7128 | 385 | 1158 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 546925_c2_176 | 1907 | 7129 | 303 | 912 | 156 | 3.3e−11 |

| Protein name | | | | Locus Name | | Acc# |
|---|---|---|---|---|---|---|
| PobR | | | | gp:RLU40388 | | U40388 |

Description

*Rhizobium leguminosarum* positive regulator of pobA (pobR) gene, complete cds, and 4-hydroxybenzoate hydroxylase (pobA) gene, partial cds.

-continued

| ORF Name | NTID | AAID | NT Length | AA Length | Score | Probability |
|---|---|---|---|---|---|---|
| 625032_c2_184 | 1908 | 7130 | 989 | 2970 | 166 | 1.7e−15 |

| Protein name | Locus Name | Acc# |
|---|---|---|
| unknown | gp:AF007381 | AF007381 |

Description

*Flavobacterium jojnsoniae* gliding motility protein (gldA) gene, complete cds; and unknown genes.

| ORF Name | NTID | AAID | NT Length | AA Length | Score | Probability |
|---|---|---|---|---|---|---|
| 6306441_f1_17 | 1909 | 7131 | 422 | 1269 | 178 | 5.0e−10 |

| Protein name | Locus Name | Acc# |
|---|---|---|
| receptor antigen (RagA) | gp:PGI130872 | AJ130872 |

Description

*Porphyromonas gingivalis* W50 receptor antigen (rag) locus encodinga major immunodominant 55 kDa antigen.

| ORF Name | NTID | AAID | NT Length | AA Length | Score | Probability |
|---|---|---|---|---|---|---|
| 634758_c1_140 | 1910 | 7132 | 79 | 240 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 6761652_c2_185 | 1911 | 7133 | 503 | 1512 | 915 | 9.6e−92 |

| Protein name | Locus Name | Acc# |
|---|---|---|
| | sp:YWNE_BACSU | P71040 |

Description

HYPOTHETICAL 55.8 KD PROTEIN IN SPOIIQ-MTA INTERGENIC REGION

| ORF Name | NTID | AAID | NT Length | AA Length | Score | Probability |
|---|---|---|---|---|---|---|
| 796950_f2_50 | 1912 | 7134 | 342 | 1029 | 165 | 1.0e−09 |

| Protein name | Locus Name | Acc# |
|---|---|---|
| transmembrane sensor | gp:AF051691 | AF051691 |

Description

*Pseudomonas aeruginosa* stress factor A (psfA), ECF sigma factor (fiuI), transmembrane sensor (fiuR), and hydroxamate-typeferrisiderophore receptor (fiuA) genes, complete cds.

| ORF Name | NTID | AAID | NT Length | AA Length | Score | Probability |
|---|---|---|---|---|---|---|
| 1055303_f3_59 | 1913 | 7135 | 76 | 231 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 10797128_f3_58 | 1914 | 7136 | 384 | 1155 | 406 | 8.3e−38 |

| Protein name | | | Locus Name | | | Acc# |
|---|---|---|---|---|---|---|
| DNA processing chain A | | | pir:C72399 | | | C72399 |

Description

| ORF Name | NTID | AAID | NT Length | AA Length | Score | Probability |
|---|---|---|---|---|---|---|
| 1293_f2_43 | 1915 | 7137 | 310 | 933 | 133 | 3.2e−06 |

| Protein name | | | Locus Name | | | Acc# |
|---|---|---|---|---|---|---|
| | | | sp:EXSA_PSEAE | | | P26993 |

Description

EXOENZYME S SYNTHESIS REGULATORY PROTEIN EXSA

| ORF Name | NTID | AAID | NT Length | AA Length | Score | Probability |
|---|---|---|---|---|---|---|
| 13157626_f1_17 | 1916 | 7138 | 85 | 258 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 134717_f1_12 | 1917 | 7139 | 322 | 969 | 107 | 0.0016 |

| Protein name | | | Locus Name | | | Acc# |
|---|---|---|---|---|---|---|
| hypothetical protein RP870 | | | pir:F71649 | | | F71649 |

Description

| ORF Name | NTID | AAID | NT Length | AA Length | Score | Probability |
|---|---|---|---|---|---|---|
| 13678887_f3_67 | 1918 | 7140 | 72 | 219 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 20734627_f2_40 | 1919 | 7141 | 341 | 1026 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 22068817_c2_132 | 1920 | 7142 | 165 | 498 | 162 | 6.0e−12 |

| Protein name | | | Locus Name | | | Acc# |
|---|---|---|---|---|---|---|
| RNA polymerase sigma-E factor | | | pir:H75550 | | | H75550 |

Description

-continued

| ORF Name | NTID | AAID | NT Length | AA Length | Score | Probability |
|---|---|---|---|---|---|---|
| 22072175_f3_62 | 1921 | 7143 | 833 | 2502 | 192 | 5.0e−11 |
| Protein name | | | Locus Name | | Acc# | |
| tonB-linked receptor Tlr | | | gp:AF155223 | | AF155223 | |
| Description | | | | | | |

*Porphyromonas gingivalis* tonB-linked receptor Tlr (tlr) gene, complete cds.

| ORF Name | NTID | AAID | NT Length | AA Length | Score | Probability |
|---|---|---|---|---|---|---|
| 22460876_f2_42 | 1922 | 7144 | 342 | 1029 | 111 | 0.0052 |
| Protein name | | | Locus Name | | Acc# | |
| 71 | | | gp:AF030027 | | AF030027 | |
| Description | | | | | | |

Equine herpesvirus 4 strain NS80567, complete genome.

| ORF Name | NTID | AAID | NT Length | AA Length | Score | Probability |
|---|---|---|---|---|---|---|
| 23634713_f1_22 | 1923 | 7145 | 377 | 1134 | 135 | 3.5e−11 |
| Protein name | | | Locus Name | | Acc# | |
| | | | gp:PSEOPRC | | D28119 | |
| Description | | | | | | |

*Pseudomonas aeruginosa* oprC gene for outer membrane protein C, complete cds.

| ORF Name | NTID | AAID | NT Length | AA Length | Score | Probability |
|---|---|---|---|---|---|---|
| 23875636_c1_92 | 1924 | 7146 | 96 | 291 | 78 | 0.039 |
| Protein name | | | Locus Name | | Acc# | |
| | | | sp:YB05_YEAST | | P33313 | |
| Description | | | | | | |

HYPOTHETICAL 44.1 KD PROTEIN IN RPB5-CDC28 INTERGENIC REGION

| ORF Name | NTID | AAID | NT Length | AA Length | Score | Probability |
|---|---|---|---|---|---|---|
| 24220312_f1_14 | 1925 | 7147 | 142 | 429 | 149 | 1.4e−10 |
| Protein name | | | Locus Name | | Acc# | |
| | | | sp:YE94_AQUAE | | O67466 | |
| Description | | | | | | |

HYPOTHETICAL 15.3 KD PROTEIN AQ_1494

| ORF Name | NTID | AAID | NT Length | AA Length | Score | Probability |
|---|---|---|---|---|---|---|
| 24335967_c2_103 | 1926 | 7148 | 255 | 768 | 744 | 1.3e−73 |
| Protein name | | | Locus Name | | Acc# | |
| putative reductase iron-sulfur protein | | | gp:SCM10 | | AL133469 | |
| Description | | | | | | |

*Streptomyces coelicolor* cosmid M10.

-continued

| ORF Name | NTID | AAID | NT Length | AA Length | Score | Probability |
|---|---|---|---|---|---|---|
| 24486507_f3_69 | 1927 | 7149 | 211 | 636 | 187 | 3.1e−14 |
| Protein name | | | Locus Name | | | Acc# |
| | | | sp:Y374_METJA | | | Q57819 |

Description

HYPOTHETICAL PROTEIN MJ0374

| ORF Name | NTID | AAID | NT Length | AA Length | Score | Probability |
|---|---|---|---|---|---|---|
| 25397550_f2_31 | 1928 | 7150 | 342 | 1029 | 197 | 8.2e−19 |
| Protein name | | | Locus Name | | | Acc# |
| probable UDP-glucose 4-epimerase | | | pir:A71183 | | | A71183 |

Description

| ORF Name | NTID | AAID | NT Length | AA Length | Score | Probability |
|---|---|---|---|---|---|---|
| 26345025_c1_95 | 1929 | 7151 | 164 | 495 | 160 | 9.7e−12 |
| Protein name | | | Locus Name | | | Acc# |
| nimD protein | | | pir:I40187 | | | |

Description

| ORF Name | NTID | AAID | NT Length | AA Length | Score | Probability |
|---|---|---|---|---|---|---|
| 31445427_c1_85 | 1930 | 7152 | 330 | 993 | 576 | 8.1e−56 |
| Protein name | | | Locus Name | | | Acc# |
| | | | sp:YACF_BACSU | | | P37567 |

Description

HYPOTHETICAL 37.1 KD PROTEIN IN FOLK-LYSS INTERGENIC REGION

| ORF Name | NTID | AAID | NT Length | AA Length | Score | Probability |
|---|---|---|---|---|---|---|
| 3397252_c3_140 | 1931 | 7153 | 652 | 1959 | 2133 | 8.2e−221 |
| Protein name | | | Locus Name | | | Acc# |
| putative reductase flavoprotein subunit | | | sp:SCM10 | | | AL133469 |

Description

*Streptomyces coelicolor* cosmid M10.

| ORF Name | NTID | AAID | NT Length | AA Length | Score | Probability |
|---|---|---|---|---|---|---|
| 33728400_c3_138 | 1932 | 7154 | 292 | 879 | 138 | 7.2e−07 |
| Protein name | | | Locus Name | | | Acc# |
| | | | sp:EXSA_PSEAE | | | P26993 |

Description

EXOENZYME S SYNTHESIS REGULATORY PROTEIN EXSA

-continued

| ORF Name | NTID | AAID | NT Length | AA Length | Score | Probability |
|---|---|---|---|---|---|---|
| 34197186_f2_30 | 1933 | 7155 | 300 | 903 | 494 | 3.9e−47 |

| Protein name | Locus Name | Acc# |
|---|---|---|
| cation efflux system homolog ydfM | pir:C69781 | C69781 |

Description

| ORF Name | NTID | AAID | NT Length | AA Length | Score | Probability |
|---|---|---|---|---|---|---|
| 34379406_c1_78 | 1934 | 7156 | 74 | 225 | 74 | 0.013 |

| Protein name | Locus Name | Acc# |
|---|---|---|
| citrate synthase | gp:BBU28076 | U28076 |

Description

*Bartonella bacilliformis* citrate synthase (gltA) gene, partial cds.

| ORF Name | NTID | AAID | NT Length | AA Length | Score | Probability |
|---|---|---|---|---|---|---|
| 36361057_f3_50 | 1935 | 7157 | 317 | 954 | 980 | 1.2e−98 |

| Protein name | Locus Name | Acc# |
|---|---|---|
| O-acetylserine(thiol)-lyase-A related protein | gp:AF174138 | AF174138 |

Description

*Methanosarcina barkeri* O-acetylserine(thiol)-lyase-A related protein (cysK) gene, complete cds.

| ORF Name | NTID | AAID | NT Length | AA Length | Score | Probability |
|---|---|---|---|---|---|---|
| 4025375_f3_57 | 1936 | 7158 | 425 | 1278 | 1537 | 1.2e−157 |

| Protein name | Locus Name | Acc# |
|---|---|---|
| collagenase | gp:AB006973 | AB006973 |

Description

*Porphyromonas gingivalis* DNA for collagenase, complete cds.

| ORF Name | NTID | AAID | NT Length | AA Length | Score | Probability |
|---|---|---|---|---|---|---|
| 4117202_f2_41 | 1937 | 7159 | 321 | 966 | 81 | 0.043 |

| Protein name | Locus Name | Acc# |
|---|---|---|
| | sp:RL12_HALVO | P41197 |

Description

50S RIBOSOMAL PROTEIN L12 ('A' TYPE)

| ORF Name | NTID | AAID | NT Length | AA Length | Score | Probability |
|---|---|---|---|---|---|---|
| 4789162_c1_91 | 1938 | 7160 | 718 | 2157 | 1190 | 7.0e−121 |

| Protein name | Locus Name | Acc# |
|---|---|---|
| conserved hypothetical protein yvaJ | pir:G70027 | G70027 |

Description

-continued

| ORF Name | NTID | AAID | NT Length | AA Length | Score | Probability |
|---|---|---|---|---|---|---|
| 5095937_f1_21 | 1939 | 7161 | 409 | 1230 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 5994790_f3_49 | 1940 | 7162 | 286 | 861 | 281 | 3.2e−24 |

| Protein name | Locus Name | Acc# |
|---|---|---|
| probable lipase | pir:C75472 | C75472 |

Description

| ORF Name | NTID | AAID | NT Length | AA Length | Score | Probability |
|---|---|---|---|---|---|---|
| 6053885_c2_101 | 1941 | 7163 | 64 | 195 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 6444187_c1_94 | 1942 | 7164 | 206 | 621 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 781703_f2_36 | 1943 | 7165 | 239 | 720 | 96 | 0.0070 |

| Protein name | Locus Name | Acc# |
|---|---|---|
| hypothetical protein | gp:PAU243397 | AJ243397 |

Description

*Pseudomonas aureofaciens* partial bolA gene and ORF1 DNA.

| ORF Name | NTID | AAID | NT Length | AA Length | Score | Probability |
|---|---|---|---|---|---|---|
| 867012_c2_102 | 1944 | 7166 | 234 | 705 | 199 | 7.2e−16 |

| Protein name | Locus Name | Acc# |
|---|---|---|
| putative cytochrome B subunit | gp:SCM10 | AL133469 |

Description

*Streptomyces coelicolor* cosmid M10.

-continued

| ORF Name | NTID | AAID | NT Length | AA Length | Score | Probability |
|---|---|---|---|---|---|---|
| 2141962_c3_52 | 1945 | 7167 | 132 | 399 | 179 | 9.5e−14 |

| Protein name | Locus Name | Acc# |
|---|---|---|
| MecI protein | gp:SSK3MECA2 | Y13095 |

Description

*S. sciuri* mecA2 gene, strain K3 (MM2).

| ORF Name | NTID | AAID | NT Length | AA Length | Score | Probability |
|---|---|---|---|---|---|---|
| 23634637_f1_14 | 1946 | 7168 | 291 | 876 | 113 | 0.0010 |

| Protein name | Locus Name | Acc# |
|---|---|---|
| immunoglobulin-Fc-binding protein | gp:SPFCRA2 | X73159 |

Description

*S. pyogenes* fcrA2 gene for Ig-Fc-binding protein.

| ORF Name | NTID | AAID | NT Length | AA Length | Score | Probability |
|---|---|---|---|---|---|---|
| 24648410_c2_41 | 1947 | 7169 | 1097 | 3294 | 289 | 4.2e−37 |

| Protein name | Locus Name | Acc# |
|---|---|---|
| hypothetical protein c0624 | pir:S73091 | S73091 |

Description

| ORF Name | NTID | AAID | NT Length | AA Length | Score | Probability |
|---|---|---|---|---|---|---|
| 25822143_c3_53 | 1948 | 7170 | 731 | 2196 | 114 | 0.0037 |

| Protein name | Locus Name | Acc# |
|---|---|---|
|  | sp:BLAR_STAAU | P18357 |

Description

REGULATORY PROTEIN BLAR1

| ORF Name | NTID | AAID | NT Length | AA Length | Score | Probability |
|---|---|---|---|---|---|---|
| 35159632_f3_27 | 1949 | 7171 | 76 | 231 | 54 | 0.022 |

| Protein name | Locus Name | Acc# |
|---|---|---|
| extracellular protein Exp4 precursor | gp:LLU95836 | U95836 |

Description

*Lactococcus lactis* extracellular protein Exp4 precursor, gene, partial cds.

| ORF Name | NTID | AAID | NT Length | AA Length | Score | Probability |
|---|---|---|---|---|---|---|
| 4178387_c1_38 | 1950 | 7172 | 317 | 954 | 750 | 2.9e−74 |

| Protein name | Locus Name | Acc# |
|---|---|---|
|  | sp:MDH_CHLAU | P80040 |

Description

MALATE DEHYDROGENASE,

-continued

| ORF Name | NTID | AAID | NT Length | AA Length | Score | Probability |
|---|---|---|---|---|---|---|
| 4725192_f3_26 | 1951 | 7173 | 676 | 2031 | 159 | 2.7e−13 |

| Protein name | Locus Name | Acc# |
|---|---|---|
| hypothetical protein F14F9.5 | pir:T33774 | T33774 |

Description

| ORF Name | NTID | AAID | NT Length | AA Length | Score | Probability |
|---|---|---|---|---|---|---|
| 24337765_c3_16 | 1952 | 7174 | 762 | 2286 | 673 | 6.1e−69 |

| Protein name | Locus Name | Acc# |
|---|---|---|
| 115 K outer membrane protein precursor:SusC protein | pir:JC6027 | JC6027 |

Description

| ORF Name | NTID | AAID | NT Length | AA Length | Score | Probability |
|---|---|---|---|---|---|---|
| 2477187_c3_15 | 1953 | 7175 | 60 | 183 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 35235700_f2_6 | 1954 | 7176 | 62 | 189 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 5991061_c1_11 | 1955 | 7177 | 227 | 684 | 859 | 8.3e−86 |

| Protein name | Locus Name | Acc# |
|---|---|---|
| Phosphoenolpyruvate carboxykinase | gp:AB016600 | AB016600 |

Description

*Selenomonas ruminantium* gene for Phosphoenolpyruvate carboxykinase, complete cds.

| ORF Name | NTID | AAID | NT Length | AA Length | Score | Probability |
|---|---|---|---|---|---|---|
| 10009393_c1_53 | 1956 | 7178 | 71 | 216 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 13103563_f3_37 | 1957 | 7179 | 375 | 1128 | 248 | 5.3e−21 |

| Protein name | | | Locus Name | | | Acc# |
|---|---|---|---|---|---|---|
| probable histidinol phosphatase | | | pir:F75515 | | | F75515 |

Description

| ORF Name | NTID | AAID | NT Length | AA Length | Score | Probability |
|---|---|---|---|---|---|---|
| 14587752_f3_39 | 1958 | 7180 | 165 | 498 | 345 | 2.4e−31 |

| Protein name | | | Locus Name | | | Acc# |
|---|---|---|---|---|---|---|
| | | | sp:RISB_BACAM | | | Q44681 |

Description (LUMAZINE SYNTHASE) (RIBOFLAVIN SYNTHASE BETA CHAIN)

| ORF Name | NTID | AAID | NT Length | AA Length | Score | Probability |
|---|---|---|---|---|---|---|
| 17092_c1_50 | 1959 | 7181 | 395 | 1188 | 474 | 5.2e−45 |

| Protein name | | | Locus Name | | | Acc# |
|---|---|---|---|---|---|---|
| | | | gp:AB013492 | | | AB013492 |

Description

*Bacillus halodurans* C-125 genomic DNA, 9A/3S' fragment, clone ALBAC001.

| ORF Name | NTID | AAID | NT Length | AA Length | Score | Probability |
|---|---|---|---|---|---|---|
| 1954562_f1_5 | 1960 | 7182 | 366 | 1101 | 1505 | 2.9e−154 |

| Protein name | | | Locus Name | | | Acc# |
|---|---|---|---|---|---|---|
| | | | sp:G3P_BACFR | | | Q59199 |

Description (FRAGMENT)

| ORF Name | NTID | AAID | NT Length | AA Length | Score | Probability |
|---|---|---|---|---|---|---|
| 23958125_c2_76 | 1961 | 7183 | 517 | 1554 | 1411 | 2.6e−144 |

| Protein name | | | Locus Name | | | Acc# |
|---|---|---|---|---|---|---|
| | | | sp:GUAA_ECOLI | | | P04079 |

Description

AMIDOTRANSFERASE) (GMP SYNTHETASE)

| ORF Name | NTID | AAID | NT Length | AA Length | Score | Probability |
|---|---|---|---|---|---|---|
| 24017187_f2_25 | 1962 | 7184 | 236 | 711 | 109 | 0.00037 |

| Protein name | | | Locus Name | | | Acc# |
|---|---|---|---|---|---|---|
| | | | sp:YA57_ACTAC | | | O52728 |

Description

HYPOTHETICAL PROTEIN 1057

-continued

| ORF Name | NTID | AAID | NT Length | AA Length | Score | Probability |
|---|---|---|---|---|---|---|
| 240762_c1_46 | 1963 | 7185 | 62 | 189 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24229038_f2_19 | 1964 | 7186 | 716 | 2151 | 1255 | 9.0e−128 |

| Protein name | | | | Locus Name | | Acc# |
|---|---|---|---|---|---|---|
| | | | | sp:OPDA_ECOLI | | P27298 |

Description

OLIGOPEPTIDASE A,

| ORF Name | NTID | AAID | NT Length | AA Length | Score | Probability |
|---|---|---|---|---|---|---|
| 24431425_f3_36 | 1965 | 7187 | 82 | 249 | 78 | 0.0054 |

| Protein name | | | | Locus Name | | Acc# |
|---|---|---|---|---|---|---|
| | | | | gp:MGU34967 | | U34967 |

Description

*Mycoplasma genitalium* repetitive sequence element mgp-r4.

| ORF Name | NTID | AAID | NT Length | AA Length | Score | Probability |
|---|---|---|---|---|---|---|
| 24508512_c3_83 | 1966 | 7188 | 102 | 309 | 100 | 2.2e−05 |

| Protein name | | | | Locus Name | | Acc# |
|---|---|---|---|---|---|---|
| hypothetical protein | | | | pir:D72328 | | D72328 |

Description

| ORF Name | NTID | AAID | NT Length | AA Length | Score | Probability |
|---|---|---|---|---|---|---|
| 24645176_f3_41 | 1967 | 7189 | 427 | 1284 | 743 | 1.6e−73 |

| Protein name | | | | Locus Name | | Acc# |
|---|---|---|---|---|---|---|
| probable oxidoreductase | | | | gp:SCF11 | | AL132662 |

Description

*Streptomyces coelicolor* cosmid F11.

| ORF Name | NTID | AAID | NT Length | AA Length | Score | Probability |
|---|---|---|---|---|---|---|
| 24648437_f2_20 | 1968 | 7190 | 171 | 516 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 26595836_f1_6 | 1969 | 7191 | 147 | 444 | 292 | 1.0e−25 |
| Protein name | | | | Locus Name | | Acc# |
| dCMP deaminase homolog | | | | pir:C69470 | | C69470 |

Description

| ORF Name | NTID | AAID | NT Length | AA Length | Score | Probability |
|---|---|---|---|---|---|---|
| 3009632_f2_16 | 1970 | 7192 | 675 | 2028 | | |
| Protein name | | | | Locus Name | | Acc# |

Description

NO-HIT

| ORF Name | NTID | AAID | NT Length | AA Length | Score | Probability |
|---|---|---|---|---|---|---|
| 34175162_f1_7 | 1971 | 7193 | 184 | 555 | 331 | 7.4e−30 |
| Protein name | | | | Locus Name | | Acc# |
| conserved hypothetical protein aq_1731 | | | | pir:C70449 | | C70449 |

Description

| ORF Name | NTID | AAID | NT Length | AA Length | Score | Probability |
|---|---|---|---|---|---|---|
| 34407937_f3_35 | 1972 | 7194 | 494 | 1485 | 538 | 8.6e−52 |
| Protein name | | | | Locus Name | | Acc# |
| carboxyl-terminal proteinase | | | | pir:F70369 | | F70369 |

Description

| ORF Name | NTID | AAID | NT Length | AA Length | Score | Probability |
|---|---|---|---|---|---|---|
| 36328387_c2_58 | 1973 | 7195 | 609 | 1830 | | |
| Protein name | | | | Locus Name | | Acc# |

Description

NO-HIT

| ORF Name | NTID | AAID | NT Length | AA Length | Score | Probability |
|---|---|---|---|---|---|---|
| 36370312_c2_75 | 1974 | 7196 | 148 | 447 | 405 | 1.1e−37 |
| Protein name | | | | Locus Name | | Acc# |
| | | | | sp:MSCL_ECOLI | | P23867 |

Description

LARGE-CONDUCTANCE MECHANOSENSITIVE CHANNEL

| ORF Name | NTID | AAID | NT Length | AA Length | Score | Probability |
|---|---|---|---|---|---|---|
| 6538962_c1_49 | 1975 | 7197 | 138 | 417 | | |
| Protein name | | | | Locus Name | | Acc# |

Description

NO-HIT

-continued

| ORF Name | NTID | AAID | NT Length | AA Length | Score | Probability |
|---|---|---|---|---|---|---|
| 782642_c2_77 | 1976 | 7198 | 66 | 201 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 16659411_f2_19 | 1977 | 7199 | 83 | 252 | 183 | 1.9e−13 |

| Protein name | | | Locus Name | | | Acc# |
|---|---|---|---|---|---|---|
| hypothetical protein | | | pir:JQ1020 | | | JQ1020 |

Description

| ORF Name | NTID | AAID | NT Length | AA Length | Score | Probability |
|---|---|---|---|---|---|---|
| 2741687_c1_28 | 1978 | 7200 | 696 | 2091 | 281 | 1.4e−23 |

| Protein name | | | Locus Name | | | Acc# |
|---|---|---|---|---|---|---|
| conserved hypothetical protein MTH83 | | | pir:F69210 | | | F69210 |

Description

| ORF Name | NTID | AAID | NT Length | AA Length | Score | Probability |
|---|---|---|---|---|---|---|
| 3942136_c3_38 | 1979 | 7201 | 649 | 1950 | 1708 | 8.9e−176 |

| Protein name | | | Locus Name | | | Acc# |
|---|---|---|---|---|---|---|
| threonyl-tRNA synthetase | | | pir:B75317 | | | B75317 |

Description

| ORF Name | NTID | AAID | NT Length | AA Length | Score | Probability |
|---|---|---|---|---|---|---|
| 4711562_f2_18 | 1980 | 7292 | 421 | 1266 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 7032800_c1_30 | 1981 | 7203 | 116 | 348 | 262 | 1.5e−22 |

| Protein name | | | Locus Name | | | Acc# |
|---|---|---|---|---|---|---|
| | | | sp:IF3_HAEIN | | | P43814 |

Description

TRANSLATION INITIATION FACTOR IF-3

| ORF Name | NTID | AAID | NT Length | AA Length | Score | Probability |
|---|---|---|---|---|---|---|
| 10741260_c2_21 | 1982 | 7204 | 74 | 225 | 110 | 1.9e–06 |

| Protein name | | | | Locus Name | | Acc# |
|---|---|---|---|---|---|---|
| | | | | sp:RL29_BACST | | P04457 |

Description

50S RIBOSOMAL PROTEIN L29

| ORF Name | NTID | AAID | NT Length | AA Length | Score | Probability |
|---|---|---|---|---|---|---|
| 1204063_c3_23 | 1983 | 7205 | 146 | 441 | 461 | 1.2e–43 |

| Protein name | | | | Locus Name | | Acc# |
|---|---|---|---|---|---|---|
| | | | | sp:RL16_SYNY3 | | P73313 |

Description

50S RIBOSOMAL PROTEIN L16

| ORF Name | NTID | AAID | NT Length | AA Length | Score | Probability |
|---|---|---|---|---|---|---|
| 24399202_c1_16 | 1984 | 7206 | 244 | 735 | 639 | 1.7e–62 |

| Protein name | | | | Locus Name | | Acc# |
|---|---|---|---|---|---|---|
| | | | | gp:AB017508 | | AB017508 |

Description

*Bacillus halodurans* C-125 genomic DNA, 32 kb fragment, complete cds.

| ORF Name | NTID | AAID | NT Length | AA Length | Score | Probability |
|---|---|---|---|---|---|---|
| 26600312_c1_14 | 1985 | 7207 | 210 | 633 | 486 | 2.8e–46 |

| Protein name | | | | Locus Name | | Acc# |
|---|---|---|---|---|---|---|
| | | | | sp:RL4_BACST | | P28601 |

Description

50S RIBOSOMAL PROTEIN L4

| ORF Name | NTID | AAID | NT Length | AA Length | Score | Probability |
|---|---|---|---|---|---|---|
| 31525257_c3_22 | 1986 | 7208 | 90 | 273 | 326 | 2.5e–29 |

| Protein name | | | | Locus Name | | Acc# |
|---|---|---|---|---|---|---|
| ribosomal protein S19 | | | | pir:H72249 | | |

Description

| ORF Name | NTID | AAID | NT Length | AA Length | Score | Probability |
|---|---|---|---|---|---|---|
| 4688811_c1_15 | 1987 | 7209 | 279 | 840 | 853 | 3.6e–85 |

| Protein name | | | | Locus Name | | Acc# |
|---|---|---|---|---|---|---|
| | | | | gp:AB017508 | | AB017508 |

Description

*Bacillus halodurans* C-125 genomic DNA, 32 kb fragment, complete cds.

-continued

| ORF Name | NTID | AAID | NT Length | AA Length | Score | Probability |
|---|---|---|---|---|---|---|
| 4978427_c2_19 | 1988 | 7210 | 97 | 294 | 173 | 4.1e−13 |

| Protein name | | | | Locus Name | | Acc# |
|---|---|---|---|---|---|---|
| | | | | sp:RL23_SYNY3 | | P73318 |

Description

50S RIBOSOMAL PROTEIN L23

| ORF Name | NTID | AAID | NT Length | AA Length | Score | Probability |
|---|---|---|---|---|---|---|
| 5976007_f3_12 | 1989 | 7211 | 64 | 195 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 659702_c1_18 | 1990 | 7212 | 89 | 270 | 278 | 3.1e−24 |

| Protein name | | | | Locus Name | | Acc# |
|---|---|---|---|---|---|---|
| ribosomal protein S17 | | | | pir:C72249 | | |

Description

| ORF Name | NTID | AAID | NT Length | AA Length | Score | Probability |
|---|---|---|---|---|---|---|
| 6829637_c2_20 | 1991 | 7213 | 143 | 432 | 231 | 2.9e−19 |

| Protein name | | | | Locus Name | | Acc# |
|---|---|---|---|---|---|---|
| | | | | sp:RL22_*ECOLI* | | P02423 |

Description

50S RIBOSOMAL PROTEIN L22

| ORF Name | NTID | AAID | NT Length | AA Length | Score | Probability |
|---|---|---|---|---|---|---|
| 11924131_f1_14 | 1992 | 7214 | 245 | 735 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 12284405_f1_1 | 1993 | 7215 | 400 | 1203 | 279 | 7.7e−23 |

| Protein name | | | | Locus Name | | Acc# |
|---|---|---|---|---|---|---|
| | | | | sp:RFBX_SALTY | | P26400 |

Description

PUTATIVE O-ANTIGEN TRANSPORTER

-continued

| ORF Name | NTID | AAID | NT Length | AA Length | Score | Probability |
|---|---|---|---|---|---|---|
| 1251537_c2_67 | 1994 | 7216 | 61 | 186 | 81 | 0.014 |

| Protein name | | | | Locus Name | | Acc# |
|---|---|---|---|---|---|---|
| | | | | gp:CEY39C12A | | AL132859 |

Description

*Caenorhabditis elegans* cosmid Y39C12A, complete sequence.

| ORF Name | NTID | AAID | NT Length | AA Length | Score | Probability |
|---|---|---|---|---|---|---|
| 1366500_f1_3 | 1995 | 7217 | 383 | 1152 | 158 | 9.7e−09 |

| Protein name | | | | Locus Name | | Acc# |
|---|---|---|---|---|---|---|
| hypothetical protein 17.9 | | | | pir:S22619 | | S22619 |

Description

| ORF Name | NTID | AAID | NT Length | AA Length | Score | Probability |
|---|---|---|---|---|---|---|
| 13710902_f3_32 | 1996 | 7218 | 407 | 1224 | 142 | 1.1e−06 |

| Protein name | | | | Locus Name | | Acc# |
|---|---|---|---|---|---|---|
| putative membrane protein | | | | gp:SPN131984 | | AJ131984 |

Description

*Streptococcus pneumoniae* cap37 locus.

| ORF Name | NTID | AAID | NT Length | AA Length | Score | Probability |
|---|---|---|---|---|---|---|
| 14882818_c2_76 | 1997 | 7219 | 93 | 282 | 165 | 2.9e−12 |

| Protein name | | | | Locus Name | | Acc# |
|---|---|---|---|---|---|---|
| | | | | sp:DBH_BACST | | |

Description

DNA-BINDING PROTEIN II (HB) (HU)

| ORF Name | NTID | AAID | NT Length | AA Length | Score | Probability |
|---|---|---|---|---|---|---|
| 15822135_f3_31 | 1998 | 7220 | 309 | 930 | 241 | 2.5e−20 |

| Protein name | | | | Locus Name | | Acc# |
|---|---|---|---|---|---|---|
| | | | | sp:Y868_HAEIN | | |

Description

PUTATIVE GLYCOSYL TRANSFERASE HI0868,

| ORF Name | NTID | AAID | NT Length | AA Length | Score | Probability |
|---|---|---|---|---|---|---|
| 161592_f3_30 | 1999 | 7221 | 321 | 966 | 194 | 3.1e−13 |

| Protein name | | | | Locus Name | | Acc# |
|---|---|---|---|---|---|---|
| WbcD | | | | gp:YEU46859 | | |

Description

*Yersinia enterocolitica* lipopolysaccharide O-side chainbiosynthesis genes.

-continued

| ORF Name | NTID | AAID | NT Length | AA Length | Score | Probability |
|---|---|---|---|---|---|---|
| 19697126_f3_37 | 2000 | 7222 | 316 | 951 | 1366 | 1.6e−139 |

| Protein name | Locus Name | Acc# |
|---|---|---|
| putative UDP-GlcNAc:undecaprenylphosphate | gp:AF048749 | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 1989077_f3_36 | 2001 | 7223 | 320 | 963 | 809 | 2.4e−147 |

| Protein name | Locus Name | Acc# |
|---|---|---|
| UDP-glucose-4-epimerase/dTDP-glucose-4,6 | gp:AF048749 | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 20350437_f2_15 | 2002 | 7224 | 253 | 762 | 362 | 3.8e−33 |

| Protein name | Locus Name | Acc# |
|---|---|---|
| unknown | gp:AF078135 | AF078135 |

Description

*Leptospira borgpetersenii* lipopolysaccharide o-antigen biosyntheticlocus, complete sequence.

| ORF Name | NTID | AAID | NT Length | AA Length | Score | Probability |
|---|---|---|---|---|---|---|
| 21879191_f3_40 | 2003 | 7225 | 239 | 720 | 129 | 2.6e−06 |

| Protein name | Locus Name | Acc# |
|---|---|---|
| lipopepticie antibiotic iturin A biosynthesis protein:protein slr0495:protein slr0495 | pir:S74408 | S74408 |

Description

| ORF Name | NTID | AAID | NT Length | AA Length | Score | Probability |
|---|---|---|---|---|---|---|
| 22304007_f2_29 | 2004 | 7226 | 404 | 1215 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 23945251_f1_11 | 2005 | 7227 | 453 | 1362 | 542 | 3.2e−52 |

| Protein name | Locus Name | Acc# |
|---|---|---|
| hemolysin-related protein | pir:F72326 | F72326 |

Description

-continued

| ORF Name | NTID | AAID | NT Length | AA Length | Score | Probability |
|---|---|---|---|---|---|---|
| 24410751_c2_85 | 2006 | 7228 | 64 | 195 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24426550_f1_8 | 2007 | 7229 | 370 | 1113 | 594 | 1.0e−57 |

| Protein name | | | | Locus Name | | Acc# |
|---|---|---|---|---|---|---|
| A/G-specific adenine glycosylase homolg yfhQ | | | | pir:A69802 | | A69802 |

Description

| ORF Name | NTID | AAID | NT Length | AA Length | Score | Probability |
|---|---|---|---|---|---|---|
| 24813137_f1_10 | 2008 | 7230 | 156 | 471 | 331 | 7.4e−30 |

| Protein name | | | | Locus Name | | Acc# |
|---|---|---|---|---|---|---|
| single stranded DNA-binding protein | | | | gp:SHU64098 | | U64098 |

Description

*Shewanella hanedai* single stranded DNA-binding protein (ssb) gene, complete cds.

| ORF Name | NTID | AAID | NT Length | AA Length | Score | Probability |
|---|---|---|---|---|---|---|
| 2537767_c2_88 | 2009 | 7231 | 105 | 315 | 76 | 0.0077 |

| Protein name | | | | Locus Name | | Acc# |
|---|---|---|---|---|---|---|
| host shut off virion protein | | | | gp:CHDNACSO | | X89471 |

Description

*Canine herpesvirus* DNA for capsid and host shut off virion protein genes.

| ORF Name | NTID | AAID | NT Length | AA Length | Score | Probability |
|---|---|---|---|---|---|---|
| 26303426_c3_102 | 2010 | 7232 | 77 | 234 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 26376260_f2_26 | 2011 | 7233 | 781 | 2346 | | |

| Protein name | | | | Locus Name | | Acc# |
|---|---|---|---|---|---|---|

Description

NO-HIT

-continued

| ORF Name | NTID | AAID | NT Length | AA Length | Score | Probability |
|---|---|---|---|---|---|---|
| 32637_f3_35 | 2012 | 7234 | 262 | 789 | 249 | 3.6e−21 |

| Protein name | Locus Name | Acc# |
|---|---|---|
| rhamnosyl transferase | gp:AF097519 | AF097519 |

Description

*Klebsiella pneumoniae* dTDP-D-glucose 4,6 dehydratase (rmlB), glucose-1-phosphate thymidylyl transferase (rmlA), dTDP-4-keto-L-rhamnose reductase (rmlD), dTDP-4-keto-6-deoxy-D-glucose 3,5-epimerase (rmlC), and rhamnosyltransferase (wbbL) genes, complete cds.

| ORF Name | NTID | AAID | NT Length | AA Length | Score | Probability |
|---|---|---|---|---|---|---|
| 34101512_c2_68 | 2013 | 7235 | 110 | 333 | 172 | 5.2e−13 |

| Protein name | Locus Name | Acc# |
|---|---|---|
| conserved hypothetical protein | pir:G75347 | G75347 |

Description

| ORF Name | NTID | AAID | NT Length | AA Length | Score | Probability |
|---|---|---|---|---|---|---|
| 4023377_f1_2 | 2014 | 7236 | 318 | 957 | 79 | 0.023 |

| Protein name | Locus Name | Acc# |
|---|---|---|
| ribosomal protein S10 | gp:U17009 | U17009 |

Description

*Phytophthora infestans* mitochondrion, complete genome.

| ORF Name | NTID | AAID | NT Length | AA Length | Score | Probability |
|---|---|---|---|---|---|---|
| 4719137_c1_65 | 2015 | 7237 | 61 | 186 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4728313_f2_16 | 2016 | 7238 | 254 | 765 | 348 | 1.2e−31 |

| Protein name | Locus Name | Acc# |
|---|---|---|
| putative glycosyl transferase | gp:AF048749 | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 4875677_f1_9 | 2017 | 7239 | 526 | 1581 | 297 | 1.2e−45 |

| Protein name | Locus Name | Acc# |
|---|---|---|
| | sp:STS_HUMAN | P08842 |

Description

SULFATE SULFOHYDROLASE) (ARYLSULFATASE C) (ASC)

-continued

| ORF Name | NTID | AAID | NT Length | AA Length | Score | Probability |
|---|---|---|---|---|---|---|
| 5273377_f3_33 | 2018 | 7240 | 299 | 900 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 5287507_f1_13 | 2019 | 7241 | 291 | 876 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 582628_c3_92 | 2020 | 7242 | 123 | 372 | 118 | 2.8e−07 |

| Protein name | | | | Locus Name | | Acc# |
|---|---|---|---|---|---|---|
| YjdI-like protein | | | | gp:LLLNISZ | | Y13384 |

Description

*Lactococcus lactis* nisZ gene and 3 ORF's.

| ORF Name | NTID | AAID | NT Length | AA Length | Score | Probability |
|---|---|---|---|---|---|---|
| 6015692_f3_45 | 2021 | 7243 | 68 | 207 | 86 | 0.011 |

| Protein name | | | | Locus Name | | Acc# |
|---|---|---|---|---|---|---|
| cryptogene protein G4 | | | | pir:S51910 | | S51910 |

Description

| ORF Name | NTID | AAID | NT Length | AA Length | Score | Probability |
|---|---|---|---|---|---|---|
| 7240938_c1_63 | 2022 | 7244 | 527 | 1584 | 631 | 5.5e−76 |

| Protein name | | | | Locus Name | | Acct# |
|---|---|---|---|---|---|---|
| | | | | sp:CAFA_HAEIN | | P45175 |

Description

CYTOPLASMIC AXIAL FILAMENT PROTEIN

| ORF Name | NTID | AAID | NT Length | AA Length | Score | Probability |
|---|---|---|---|---|---|---|
| 9954652_f3_34 | 2023 | 7245 | 207 | 624 | 424 | 1.0e−39 |

| Protein name | | | | Locus Name | | Acc# |
|---|---|---|---|---|---|---|
| | | | | sp:WBBJ_ECOLI | | |

Description (EC 2.3.1.—)

-continued

| ORF Name | NTID | AAID | NT Length | AA Length | Score | Probability |
|---|---|---|---|---|---|---|
| 10558252_f2_8 | 2024 | 7246 | 335 | 1008 | 88 | 0.0017 |

| Protein name | Locus Name | Acct# |
|---|---|---|
| transposase | gp:AF038866 | AF038866 |

Description

*Bacteroides fragilis* transposon Tn5520 transposase (bipH) and mobilization protein BmpH (bmpH) genes, complete cds.

| ORF Name | NTID | AAID | NT Length | AA Length | Score | Probability |
|---|---|---|---|---|---|---|
| 12351376_f2_7 | 2025 | 7247 | 529 | 1590 | 1357 | 1.4e−138 |

| Protein name | Locus Name | Acct# |
|---|---|---|
| unknown | gp:AF125164 | AF125164 |

Description

*Bacteroides fragilis* 638R polysaccharide B (PS B2) biosynthesislocus, complete sequence; and unknown genes.

| ORF Name | NTID | AAID | NT Length | AA Length | Score | Probability |
|---|---|---|---|---|---|---|
| 16102032_f2_6 | 2026 | 7248 | 68 | 207 | | |

| Protein name | Locus Name | Acct# |
|---|---|---|

Description

NO-HIT

| ORF Name | NTID | AAID | NT Length | AA Length | Score | Probability |
|---|---|---|---|---|---|---|
| 25962692_c3_33 | 2027 | 7249 | 104 | 315 | | |

| Protein name | Locus Name | Acct# |
|---|---|---|

Description

NO-HIT

| ORF Name | NTID | AAID | NT Length | AA Length | Score | Probability |
|---|---|---|---|---|---|---|
| 31770636_f2_4 | 2028 | 7250 | 305 | 918 | 95 | 0.013 |

| Protein name | Locus Name | Acct# |
|---|---|---|
|  | gp:AB021078 | AB021078 |

Description plasmid ColIb-P9 DNA, complete sequence.

| ORF Name | NTID | AAID | NT Length | AA Length | Score | Probability |
|---|---|---|---|---|---|---|
| 7089527_f3_11 | 2029 | 7251 | 74 | 225 | | |

| Protein name | Locus Name | Acct# |
|---|---|---|

Description

NO-HIT

-continued

| ORF Name | NTID | AAID | NT Length | AA Length | Score | Probability |
|---|---|---|---|---|---|---|
| 196952_f3_10 | 2030 | 7252 | 509 | 1530 | | |

| Protein name | | | Locus Name | | Acct# | |
|---|---|---|---|---|---|---|

Description

NO-HIT

| ORF Name | NTID | AAID | NT Length | AA Length | Score | Probability |
|---|---|---|---|---|---|---|
| 203177_f1_3 | 2031 | 7253 | 362 | 1089 | | |

| Protein name | | | Locus Name | | Acct# | |
|---|---|---|---|---|---|---|

Description

NO-HIT

| ORF Name | NTID | AAID | NT Length | AA Length | Score | Probability |
|---|---|---|---|---|---|---|
| 23633438_c3_38 | 2032 | 7254 | 67 | 204 | | |

| Protein name | | | Locus Name | | Acct# | |
|---|---|---|---|---|---|---|

Description

NO-HIT

| ORF Name | NTID | AAID | NT Length | AA Length | Score | Probability |
|---|---|---|---|---|---|---|
| 23635900_f2_6 | 2033 | 7255 | 344 | 1035 | | |

| Protein name | | | Locus Name | | Acct# | |
|---|---|---|---|---|---|---|

Description

NO-HIT

| ORF Name | NTID | AAID | NT Length | AA Length | Score | Probability |
|---|---|---|---|---|---|---|
| 24649063_f1_2 | 2034 | 7256 | 345 | 1038 | | |

| Protein name | | | Locus Name | | Acct# | |
|---|---|---|---|---|---|---|

Description

NO-HIT

| ORF Name | NTID | AAID | NT Length | AA Length | Score | Probability |
|---|---|---|---|---|---|---|
| 35632826_f2_7 | 2035 | 7257 | 227 | 684 | | |

| Protein name | | | Locus Name | | Acct# | |
|---|---|---|---|---|---|---|

Description

NO-HIT

-continued

| ORF Name | NTID | AAID | NT Length | AA Length | Score | Probability |
|---|---|---|---|---|---|---|
| 45317951_f2_5 | 2036 | 7258 | 646 | 1941 | 233 | 4.5e–18 |
| Protein name | | | Locus Name | | Acct# | |
| receptor antigen (RagA) | | | gp:PGI130872 | | AJ130872 | |

Description

*Porphyromonas gingivalis* W50 receptor antigen (rag) locus encoding a major immunodominant 55 kDa antigen.

| ORF Name | NTID | AAID | NT Length | AA Length | Score | Probability |
|---|---|---|---|---|---|---|
| 7275081_f1_1 | 2037 | 7259 | 246 | 741 | 157 | 4.8e–16 |
| Protein name | | | Locus Name | | Acct# | |
| 115 K outer membrane protein precursor:SusC protein | | | pir:JC6027 | | JC6027 | |

Description

| ORF Name | NTID | AAID | NT Length | AA Length | Score | Probability |
|---|---|---|---|---|---|---|
| 10552188_c3_304 | 2038 | 7260 | 170 | 513 | 158 | 5.9e–14 |
| Protein name | | | Locus Name | | Acct# | |
| glucosamine--fructose-6-phosphate aminotransferase PAB2201 | | | pir:F75212 | | F75212 | |

Description

| ORF Name | NTID | AAID | NT Length | AA Length | Score | Probability |
|---|---|---|---|---|---|---|
| 10735812_f1_17 | 2039 | 7261 | 112 | 339 | 154 | 4.4e–10 |
| Protein name | | | Locus Name | | Acct# | |
| | | | sp:ASNB_*ECOLI* | | P22106 | |

Description

| ORF Name | NTID | AAID | NT Length | AA Length | Score | Probability |
|---|---|---|---|---|---|---|
| 10744013_c1_192 | 2040 | 7262 | 189 | 570 | 114 | 3.0e–05 |
| Protein name | | | Locus Name | | Acct# | |
| hypothetical protein Rv1624c | | | pir:F70558 | | F70558 | |

Description

| ORF Name | NTID | AAID | NT Length | AA Length | Score | Probability |
|---|---|---|---|---|---|---|
| 10991288_f1_36 | 2041 | 7263 | 220 | 663 | 291 | 1.3e–25 |
| Protein name | | | Locus Name | | Acct# | |
| | | | sp:TRPF_*THEMA* | | Q56320 | |

Description

N-(5'-PHOSPHORIBOSYL)ANTHRANILATE ISOMERASE, (PRAI)

-continued

| ORF Name | NTID | AAID | NT Length | AA Length | Score | Probability |
|---|---|---|---|---|---|---|
| 11879400_c2_208 | 2042 | 7264 | 774 | 2325 | 243 | 6.9e−17 |

| Protein name | Locus Name | Acct# |
|---|---|---|
| | sp:CIRA_ECOLI | P17315 |

Description

COLICIN I RECEPTOR PRECURSOR

| ORF Name | NTID | AAID | NT Length | AA Length | Score | Probability |
|---|---|---|---|---|---|---|
| 12125931_f3_144 | 2043 | 7265 | 214 | 645 | 220 | 4.3e−18 |

| Protein name | Locus Name | Acct# |
|---|---|---|
| 2,3,4,5-tetrahydropyridine-2-carboxylate N-succinyltransferase-related protein | pir:H72245 | H72245 |

Description

| ORF Name | NTID | AAID | NT Length | AA Length | Score | Probability |
|---|---|---|---|---|---|---|
| 12213186_f3_148 | 2044 | 7266 | 210 | 633 | 336 | 2.2e−30 |

| Protein name | Locus Name | Acct# |
|---|---|---|
| flavodoxin | pir:H71850 | H71850 |

Description

| ORF Name | NTID | AAID | NT Length | AA Length | Score | Probability |
|---|---|---|---|---|---|---|
| 1228787_f3_136 | 2045 | 7267 | 486 | 1461 | 718 | 7.2e−71 |

| Protein name | Locus Name | Acct# |
|---|---|---|
| anthranilate synthase, component I | pir:D72414 | |

Description

| ORF Name | NTID | AAID | NT Length | AA Length | Score | Probability |
|---|---|---|---|---|---|---|
| 12988762_f3_145 | 2046 | 7268 | 69 | 210 | 82 | 0.026 |

| Protein name | Locus Name | Acct# |
|---|---|---|
| | sp:NU5M_PETMA | Q35543 |

Description

NADH-UBIQUINONE OXIDOREDUCTASE CHAIN 5,

| ORF Name | NTID | AAID | NT Length | AA Length | Score | Probability |
|---|---|---|---|---|---|---|
| 14336463_c2_209 | 2047 | 7269 | 340 | 1023 | 332 | 6.1e−45 |

| Protein name | Locus Name | Acct# |
|---|---|---|
| hypothetical protein | pir:D72115 | D72115 |

Description

-continued

| ORF Name | NTID | AAID | NT Length | AA Length | Score | Probability |
|---|---|---|---|---|---|---|
| 14354642_f1_8 | 2048 | 7270 | 449 | 1350 | | |

| Protein name | | | | Locus Name | | Acct# |
|---|---|---|---|---|---|---|
| | | | | | | |

Description

NO-HIT

| ORF Name | NTID | AAID | NT Length | AA Length | Score | Probability |
|---|---|---|---|---|---|---|
| 14632808_f3_142 | 2049 | 7271 | 813 | 2442 | | |

| Protein name | | | | Locus Name | | Acct# |
|---|---|---|---|---|---|---|
| | | | | | | |

Description

NO-HIT

| ORF Name | NTID | AAID | NT Length | AA Length | Score | Probability |
|---|---|---|---|---|---|---|
| 14726593_f1_24 | 2050 | 7272 | 101 | 306 | 163 | 2.7e−11 |

| Protein name | | | | Locus Name | | Acct# |
|---|---|---|---|---|---|---|
| hypthetical protein | | | | pir:S76339 | | S76639 |

Description

| ORF Name | NTID | AAID | NT Length | AA Length | Score | Probability |
|---|---|---|---|---|---|---|
| 15656537_c3_309 | 2051 | 7273 | 446 | 1341 | 133 | 1.3e−05 |

| Protein name | | | | Locus Name | | Acct# |
|---|---|---|---|---|---|---|
| hypothetical protein aq_1059 | | | | pir:C70391 | | C70391 |

Description

| ORF Name | NTID | AAID | NT Length | AA Length | Score | Probability |
|---|---|---|---|---|---|---|
| 16832885_c3_293 | 2052 | 7274 | 431 | 1296 | 1723 | 2.3e−177 |

| Protein name | | | | Locus Name | | Acct# |
|---|---|---|---|---|---|---|
| hypothetical protein | | | | pir:JQ1020 | | JQ1020 |

Description

| ORF Name | NTID | AAID | NT Length | AA Length | Score | Probability |
|---|---|---|---|---|---|---|
| 182832_c1_203 | 2053 | 7275 | 384 | 1155 | 1034 | 2.4e−104 |

| Protein name | | | | Locus Name | | Acct# |
|---|---|---|---|---|---|---|
| carbamoyl phospate synthetase III | | | | gp:FR24G11 | | Z93780 |

Description

*Fugu rubripes* genes encoding carbamoyl phosphate synthetase III, myosin light chain, MAP2.

| ORF Name | NTID | AAID | NT Length | AA Length | Score | Probability |
|---|---|---|---|---|---|---|
| 19578255_f2_87 | 2054 | 7276 | 231 | 696 | 460 | 1.6e−43 |

| Protein name | | | | Locus Name | | Acct# |
|---|---|---|---|---|---|---|
| | | | | sp:TRPG_THEMA | | Q08654 |

Description

-continued

| ORF Name | NTID | AAID | NT Length | AA Length | Score | Probability |
|---|---|---|---|---|---|---|
| 1964390_f2_83 | 2055 | 7277 | 97 | 294 | 83 | 0.035 |

| Protein name | Locus Name | Acct# |
|---|---|---|
| hypothetical protein HelE | pir:T08605 | T08605 |

Description

| ORF Name | NTID | AAID | NT Length | AA Length | Score | Probability |
|---|---|---|---|---|---|---|
| 19955328_f3_123 | 2056 | 7278 | 498 | 1497 | | |

| Protein name | Locus Name | Acct# |
|---|---|---|

Description

NO-HIT

| ORF Name | NTID | AAID | NT Length | AA Length | Score | Probability |
|---|---|---|---|---|---|---|
| 2111262_f1_37 | 2057 | 7279 | 362 | 1089 | 736 | 8.9e−73 |

| Protein name | Locus Name | Acct# |
|---|---|---|
| | sp:ASG1_ECOLI | P18840 |

Description (L-ASNASE I)

| ORF Name | NTID | AAID | NT Length | AA Length | Score | Probability |
|---|---|---|---|---|---|---|
| 2131327_f1_40 | 2058 | 7280 | 386 | 1161 | 198 | 3.4e−32 |

| Protein name | Locus Name | Acct# |
|---|---|---|
| Cps9F | gp:AF155805 | AF155805 |

Description

*Streptococcus suis* strain 5218 Cps9D (cps9D) gene, partial cds; Cps9E (cps9E), Cps9F (cps9F), and Cps9G (cps9G) genes, complete cds; and Cps9H (cps9H) gene, partial cds.

| ORF Name | NTID | AAID | NT Length | AA Length | Score | Probability |
|---|---|---|---|---|---|---|
| 22033141_c1_162 | 2059 | 7281 | 140 | 423 | | |

| Protein name | Locus Name | Acct# |
|---|---|---|

Description

NO-HIT

| ORF Name | NTID | AAID | NT Length | AA Length | Score | Probability |
|---|---|---|---|---|---|---|
| 22270175_f1_21 | 2060 | 7282 | 300 | 903 | 186 | 1.8e−11 |

| Protein name | Locus Name | Acct# |
|---|---|---|
| receptor antigen (RagA) | gp:PGI130872 | AJ130872 |

Description

*Porphyromonas gingivalis* W50 receptor antigen (rag) locus encoding a major immunodominant 55 kDa antigen.

-continued

| ORF Name | NTID | AAID | NT Length | AA Length | Score | Probability |
|---|---|---|---|---|---|---|
| 22304531_f1_31 | 2061 | 7283 | 401 | 1206 | 1218 | 7.5e-124 |
| Protein name | | | | Locus Name | | Acct# |
| | | | | sp:TRPB_THEMA | | P50909 |

Description

TRYPTOPHAN SYNTHASE BETA CHAIN,

| ORF Name | NTID | AAID | NT Length | AA Length | Score | Probability |
|---|---|---|---|---|---|---|
| 22460027_f3_151 | 2062 | 7284 | 90 | 273 | | |
| Protein name | | | | Locus Name | | Acct# |

Description

NO-HIT

| ORF Name | NTID | AAID | NT Length | AA Length | Score | Probability |
|---|---|---|---|---|---|---|
| 22860128_c1_190 | 2063 | 7285 | 83 | 252 | 64 | 0.031 |
| Protein name | | | | Locus Name | | Acct# |
| | | | | sp:SPRC_XENLA | | P36378 |

Description (OSTEONECTIN) (ON) (BASEMENT MEMBRANE PROTEIN BM-40)

| ORF Name | NTID | AAID | NT Length | AA Length | Score | Probability |
|---|---|---|---|---|---|---|
| 23600812_c1_169 | 2064 | 7286 | 104 | 315 | | |
| Protein name | | | | Locus Name | | Acct# |

Description

NO-HIT

| ORF Name | NTID | AAID | NT Length | AA Length | Score | Probability |
|---|---|---|---|---|---|---|
| 23650256_c3_289 | 2065 | 7287 | 382 | 1149 | 971 | 1.1e-97 |
| Protein name | | | | Locus Name | | Acct# |
| | | | | sp:YQHD_ECOLI | | Q46856 |

Description

HYPOTHETICAL OXIDOREDUCTASE IN METC-SUFI INTERGENIC REGION

| ORF Name | NTID | AAID | NT Length | AA Length | Score | Probability |
|---|---|---|---|---|---|---|
| 23851532_c1_204 | 2066 | 7288 | 1084 | 3255 | 3165 | 0.0 |
| Protein name | | | | Locus Name | | Acct# |
| | | | | sp:PYR1_DICDI | | P20054 |

Description

-continued

| ORF Name | NTID | AAID | NT Length | AA Length | Score | Probability |
|---|---|---|---|---|---|---|
| 24022162_f3_147 | 2067 | 7289 | 395 | 1188 | 1161 | 8.2e−118 |

| Protein name | Locus Name | Acct# |
|---|---|---|
| | sp:PU91_YEAST | P54113 |

Description

| ORF Name | NTID | AAID | NT Length | AA Length | Score | Probability |
|---|---|---|---|---|---|---|
| 24026537_f1_23 | 2068 | 7290 | 313 | 942 | 962 | 1.0e−96 |

| Protein name | Locus Name | Acct# |
|---|---|---|
| aspartate aminotransferase related protein | pir:E69168 | E69168 |

Description

| ORF Name | NTID | AAID | NT Length | AA Length | Score | Probability |
|---|---|---|---|---|---|---|
| 24081580_f3_121 | 2069 | 7291 | 505 | 1518 | 1698 | 1.0e−174 |

| Protein name | Locus Name | Acct# |
|---|---|---|
| | gp:AB025342 | AB025342 |

Description

*Moritella marina* genes, complete cds, similar to eicosapentaenoicacid synthesis gene cluster.

| ORF Name | NTID | AAID | NT Length | AA Length | Score | Probability |
|---|---|---|---|---|---|---|
| 24267843_f2_81 | 2070 | 7292 | 284 | 855 | 244 | 1.2e−20 |

| Protein name | Locus Name | Acct# |
|---|---|---|
| exopolyphosphatase | pir:E70376 | E70376 |

Description

| ORF Name | NTID | AAID | NT Length | AA Length | Score | Probability |
|---|---|---|---|---|---|---|
| 24317552_f3_143 | 2071 | 7293 | 331 | 996 | | |

| Protein name | Locus Name | Acct# |
|---|---|---|
| | | |

Description

NO-HIT

| ORF Name | NTID | AAID | NT Length | AA Length | Score | Probability |
|---|---|---|---|---|---|---|
| 24429187_f3_152 | 2072 | 7294 | 165 | 498 | 324 | 4.1e−29 |

| Protein name | Locus Name | Acct# |
|---|---|---|
| | sp:THIO_BORBU | O51088 |

Description

THIOREDOXIN (TRX)

-continued

| ORF Name | NTID | AAID | NT Length | AA Length | Score | Probability |
|---|---|---|---|---|---|---|
| 24486082_f1_35 | 2073 | 7295 | 281 | 846 | 436 | 5.5e−41 |

| Protein name | Locus Name | Acct# |
|---|---|---|
| | sp:TRPC_PSEPU | P20578 |

Description

INDOLE-3-GLYCEROL PHOSPHATE SYNTHASE, (IGPS)

| ORF Name | NTID | AAID | NT Length | AA Length | Score | Probability |
|---|---|---|---|---|---|---|
| 245927_c1_173 | 2074 | 7296 | 238 | 717 | | |

| Protein name | Locus Name | Acct# |
|---|---|---|

Description

NO-HIT

| ORF Name | NTID | AAID | NT Length | AA Length | Score | Probability |
|---|---|---|---|---|---|---|
| 24641962_f3_140 | 2075 | 7297 | 265 | 798 | 407 | 6.5e−38 |

| Protein name | Locus Name | Acct# |
|---|---|---|
| | sp:TRPA_METVO | P14637 |

Description

TRYPTOPHAN SYNTHASE ALPHA CHAIN,

| ORF Name | NTID | AAID | NT Length | AA Length | Score | Probability |
|---|---|---|---|---|---|---|
| 24645650_c2_265 | 2076 | 7298 | 388 | 1167 | | |

| Protein name | Locus Name | Acct# |
|---|---|---|

Description

NO-HIT

| ORF Name | NTID | AAID | NT Length | AA Length | Score | Probability |
|---|---|---|---|---|---|---|
| 26820202_f3_131 | 2077 | 7299 | 73 | 222 | | |

| Protein name | Locus Name | Acct# |
|---|---|---|

Description

NO-HIT

| ORF Name | NTID | AAID | NT Length | AA Length | Score | Probability |
|---|---|---|---|---|---|---|
| 2744752_f2_71 | 2078 | 7300 | 269 | 810 | 148 | 8.9e−09 |

| Protein name | Locus Name | Acct# |
|---|---|---|
| probable glycerophosphoryl diester phosphodiesterase | pir:G75506 | G75506 |

Description

-continued

| ORF Name | NTID | AAID | NT Length | AA Length | Score | Probability |
|---|---|---|---|---|---|---|
| 2914202_c3_305 | 2079 | 7301 | 627 | 1884 | 151 | 1.2e−23 |

| Protein name | Locus Name | Acct# |
|---|---|---|
| | sp:PUR1_HAEIN | P43854 |

Description

PHOSPHORIBOSYLPYROPHOSPHATE AMIDOTRANSFERASE) (ATASE) (GPATASE)

| ORF Name | NTID | AAID | NT Length | AA Length | Score | Probability |
|---|---|---|---|---|---|---|
| 2926562_f2_99 | 2080 | 7302 | 352 | 1059 | 221 | 5.2e−18 |

| Protein name | Locus Name | Acct# |
|---|---|---|
| subunit of the terminal oxidase with unknown | gp:AADOXP24H | Y08730 |

Description

*A. ambivalens* doxA gene locus with doxD and doxA genes.

| ORF Name | NTID | AAID | NT Length | AA Length | Score | Probability |
|---|---|---|---|---|---|---|
| 2947687_c2_263 | 2081 | 7303 | 119 | 360 | 152 | 6.9e−11 |

| Protein name | Locus Name | Acct# |
|---|---|---|
| probable thioredoxin | pir: T08271 | |

Description

| ORF Name | NTID | AAID | NT Length | AA Length | Score | Probability |
|---|---|---|---|---|---|---|
| 31672007_f3_130 | 2082 | 7304 | 692 | 2079 | 1338 | 1.4e−136 |

| Protein name | Locus Name | Acct# |
|---|---|---|
| polyphosphate kinase | gp:AF03928 | AF083928 |

Description

*Vibrio cholerae* polyphosphate kinase (ppk) and exopolyphosphatase (ppx) genes, complete cds.

| ORF Name | NTID | AAID | NT Length | AA Length | Score | Probability |
|---|---|---|---|---|---|---|
| 31750887_c3_285 | 2083 | 7305 | 75 | 228 | 101 | 1.7e−05 |

| Protein name | Locus Name | Acct# |
|---|---|---|
| hypothetical protein APE2554 | pir:C72489 | C72489 |

Description

| ORF Name | NTID | AAID | NT Length | AA Length | Score | Probability |
|---|---|---|---|---|---|---|
| 32440650_c2_243 | 2084 | 7306 | 547 | 1644 | 79 | 0.0024 |

| Protein name | Locus Name | Acct# |
|---|---|---|
| | gp:CELB0454 | AF025452 |

Description

*Caenorhabditis elegans* cosmid B0454.

-continued

| ORF Name | NTID | AAID | NT Length | AA Length | Score | Probability |
|---|---|---|---|---|---|---|
| 32458331_f3_137 | 2085 | 7307 | 342 | 1029 | 541 | 4.1e−52 |

| Protein name | Locus Name | Acct# |
|---|---|---|
| | sp:TRPD_METJA | Q57686 |

Description

ANTHRANILATE PHOSPHORIBOSYLTRANSFERASE,

| ORF Name | NTID | AAID | NT Length | AA Length | Score | Probability |
|---|---|---|---|---|---|---|
| 33398412_c2_266 | 2086 | 7308 | 151 | 453 | 109 | 4.1e−05 |

| Protein name | Locus Name | Acct# |
|---|---|---|
| immunoreactive 36 kDa antigen PG14 | gp:AF145798 | AF145798 |

Description

*Porphyromonas gingivalis* strain W50 immunoreactive 36 kDa antigen PG14 gene, complete cds.

| ORF Name | NTID | AAID | NT Length | AA Length | Score | Probability |
|---|---|---|---|---|---|---|
| 3376327_f3_106 | 2087 | 7309 | 64 | 195 | | |

| Protein name | Locus Name | Acct# |
|---|---|---|
| | | |

Description

NO-HIT

| ORF Name | NTID | AAID | NT Length | AA Length | Score | Probability |
|---|---|---|---|---|---|---|
| 34017302_f3_126 | 2088 | 7310 | 303 | 912 | 550 | 4.6e−53 |

| Protein name | Locus Name | Acct# |
|---|---|---|
| | sp:DAPF_SYNY3 | P74667 |

Description

DIAMINOPIMELATE EPIMERASE, (DAP EPIMERASE)

| ORF Name | NTID | AAID | NT Length | AA Length | Score | Probability |
|---|---|---|---|---|---|---|
| 34235700_f3_129 | 2089 | 7311 | 60 | 183 | | |

| Protein name | Locus Name | Acct# |
|---|---|---|
| | | |

Description

NO-HIT

| ORF Name | NTID | AAID | NT Length | AA Length | Score | Probability |
|---|---|---|---|---|---|---|
| 35345063_f3_161 | 2090 | 7312 | 66 | 201 | | |

| Protein name | Locus Name | Acct# |
|---|---|---|
| | | |

Description

NO-HIT

| ORF Name | NTID | AAID | NT Length | AA Length | Score | Probability |
|---|---|---|---|---|---|---|
| 35392907_f2_75 | 2091 | 7313 | 92 | 279 | 258 | 7.2e−22 |
| Protein name | | | | Locus Name | | Acct# |
| aspartate aminotransferase related protein | | | | pir:E69168 | | E69168 |

Description

| ORF Name | NTID | AAID | NT Length | AA Length | Score | Probability |
|---|---|---|---|---|---|---|
| 36136262_c2_216 | 2092 | 7314 | 210 | 633 | 136 | 5.5e−12 |
| Protein name | | | | Locus Name | | Acct# |
| probable response regulator | | | | pir:T34675 | | T34675 |

Description

| ORF Name | NTID | AAID | NT Length | AA Length | Score | Probability |
|---|---|---|---|---|---|---|
| 4082762_c1_165 | 2093 | 7315 | 378 | 1137 | 474 | 5.2e−45 |
| Protein name | | | | Locus Name | | Acct# |
| | | | | sp:MAUG_PARDE | | Q51658 |

Description

METHYLAMINE UTILIZATION PROTEIN MAUG PRECURSOR

| ORF Name | NTID | AAID | NT Length | AA Length | Score | Probability |
|---|---|---|---|---|---|---|
| 4379433_f1_39 | 2094 | 7316 | 143 | 432 | 203 | 5.7e−15 |
| Protein name | | | | Locus Name | | Acct# |
| bZIP histidine kinase | | | | gp:PPUY18245 | | Y18245 |

Description

*Pseudomonas putida* todX, todF, todC1, todC2, todB, todA, todD, todE, todG, todI, todH, todS, todT genes.

| ORF Name | NTID | AAID | NT Length | AA Length | Score | Probability |
|---|---|---|---|---|---|---|
| 6057812_f1_43 | 2095 | 7317 | 134 | 405 | | |
| Protein name | | | | Locus Name | | Acct# |

Description

NO-HIT

| ORF Name | NTID | AAID | NT Length | AA Length | Score | Probability |
|---|---|---|---|---|---|---|
| 806512_f1_5 | 2096 | 7318 | 321 | 966 | 194 | 1.2e−13 |
| Protein name | | | | Locus Name | | Acct# |
| PobR protein | | | | gp:PPU251792 | | AJ251792 |

Description

*Pseudomonas putida* pobR gene for PobR protein and pobA gene for PobA protein.

-continued

| ORF Name | NTID | AAID | NT Length | AA Length | Score | Probability |
|---|---|---|---|---|---|---|
| 11816716_c3_86 | 2097 | 7319 | 78 | 237 | 119 | 2.8e−07 |

| Protein name | | | | Locus Name | | Acct# |
|---|---|---|---|---|---|---|
| | | | | gp:D90701 | | |

Description

*Escherichia coli* genomic DNA. (13.6–14.0 min).

| ORF Name | NTID | AAID | NT Length | AA Length | Score | Probability |
|---|---|---|---|---|---|---|
| 16051540_c1_63 | 2098 | 7320 | 122 | 369 | | |

| Protein name | | | | Locus Name | | Acct# |

Description

NO-HIT

| ORF Name | NTID | AAID | NT Length | AA Length | Score | Probability |
|---|---|---|---|---|---|---|
| 20203951_c1_55 | 2099 | 7321 | 90 | 273 | | |

| Protein name | | | | Locus Name | | Acct# |

Description

NO-HIT

| ORF Name | NTID | AAID | NT Length | AA Length | Score | Probability |
|---|---|---|---|---|---|---|
| 20895303_f1_11 | 2100 | 7322 | 1045 | 3138 | | |

| Protein name | | | | Locus Name | | Acct# |

Description

NO-HIT

| ORF Name | NTID | AAID | NT Length | AA Length | Score | Probability |
|---|---|---|---|---|---|---|
| 22687817_c3_100 | 2101 | 7323 | 126 | 381 | | |

| Protein name | | | | Locus Name | | Acct# |

Description

NO-HIT

| ORF Name | NTID | AAID | NT Length | AA Length | Score | Probability |
|---|---|---|---|---|---|---|
| 24335781_f2_25 | 2102 | 7324 | 140 | 423 | 77 | 0.0064 |

| Protein name | | | | Locus Name | | Acct# |
|---|---|---|---|---|---|---|
| | | | | sp:NOLP_RHILP | | P23717 |

Description

NODULATION PROTEIN NOLP

-continued

| ORF Name | NTID | AAID | NT Length | AA Length | Score | Probability |
|---|---|---|---|---|---|---|
| 24727127_c3_102 | 2103 | 7325 | 155 | 468 | 243 | 2.1e−20 |

| Protein name | Locus Name | Acct# |
|---|---|---|
| putative oxygen-independent coproporphyrinogen | gp:AF157642 | AF157642 |

Description

*Desulfitobacterium dehalogenans* putative oxygen-independent coproporphyrinogen III oxidase (hemN) gene, partial cds; Hrd22-1 (hrd22-1) gene, complete cds; and two-component sensor histidinekinase homolog (hkhB) gene, partial cds.

| ORF Name | NTID | AAID | NT Length | AA Length | Score | Probability |
|---|---|---|---|---|---|---|
| 25494062_c3_99 | 2104 | 7326 | 84 | 255 | | |

| Protein name | Locus Name | Acct# |
|---|---|---|

Description

NO-HIT

| ORF Name | NTID | AAID | NT Length | AA Length | Score | Probability |
|---|---|---|---|---|---|---|
| 26594127_f3_40 | 2105 | 7327 | 536 | 1611 | 2764 | 1.1e−287 |

| Protein name | Locus Name | Acct# |
|---|---|---|
| mobilization protein C | gp:AF118243 | AF118243 |

Description

*Bacteroides fragilis* mobilization protein C (mobC) gene, complete cds.

| ORF Name | NTID | AAID | NT Length | AA Length | Score | Probability |
|---|---|---|---|---|---|---|
| 26602175_c1_62 | 2106 | 7328 | 229 | 690 | 171 | 6.7e−13 |

| Protein name | Locus Name | Acct# |
|---|---|---|
| RNA polymerase sigma factor SigZ-like protein | gp:AF137263 | AF137263 |

Description

*Bacteroides thetaiotaomicron* 30S ribosomal protein S16-like protein, fucose gene cluster, and RNA polymerase sigma factor SigZ-like protein (sigZ) genes, complete cds.

| ORF Name | NTID | AAID | NT Length | AA Length | Score | Probability |
|---|---|---|---|---|---|---|
| 33708427_c1_43 | 2107 | 7329 | 157 | 474 | | |

| Protein name | Locus Name | Acct# |
|---|---|---|

Description

NO-HIT

| ORF Name | NTID | AAID | NT Length | AA Length | Score | Probability |
|---|---|---|---|---|---|---|
| 34412578_f1_1 | 2108 | 7330 | 102 | 309 | | |

| Protein name | Locus Name | Acct# |
|---|---|---|

Description

NO-HIT

| ORF Name | NTID | AAID | NT Length | AA Length | Score | Probability |
|---|---|---|---|---|---|---|
| 36367837_c1_44 | 2109 | 7331 | 423 | 1272 | 531 | 4.0e−55 |

| Protein name | Locus Name | Acct# |
|---|---|---|
|  | sp:YBDN_ECOLI | P77216 |

Description

HYPOTHETICAL 47.8 KD PROTEIN IN CSTA-DSBG INTERGENIC REGION

| ORF Name | NTID | AAID | NT Length | AA Length | Score | Probability |
|---|---|---|---|---|---|---|
| 4032950_f1_3 | 2110 | 7332 | 296 | 891 |  |  |

| Protein name | Locus Name | Acct# |
|---|---|---|

Description

NO-HIT

| ORF Name | NTID | AAID | NT Length | AA Length | Score | Probability |
|---|---|---|---|---|---|---|
| 4103377_f2_28 | 2111 | 7333 | 118 | 357 |  |  |

| Protein name | Locus Name | Acct# |
|---|---|---|

Description

NO-HIT

| ORF Name | NTID | AAID | NT Length | AA Length | Score | Probability |
|---|---|---|---|---|---|---|
| 4180181_c2_68 | 2112 | 7334 | 126 | 381 | 265 | 7.3e−23 |

| Protein name | Locus Name | Acct# |
|---|---|---|
| unknown | gp:AF118244 | AF118244 |

Description

*Bacteroides fragilis* unknown gene.

| ORF Name | NTID | AAID | NT Length | AA Length | Score | Probability |
|---|---|---|---|---|---|---|
| 4406908_c1_46 | 2113 | 7335 | 69 | 210 | 199 | 7.2e−16 |

| Protein name | Locus Name | Acct# |
|---|---|---|
|  | sp:YBDM_ECOLI | P77174 |

Description

HYPOTHETICAL 23.9 KD PROTEIN IN CSTA-DSBG INTERGENIC REGION

| ORF Name | NTID | AAID | NT Length | AA Length | Score | Probability |
|---|---|---|---|---|---|---|
| 4486052_f1_2 | 2114 | 7336 | 69 | 210 |  |  |

| Protein name | Locus Name | Acct# |
|---|---|---|

Description

NO-HIT

-continued

| ORF Name | NTID | AAID | NT Length | AA Length | Score | Probability |
|---|---|---|---|---|---|---|
| 6287687_f1_10 | 2115 | 7337 | 439 | 1320 | 130 | 3.1e−05 |

| Protein name | Locus Name | Acct# |
|---|---|---|
| M protein | gp:SSGEMM | X60098 |

Description

*Streptococcus* sp. (group G) emm gene or M protein.

| ORF Name | NTID | AAID | NT Length | AA Length | Score | Probability |
|---|---|---|---|---|---|---|
| 6522533_c2_81 | 2116 | 7338 | 213 | 642 | 120 | 4.3e−05 |

| Protein name | Locus Name | Acct# |
|---|---|---|
| probable transposase for IS1558 | pir:F70678 | F70678 |

Description

| ORF Name | NTID | AAID | NT Length | AA Length | Score | Probability |
|---|---|---|---|---|---|---|
| 9897137_c3_103 | 2117 | 7339 | 102 | 309 | 83 | 0.0087 |

| Protein name | Locus Name | Acct# |
|---|---|---|
| coproporphyrinogen III oxidase | gp:BSHRCA | Y09446 |

Description

*B. stearothermophilus* hemN gene (partial) and hrcA gene.

| ORF Name | NTID | AAID | NT Length | AA Length | Score | Probability |
|---|---|---|---|---|---|---|
| 14463305_c3_24 | 2118 | 7340 | 520 | 1563 | 1215 | 1.6e−123 |

| Protein name | Locus Name | Acct# |
|---|---|---|
| 50 kD antigen PG1 | gp: AF144076 | AF144076 |

Description

*Porphyromonas gingivalis* strain W50 50 kD antigen PG1 gene, complete cds.

| ORF Name | NTID | AAID | NT Length | AA Length | Score | Probability |
|---|---|---|---|---|---|---|
| 16603425_c1_18 | 2119 | 7341 | 361 | 1083 | 558 | 1.7e−68 |

| Protein name | Locus Name | Acct# |
|---|---|---|
| NqrB | gp:AF165980 | AF165980 |

Description

*Vibrio harveyi* Na+-translocating NADH-quinone oxidoreductase complex operon, complete sequence.

| ORF Name | NTID | AAID | NT Length | AA Length | Score | Probability |
|---|---|---|---|---|---|---|
| 19775252_f2_8 | 2120 | 7342 | 432 | 1299 | | |

| Protein name | Locus Name | Acct# |
|---|---|---|
| | | |

Description

NO-HIT

| ORF Name | NTID | AAID | NT Length | AA Length | Score | Probability |
|---|---|---|---|---|---|---|
| 30728302_c3_23 | 2121 | 7343 | 355 | 1068 | 707 | 1.1e−69 |

| Protein name | | Locus Name | Acct# |
|---|---|---|---|
| | | sp:BLMH_RAT | P70645 |

Description

BLEOMYCIN HYDROLASE, (BLM HYDROLASE) (BMH)

| ORF Name | NTID | AAID | NT Length | AA Length | Score | Probability |
|---|---|---|---|---|---|---|
| 13845052_c3_49 | 2122 | 7344 | 812 | 2439 | 649 | 3.1e−82 |

| Protein name | | Locus Name | Acct# |
|---|---|---|---|
| 115 K outer membrane protein precursor:SusC protein | | pir:JC6027 | JC6027 |

Description

| ORF Name | NTID | AAID | NT Length | AA Length | Score | Probability |
|---|---|---|---|---|---|---|
| 1953386_f3_23 | 2123 | 7345 | 148 | 447 | | |

| Protein name | | Locus Name | Acct# |
|---|---|---|---|

Description

NO-HIT

| ORF Name | NTID | AAID | NT Length | AA Length | Score | Probability |
|---|---|---|---|---|---|---|
| 19553528_c1_32 | 2124 | 7346 | 101 | 306 | 99 | 2.8e−05 |

| Protein name | | Locus Name | Acct# |
|---|---|---|---|
| | | sp:Y660_HAEIN | P44031 |

Description

HYPOTHETICAL PROTEIN HI0660

| ORF Name | NTID | AAID | NT Length | AA Length | Score | Probability |
|---|---|---|---|---|---|---|
| 21988900_f2_17 | 2125 | 7347 | 316 | 951 | | |

| Protein name | | Locus Name | Acct# |
|---|---|---|---|

Description

NO-HIT

| ORF Name | NTID | AAID | NT Length | AA Length | Score | Probability |
|---|---|---|---|---|---|---|
| 23492761_f1_6 | 2126 | 7348 | 89 | 270 | | |

| Protein name | | Locus Name | Acct# |
|---|---|---|---|

Description

NO-HIT

-continued

| ORF Name | NTID | AAID | NT Length | AA Length | Score | Probability |
|---|---|---|---|---|---|---|
| 23610933_c1_26 | 2127 | 7349 | 60 | 183 | | |

| Protein name | | | | Locus Name | | Acct# |
|---|---|---|---|---|---|---|
| | | | | | | |

Description

NO-HIT

| ORF Name | NTID | AAID | NT Length | AA Length | Score | Probability |
|---|---|---|---|---|---|---|
| 23643903_f1_3 | 2128 | 7350 | 121 | 366 | | |

| Protein name | | | | Locus Name | | Acct# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24494056_f1_7 | 2129 | 7351 | 498 | 1494 | 481 | 1.1e−44 |

| Protein name | | | | Locus Name | | Acct# |
|---|---|---|---|---|---|---|
| 115 K outer membrane protein precursor:SusC protein | | | | pir:JC6027 | | JC6027 |

Description

| ORF Name | NTID | AAID | NT Length | AA Length | Score | Probability |
|---|---|---|---|---|---|---|
| 24892087_c1_36 | 2130 | 7352 | 332 | 996 | 178 | 2.9e−10 |

| Protein name | | | | Locus Name | | Acc# |
|---|---|---|---|---|---|---|
| receptor antigen (RagA) | | | | gp:PGI130872 | | AJ130872 |

Description

*Porphyromonas gingivalis* W50 receptor antigen (rag) locus encoding a major immunodominant 55 kDa antigen.

| ORF Name | NTID | AAID | NT Length | AA Length | Score | Probability |
|---|---|---|---|---|---|---|
| 29691536_f2_13 | 2131 | 7353 | 89 | 270 | | |

| Protein name | | | | Locus Name | | Acct# |
|---|---|---|---|---|---|---|
| | | | | | | |

Description

NO-HIT

| ORF Name | NTID | AAID | NT Length | AA Length | Score | Probability |
|---|---|---|---|---|---|---|
| 31414132_c2_41 | 2132 | 7354 | 68 | 207 | | |

| Protein name | | | | Locus Name | | Acct# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 7245312_c3_47 | 2133 | 7355 | 101 | 306 | 101 | 1.7e−05 |

| Protein name | Locus Name | Acct# |
|---|---|---|
| putative transcriptional regulator | gp:YPPCP1 | AL109969 |

Description

*Yersinia pestis* plasmid pPCP1.

| ORF Name | NTID | AAID | NT Length | AA Length | Score | Probability |
|---|---|---|---|---|---|---|
| 1360802_f3_34 | 2134 | 7356 | 373 | 1122 | | |

| Protein name | Locus Name | Acct# |
|---|---|---|
| | | |

Description

NO-HIT

| ORF Name | NTID | AAID | NT Length | AA Length | Score | Probability |
|---|---|---|---|---|---|---|
| 13884652_f3_32 | 2135 | 7357 | 125 | 378 | 259 | 2.2e−21 |

| Protein name | Locus Name | Acct# |
|---|---|---|
| | sp:TRA2_BACFR | Q45119 |

Description

TRANSPOSASE FOR INSERTION SEQUENCE ELEMENT IS21-LIKE

| ORF Name | NTID | AAID | NT Length | AA Length | Score | Probability |
|---|---|---|---|---|---|---|
| 14556510_f3_30 | 2136 | 7358 | 209 | 630 | 396 | 9.6e−37 |

| Protein name | Locus Name | Acct# |
|---|---|---|
| YadS | gp:AF198617 | AF198617 |

Description

*Aeromonas caviae* polar flagella locus, complete sequence.

| ORF Name | NTID | AAID | NT Length | AA Length | Score | Probability |
|---|---|---|---|---|---|---|
| 195337_f3_33 | 2137 | 7359 | 103 | 312 | | |

| Protein name | Locus Name | Acct# |
|---|---|---|
| | | |

Description

NO-HIT

| ORF Name | NTID | AAID | NT Length | AA Length | Score | Probability |
|---|---|---|---|---|---|---|
| 20815912_c2_56 | 2138 | 7360 | 446 | 1341 | 494 | 3.9e−47 |

| Protein name | Locus Name | Acct# |
|---|---|---|
| lipopoysaccharide biosynthesis protein bplD homolog | pir:G64487 | G64487 |

Description

-continued

| ORF Name | NTID | AAID | NT Length | AA Length | Score | Probability |
|---|---|---|---|---|---|---|
| 25422952_f1_12 | 2139 | 7361 | 165 | 498 | | |

| Protein name | | | | Locus Name | | Acct# |
|---|---|---|---|---|---|---|

Description

NO-HIT

| ORF Name | NTID | AAID | NT Length | AA Length | Score | Probability |
|---|---|---|---|---|---|---|
| 26174037_f1_9 | 2140 | 7362 | 88 | 267 | | |

| Protein name | | | | Locus Name | | Acct# |
|---|---|---|---|---|---|---|

Description

NO-HIT

| ORF Name | NTID | AAID | NT Length | AA Length | Score | Probability |
|---|---|---|---|---|---|---|
| 26581625_f3_35 | 2141 | 7363 | 320 | 963 | | |

| Protein name | | | | Locus Name | | Acct# |
|---|---|---|---|---|---|---|

Description

NO-HIT

| ORF Name | NTID | AAID | NT Length | AA Length | Score | Probability |
|---|---|---|---|---|---|---|
| 30523513_c1_47 | 2142 | 7364 | 731 | 2193 | 122 | 0.00035 |

| Protein name | | | | Locus Name | | Acct# |
|---|---|---|---|---|---|---|
| 115 K outer membrane protein precursor:SusC protein | | | | pir:JC6027 | | JC6027 |

Description

| ORF Name | NTID | AAID | NT Length | AA Length | Score | Probability |
|---|---|---|---|---|---|---|
| 4006551_f1_10 | 2143 | 7365 | 110 | 333 | | |

| Protein name | | | | Locus Name | | Acct# |
|---|---|---|---|---|---|---|

Description

NO-HIT

| ORF Name | NTID | AAID | NT Length | AA Length | Score | Probability |
|---|---|---|---|---|---|---|
| 4087502_c1_45 | 2144 | 7366 | 179 | 540 | | |

| Protein name | | | | Locus Name | | Acct# |
|---|---|---|---|---|---|---|

Description

NO-HIT

| ORF Name | NTID | AAID | NT Length | AA Length | Score | Probability |
|---|---|---|---|---|---|---|
| 4100342_f1_8 | 2145 | 7367 | 65 | 198 | | |

| Protein name | | | | Locus Name | | Acct# |
|---|---|---|---|---|---|---|

Description

NO-HIT

-continued

| ORF Name | NTID | AAID | NT Length | AA Length | Score | Probability |
|---|---|---|---|---|---|---|
| 7034587_f2_22 | 2146 | 7368 | 104 | 315 | 81 | 0.0058 |

| Protein name | | | | Locus Name | | Acct# |
|---|---|---|---|---|---|---|
| | | | | sp:ZN90_HUMAN | | Q03938 |

Description

ZINC FINGER PROTEIN 90 (ZINC FINGER PROTEIN HTF9) (FRAGMENT)

| ORF Name | NTID | AAID | NT Length | AA Length | Score | Probability |
|---|---|---|---|---|---|---|
| 16525383_c2_37 | 2147 | 7369 | 119 | 360 | | |

| Protein name | | | | Locus Name | | Acct# |
|---|---|---|---|---|---|---|

Description

NO-HIT

| ORF Name | NTID | AAID | NT Length | AA Length | Score | Probability |
|---|---|---|---|---|---|---|
| 32665833_c1_32 | 2148 | 7370 | 577 | 1731 | 150 | 3.4e−07 |

| Protein name | | | | Locus Name | | Acct# |
|---|---|---|---|---|---|---|
| immunoreactive 53 kD antigen PG123 | | | | gp:AF144641 | | AF144641 |

Description

*Porphyromonas gingivalis* strain W50 immunoreactive 53 kD antigen PG123 gene, complete cds.

| ORF Name | NTID | AAID | NT Length | AA Length | Score | Probability |
|---|---|---|---|---|---|---|
| 36226558_c1_31 | 2149 | 7371 | 118 | 357 | | |

| Protein name | | | | Locus Name | | Acct# |
|---|---|---|---|---|---|---|

Description

NO-HIT

| ORF Name | NTID | AAID | NT Length | AA Length | Score | Probability |
|---|---|---|---|---|---|---|
| 36363967_c2_34 | 2150 | 7372 | 109 | 330 | | |

| Protein name | | | | Locus Name | | Acct# |
|---|---|---|---|---|---|---|

Description

NO-HIT

| ORF Name | NTID | AAID | NT Length | AA Length | Score | Probability |
|---|---|---|---|---|---|---|
| 36525317_c1_28 | 2151 | 7373 | 95 | 288 | | |

| Protein name | | | | Locus Name | | Acct# |
|---|---|---|---|---|---|---|

Description

NO-HIT

-continued

| ORF Name | NTID | AAID | NT Length | AA Length | Score | Probability |
|---|---|---|---|---|---|---|
| 36679717_c2_33 | 2152 | 7374 | 61 | 186 | | |

| Protein name | | | | Locus Name | | Acct# |
|---|---|---|---|---|---|---|

Description

NO-HIT

| ORF Name | NTID | AAID | NT Length | AA Length | Score | Probability |
|---|---|---|---|---|---|---|
| 5332628_c3_42 | 2153 | 7375 | 73 | 222 | | |

| Protein name | | | | Locus Name | | Acct# |
|---|---|---|---|---|---|---|

Description

NO-HIT

| ORF Name | NTID | AAID | NT Length | AA Length | Score | Probability |
|---|---|---|---|---|---|---|
| 6459782_c2_35 | 2154 | 7376 | 138 | 417 | | |

| Protein name | | | | Locus Name | | Acct# |
|---|---|---|---|---|---|---|

Description

NO-HIT

| ORF Name | NTID | AAID | NT Length | AA Length | Score | Probability |
|---|---|---|---|---|---|---|
| 23992175_c3_29 | 2155 | 7377 | 432 | 1296 | | |

| Protein name | | | | Locus Name | | Acct# |
|---|---|---|---|---|---|---|

Description

NO-HIT

| ORF Name | NTID | AAID | NT Length | AA Length | Score | Probability |
|---|---|---|---|---|---|---|
| 24006387_f1_4 | 2156 | 7378 | 763 | 2292 | 613 | 6.0e−59 |

| Protein name | | | | Locus Name | | Acct# |
|---|---|---|---|---|---|---|
| 115 K outer membrane protein precursor:SusC protein | | | | pir:JC6027 | | JC6027 |

Description

| ORF Name | NTID | AAID | NT Length | AA Length | Score | Probability |
|---|---|---|---|---|---|---|
| 24511625_f1_5 | 2157 | 7379 | 70 | 213 | 52 | 0.042 |

| Protein name | | | | Locus Name | | Acct# |
|---|---|---|---|---|---|---|
| heat shock transcription factor HSF21 | | | | pir:S59537 | | |

Description

| ORF Name | NTID | AAID | NT Length | AA Length | Score | Probability |
|---|---|---|---|---|---|---|
| 24666656_f2_6 | 2158 | 7380 | 397 | 1194 | 229 | 1.5e−16 |

| Protein name | Locus Name | Acct# |
|---|---|---|
| dipeptidase homolog | gp:AF060858 | AF060858 |

Description

*Salmonella dublin* regulatory protein CopR (copR), histidine kinase (copS), SPI-4 pathogenicity island containing dipeptidase homolog (pipD), SopB (sopB), PipC (pipC), PipB (pipB), and PipA (pipA) genes, complete cds; and tRNA-Ser gene, complete sequence; and unknown genes.

| ORF Name | NTID | AAID | NT Length | AA Length | Score | Probability |
|---|---|---|---|---|---|---|
| 33412762_f1_2 | 2159 | 7381 | 586 | 1761 | 1163 | 5.0e−118 |

| Protein name | Locus Name | Acct# |
|---|---|---|
| | sp:YHXB_BACSU | P18159 |

Description

PROBABLE PHOSPHOMANNOMUTASE, (PMM)

| ORF Name | NTID | AAID | NT Length | AA Length | Score | Probability |
|---|---|---|---|---|---|---|
| 34119717_f3_12 | 2160 | 7382 | 64 | 195 | | |

| Protein name | Locus Name | Acct# |
|---|---|---|

Description

NO-HIT

| ORF Name | NTID | AAID | NT Length | AA Length | Score | Probability |
|---|---|---|---|---|---|---|
| 3912688_c2_26 | 2161 | 7383 | 81 | 246 | | |

| Protein name | Locus Name | Acct# |
|---|---|---|

Description

NO-HIT

| ORF Name | NTID | AAID | NT Length | AA Length | Score | Probability |
|---|---|---|---|---|---|---|
| 4344035_f3_13 | 2162 | 7384 | 314 | 945 | 135 | 2.4e−06 |

| Protein name | Locus Name | Acct# |
|---|---|---|
| transmembrane sensor | gp:AF051691 | AF051691 |

Description

*Pseudomonas aeruginosa* stress factor A (psfA), ECF sigma factor (fiuI), transmembrane sensor (fiuR), and hydroxamate-typeferrisiderophore receptor (fiuA) genes, complete cds.

| ORF Name | NTID | AAID | NT Length | AA Length | Score | Probability |
|---|---|---|---|---|---|---|
| 4735655_f2_9 | 2163 | 7385 | 195 | 588 | 199 | 7.2e−16 |

| Protein name | Locus Name | Acct# |
|---|---|---|
| RNA polymerase sigma factor SigZ-like protein | gp:AF137263 | AF137263 |

Description

*Bacteroides thetaiotaomicron* 30S ribosomal protein S16-like protein, fucose gene cluster, and RNA polymerase sigma factor SigZ-like protein (sigZ) genes, complete cds.

-continued

| ORF Name | NTID | AAID | NT Length | AA Length | Score | Probability |
|---|---|---|---|---|---|---|
| 3001688_f3_13 | 2164 | 7386 | 629 | 1890 | 1567 | 7.8e−161 |

| Protein name | Locus Name | Acct# |
|---|---|---|
| | sp:PARE_BORBU | Q59189 |

Description

TOPOISOMERASE IV SUBUNIT B,

| ORF Name | NTID | AAID | NT Length | AA Length | Score | Probability |
|---|---|---|---|---|---|---|
| 33361630_f2_9 | 2165 | 7387 | 160 | 483 | 305 | 4.2e−27 |

| Protein name | Locus Name | Acct# |
|---|---|---|
| probable KDO transferase | pir:T35652 | T35652 |

Description

| ORF Name | NTID | AAID | NT Length | AA Length | Score | Probability |
|---|---|---|---|---|---|---|
| 33707761_c3_32 | 2166 | 7388 | 146 | 441 | 131 | 1.2e−08 |

| Protein name | Locus Name | Acct# |
|---|---|---|
| hypothetical protein PH0474 | pir:E71159 | E71159 |

Description

| ORF Name | NTID | AAID | NT Length | AA Length | Score | Probability |
|---|---|---|---|---|---|---|
| 4038927_f1_1 | 2167 | 7389 | 381 | 1146 | 331 | 7.4e−30 |

| Protein name | Locus Name | Acct# |
|---|---|---|
| hypothetical protein b2981 | pir:C65084 | C65084 |

Description

| ORF Name | NTID | AAID | NT Length | AA Length | Score | Probability |
|---|---|---|---|---|---|---|
| 4195250_f3_11 | 2168 | 7390 | 323 | 972 | 627 | 3.2e−61 |

| Protein name | Locus Name | Acct# |
|---|---|---|
| conserved hypothetical protein aq_066 | pir:E70306 | E70306 |

Description

| ORF Name | NTID | AAID | NT Length | AA Length | Score | Probability |
|---|---|---|---|---|---|---|
| 5126407_f2_10 | 2169 | 7391 | 306 | 921 | 409 | 4.0e−38 |

| Protein name | Locus Name | Acct# |
|---|---|---|
| carboxy-terminal processing proteinase ctpA,:tail-specific endopeptidase Prc | pir:B69610 | |

Description

-continued

| ORF Name | NTID | AAID | NT Length | AA Length | Score | Probability |
|---|---|---|---|---|---|---|
| 14664017_c3_5 | 2170 | 7392 | 209 | 627 | 376 | 1.9e−33 |

| Protein name | Locus Name | Acct# |
|---|---|---|
| receptor antigen (RagA) | gp:PGI130872 | AJ130872 |

Description

*Porphyromonas gingivalis* W50 receptor antigen (rag) locus encodinga major immunodominant 55 kDa antigen.

| ORF Name | NTID | AAID | NT Length | AA Length | Score | Probability |
|---|---|---|---|---|---|---|
| 24257800_f2_2 | 2171 | 7393 | 398 | 1197 | 343 | 4.0e−31 |

| Protein name | Locus Name | Acct# |
|---|---|---|
| transposase | gp:AF038866 | AF038866 |

Description

*Bacteroides fragilis* transposon Tn5520 transposase (bipH) and mobilization protein BmpH (bmpH) genes, complete cds.

| ORF Name | NTID | AAID | NT Length | AA Length | Score | Probability |
|---|---|---|---|---|---|---|
| 12687687_f3_16 | 2172 | 7394 | 156 | 471 | 147 | 2.5e−10 |

| Protein name | Locus Name | Acct# |
|---|---|---|
|  | sp:CUTF_ECOLI | P40710 |

Description

COPPER HOMEOSTASIS PROTEIN CUTF PERCURSOR (LIPOPROTEIN NLPE)

| ORF Name | NTID | AAID | NT Length | AA Length | Score | Probability |
|---|---|---|---|---|---|---|
| 14067057_f1_8 | 2173 | 7395 | 738 | 2217 | 863 | 3.1e−86 |

| Protein name | Locus Name | Acct# |
|---|---|---|
| Na+/H+-exchanging protein slr1595:Na+/H+ antiporter:Na+/H+ antiporter | pir:S74951 | S74951 |

Description

| ORF Name | NTID | AAID | NT Length | AA Length | Score | Probability |
|---|---|---|---|---|---|---|
| 14354762_f3_15 | 2174 | 7396 | 117 | 354 | 90 | 0.0020 |

| Protein name | Locus Name | Acct# |
|---|---|---|
|  | gp:CEY111B2C | AL132906 |

Description

*Caenorhabditis elegans* cosmid Y111B2C, complete sequence.

| ORF Name | NTID | AAID | NT Length | AA Length | Score | Probability |
|---|---|---|---|---|---|---|
| 16832885_f2_14 | 2175 | 7397 | 182 | 546 | 702 | 3.6e−69 |

| Protein name | Locus Name | Acct# |
|---|---|---|
| hypothetical protein | pir:JQ1020 | JQ1020 |

Description

-continued

| ORF Name | NTID | AAID | NT Length | AA Length | Score | Probability |
|---|---|---|---|---|---|---|
| 22860128_f3_26 | 2176 | 7398 | 83 | 252 | 64 | 0.031 |

| Protein name | Locus Name | Acct# |
|---|---|---|
| | sp:SPRC_XENLA | P36378 |

Description (OSTEONECTIN) (ON) (BASEMENT MEMBRANE PROTEIN BM-40)

| ORF Name | NTID | AAID | NT Length | AA Length | Score | Probability |
|---|---|---|---|---|---|---|
| 24412566_f2_13 | 2177 | 7399 | 358 | 1077 | 153 | 1.1e−07 |

| Protein name | Locus Name | Acct# |
|---|---|---|
| KIAA0850 protein | gp:AB020657 | AB020657 |

Description

*Homo sapiens* mRNA for KIAA0850 protein, complete cds.

| ORF Name | NTID | AAID | NT Length | AA Length | Score | Probability |
|---|---|---|---|---|---|---|
| 34181531_c1_33 | 2178 | 7400 | 402 | 1209 | 86 | 0.0058 |

| Protein name | Locus Name | Acct# |
|---|---|---|
| | sp:Y414_HAEIN | |

Description

HYPOTHETICAL PROTEIN HI0414

| ORF Name | NTID | AAID | NT Length | AA Length | Score | Probability |
|---|---|---|---|---|---|---|
| 5172277_c2_40 | 2179 | 7401 | 466 | 1401 | | |

| Protein name | Locus Name | Acct# |
|---|---|---|

Description

NO-HIT

| ORF Name | NTID | AAID | NT Length | AA Length | Score | Probability |
|---|---|---|---|---|---|---|
| 16270793_c2_53 | 2180 | 7402 | 87 | 264 | | |

| Protein name | Locus Name | Acct# |
|---|---|---|

Description

NO-HIT

| ORF Name | NTID | AAID | NT Length | AA Length | Score | Probability |
|---|---|---|---|---|---|---|
| 2007255_c3_60 | 2181 | 7403 | 419 | 1260 | 759 | 3.3e−75 |

| Protein name | Locus Name | Acct# |
|---|---|---|
| hypothetical protein | pir:G72244 | G72244 |

Description

-continued

| ORF Name | NTID | AAID | NT Length | AA Length | Score | Probability |
|---|---|---|---|---|---|---|
| 22150262_c2_47 | 2182 | 7404 | 211 | 636 | 570 | 3.5e−55 |

| Protein name | Locus Name | Acct# |
|---|---|---|
|  | sp:Y168_HAEIN |  |

Description

HYPOTHETICAL PROTEIN HI0168/169

| ORF Name | NTID | AAID | NT Length | AA Length | Score | Probability |
|---|---|---|---|---|---|---|
| 24744125_c1_44 | 2183 | 7405 | 164 | 495 | 276 | 5.0e−24 |

| Protein name | Locus Name | Acct# |
|---|---|---|
| macrophage infectivity potentiator | gp:LSU92222 | U92222 |

Description

*Legionella spiritensis* macrophage infectivity potentiator (mip) gene, complete cds.

| ORF Name | NTID | AAID | NT Length | AA Length | Score | Probability |
|---|---|---|---|---|---|---|
| 24804642_c1_41 | 2184 | 7406 | 429 | 1290 | 1031 | 4.9e−104 |

| Protein name | Locus Name | Acct# |
|---|---|---|
| Na+-translocating NADH-ubiquinone oxidoreductase, beta chain | pir:D64052 | D64052 |

Description

| ORF Name | NTID | AAID | NT Length | AA Length | Score | Probability |
|---|---|---|---|---|---|---|
| 26214062_c1_46 | 2185 | 7407 | 152 | 456 | 155 | 1.5e−10 |

| Protein name | Locus Name | Acct# |
|---|---|---|
|  | sp:T2H2_HAEPA | P36433 |

Description (R.HPAII)

| ORF Name | NTID | AAID | NT Length | AA Length | Score | Probability |
|---|---|---|---|---|---|---|
| 26456280_c1_42 | 2186 | 7408 | 471 | 1416 | 452 | 1.5e−51 |

| Protein name | Locus Name | Acct# |
|---|---|---|
|  | sp:DEAD_BACSU | P42305 |

Description

PROBABLE ATP-DEPENDENT RNA HELICASE DEAD

| ORF Name | NTID | AAID | NT Length | AA Length | Score | Probability |
|---|---|---|---|---|---|---|
| 30105385_c3_61 | 2187 | 7409 | 183 | 552 | 221 | 3.3e−18 |

| Protein name | Locus Name | Acct# |
|---|---|---|
|  | gp:AB014075 | AB014075 |

Description

*Clostridium histolyticum* genes for hypoxanthine-guaninephosphoribosyl-transferase (HGPRTase), GTPase and 12 ORFs, complete and partial cds.

-continued

| ORF Name | NTID | AAID | NT Length | AA Length | Score | Probability |
|---|---|---|---|---|---|---|
| 34174063_c3_55 | 2188 | 7410 | 214 | 645 | 626 | 4.1e−61 |

| Protein name | Locus Name | Acct# |
|---|---|---|
| | sp:NQRE_HAEIN | P71342 |

Description (NA-NQR COMPLEX SUBUNIT 5)

| ORF Name | NTID | AAID | NT Length | AA Length | Score | Probability |
|---|---|---|---|---|---|---|
| 35806324_c1_40 | 2189 | 7411 | 84 | 255 | 102 | 4.8e−05 |

| Protein name | Locus Name | Acct# |
|---|---|---|
| Na+-translocating NADH-ubiquinone oxidoreductase, gamma chain | pir:S65528 | S65528 |

Description

| ORF Name | NTID | AAID | NT Length | AA Length | Score | Probability |
|---|---|---|---|---|---|---|
| 4142191_c1_43 | 2190 | 7412 | 365 | 1098 | 839 | 1.1e−83 |

| Protein name | Locus Name | Acc# |
|---|---|---|
| | sp:SERC_BACSU | |

Description

PROTEIN 234) (VEG234)

| ORF Name | NTID | AAID | NT Length | AA Length | Score | Probability |
|---|---|---|---|---|---|---|
| 916577_c3_59 | 2191 | 7413 | 327 | 984 | 1049 | 6.1e−106 |

| Protein name | Locus Name | Acc# |
|---|---|---|
| D-3-phosphoglycerate dehydrogenase | gp:AF079881 | AF079881 |

Description

Entodinium caudatum D-3-phosphoglycerate dehydrogenase mRNA, partial cds.

| ORF Name | NTID | AAID | NT Length | AA Length | Score | Probability |
|---|---|---|---|---|---|---|
| 984752_c2_3 | 2192 | 7414 | 110 | 333 | 460 | 1.6e−43 |

| Protein name | Locus Name | Acc# |
|---|---|---|
| hypothetical protein | pir:JQ1020 | JQ1020 |

Description

| ORF Name | NTID | AAID | NT Length | AA Length | Score | Probability |
|---|---|---|---|---|---|---|
| 116052_c2_50 | 2193 | 7415 | 86 | 261 | 96 | 5.9e−05 |

| Protein name | Locus Name | Acc# |
|---|---|---|
| hypotheical protein MJ1608 | pir:G64500 | G64500 |

Description

-continued

| ORF Name | NTID | AAID | NT Length | AA Length | Score | Probability |
|---|---|---|---|---|---|---|
| 12704377_f2_10 | 2194 | 7416 | 61 | 186 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 16832885_f1_6 | 2195 | 7417 | 271 | 813 | 1021 | 5.6e−103 |
| Protein name | | | Locus Name | | | Acc# |
| hypothetical protein | | | pir:JQ1020 | | | JQ1020 |
| Description | | | | | | |

| ORF Name | NTID | AAID | NT Length | AA Length | Score | Probability |
|---|---|---|---|---|---|---|
| 19923150_c3_61 | 2196 | 7418 | 175 | 528 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 20500430_f3_31 | 2197 | 7419 | 115 | 348 | 72 | 0.020 |
| Protein name | | | Locus Name | | | Acc# |
| PRO1914 | | | gp:AF118084 | | | AF118084 |
| Description | | | | | | |

*Homo sapiens* PRO1914 mRNA, complete cds.

| ORF Name | NTID | AAID | NT Length | AA Length | Score | Probability |
|---|---|---|---|---|---|---|
| 22860128_f2_21 | 2198 | 7420 | 83 | 252 | 64 | 0.031 |
| Protein name | | | Locus Name | | | Acc# |
| | | | sp:SPRC_XENLA | | | P36378 |
| Description | | | | | | |

(OSTEONECTIN) (ON) (BASEMENT MEMBRANE PROTEIN BM-40)

| ORF Name | NTID | AAID | NT Length | AA Length | Score | Probability |
|---|---|---|---|---|---|---|
| 24229677_c3_60 | 2199 | 7421 | 113 | 342 | | |
| Protein name | | | Locus Name | | | Acc# |
| Description | | | | | | |

NO-HIT

-continued

| ORF Name | NTID | AAID | NT Length | AA Length | Score | Probability |
|---|---|---|---|---|---|---|
| 25835942_c1_41 | 2200 | 7422 | 161 | 486 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 34173157_c1_37 | 2201 | 7423 | 198 | 597 | 483 | 5.8e−46 |

| Protein name | | | | Locus Name | | Acc# |
|---|---|---|---|---|---|---|
| conserved hypothetical protein CAB06296 | | | | pir:T17189 | | T17189 |

Description

| ORF Name | NTID | AAID | NT Length | AA Length | Score | Probability |
|---|---|---|---|---|---|---|
| 34407161_c3_65 | 2202 | 7424 | 339 | 1020 | 652 | 7.1e−64 |

| Protein name | | | | Locus Name | | Acc# |
|---|---|---|---|---|---|---|
| low specificity L-threonine aldolase | | | | gp:AB001577 | | AB001577 |

Description

*Pseudomonas* sp. DNA for low specificity L-threonine aldolase, complete cds.

| ORF Name | NTID | AAID | NT Length | AA Length | Score | Probability |
|---|---|---|---|---|---|---|
| 35166557_f3_22 | 2203 | 7425 | 736 | 2211 | 120 | 0.0012 |

| Protein name | | | | Locus Name | | Acc# |
|---|---|---|---|---|---|---|
| hypothetical protein T13D8.29 | | | | pir:T02292 | | T02292 |

Description

| ORF Name | NTID | AAID | NT Length | AA Length | Score | Probability |
|---|---|---|---|---|---|---|
| 4329831_c2_51 | 2204 | 7426 | 186 | 561 | 218 | 7.0e−18 |

| Protein name | | | | Locus Name | | Acc# |
|---|---|---|---|---|---|---|
| AlgT | | | | gp:AF190580 | | AF190580 |

Description

*Pseudomonas syringae* pv. *syringae* AlgT (algT) gene, complete cds.

| ORF Name | NTID | AAID | NT Length | AA Length | Score | Probability |
|---|---|---|---|---|---|---|
| 5188937_f1_4 | 2205 | 7427 | 146 | 441 | | |

| Protein name | | | | Locus Name | | Acc# |
|---|---|---|---|---|---|---|

Description

NO-HIT

-continued

| ORF Name | NTID | AAID | NT Length | AA Length | Score | Probability |
|---|---|---|---|---|---|---|
| 582552_f3_29 | 2206 | 7428 | 601 | 1806 | 1549 | 6.3e−159 |

| Protein name | | | | Locus Name | | Acc# |
|---|---|---|---|---|---|---|
| pyruvate dehydrogenase | | | | pir:T34668 | | T34668 |

Description

| ORF Name | NTID | AAID | NT Length | AA Length | Score | Probability |
|---|---|---|---|---|---|---|
| 595700_c2_46 | 2207 | 7429 | 89 | 270 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 7167057_c2_45 | 2208 | 7430 | 90 | 273 | 100 | 0.00069 |

| Protein name | | | | Locus Name | | Acc# |
|---|---|---|---|---|---|---|
| | | | | sp:YHV8_YEAST | | P38853 |

Description

HYPOTHETICAL 131.1 KD PROTEIN IN REC104-SOL3 INTERGENIC REGION

| ORF Name | NTID | AAID | NT Length | AA Length | Score | Probability |
|---|---|---|---|---|---|---|
| 11049030_c1_97 | 2209 | 7431 | 70 | 213 | 109 | 3.3e−06 |

| Protein name | | | | Locus Name | | Acc# |
|---|---|---|---|---|---|---|
| hypothetical protein APE0580 | | | | pir:D72643 | | D72643 |

Description

| ORF Name | NTID | AAID | NT Length | AA Length | Score | Probability |
|---|---|---|---|---|---|---|
| 16832885_f3_63 | 2210 | 7432 | 431 | 1296 | 1723 | 2.3e−177 |

| Protein name | | | | Locus Name | | Acc# |
|---|---|---|---|---|---|---|
| hypothetical protein | | | | pir:JQ1020 | | JQ1020 |

Description

| ORF Name | NTID | AAID | NT Length | AA Length | Score | Probability |
|---|---|---|---|---|---|---|
| 21519061_f2_39 | 2211 | 7433 | 262 | 789 | 175 | 3.8e−11 |

| Protein name | | | | Locus Name | | Acc# |
|---|---|---|---|---|---|---|
| | | | | sp:Y612_METJA | | Q58029 |

Description

HYPOTHETICAL PROTEIN MJ0612

-continued

| ORF Name | NTID | AAID | NT Length | AA Length | Score | Probability |
|---|---|---|---|---|---|---|
| 22689083_f1_16 | 2212 | 7434 | 396 | 1191 | 766 | 5.9e−76 |

| Protein name | | | | Locus Name | | Acc# |
|---|---|---|---|---|---|---|
| aminotransferase (AspC family) | | | | pir:B70325 | | B70325 |

Description

| ORF Name | NTID | AAID | NT Length | AA Length | Score | Probability |
|---|---|---|---|---|---|---|
| 22860128_f1_14 | 2213 | 7435 | 83 | 252 | 64 | 0.031 |

| Protein name | | | | Locus Name | | Acc# |
|---|---|---|---|---|---|---|
| | | | | sp:SPRC_XENLA | | P36378 |

Description (OSTEONECTIN) (ON) (BASEMENT MEMBRANE PROTEIN BM-40)

| ORF Name | NTID | AAID | NT Length | AA Length | Score | Probability |
|---|---|---|---|---|---|---|
| 23626550_c2_121 | 2214 | 7436 | 306 | 921 | 391 | 3.2e−36 |

| Protein name | | | | Locus Name | | Acc# |
|---|---|---|---|---|---|---|
| | | | | sp:NPL_ECOLI | | P06995 |

Description

ACID ALDOLASE) (N-ACETYLNEURAMINATE PYRUVATE LYASE) (NALASE)

| ORF Name | NTID | AAID | NT Length | AA Length | Score | Probability |
|---|---|---|---|---|---|---|
| 24229677_c3_127 | 2215 | 7437 | 165 | 498 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24329587_c1_104 | 2216 | 7438 | 1102 | 3309 | 421 | 9.0e−71 |

| Protein name | | | | Locus Name | | Acc# |
|---|---|---|---|---|---|---|
| receptor antigen (RagA) | | | | gp:PGI130872 | | AJ130872 |

Description

*Porphyromonas gingivalis* W50 receptor antigen (rag) locus encoding a major immunodominant 55 kDa antigen.

| ORF Name | NTID | AAID | NT Length | AA Length | Score | Probability |
|---|---|---|---|---|---|---|
| 24800675_f1_20 | 2217 | 7439 | 683 | 2052 | 738 | 6.2e−77 |

| Protein name | | | | Locus Name | | Acc# |
|---|---|---|---|---|---|---|
| | | | | sp:PRIM_CLOAB | | P33655 |

Description

DNA PRIMASE,

-continued

| ORF Name | NTID | AAID | NT Length | AA Length | Score | Probability |
|---|---|---|---|---|---|---|
| 26287762_c3_133 | 2218 | 7440 | 534 | 1605 | 232 | 1.3e−38 |

| Protein name | Locus Name | Acc# |
|---|---|---|
| | sp:STS_RAT | P15589 |

Description

SULFATE SULFOHYDROLASE) (ARYLSULFATASE C) (ASC)

| ORF Name | NTID | AAID | NT Length | AA Length | Score | Probability |
|---|---|---|---|---|---|---|
| 26595402_f2_38 | 2219 | 7441 | 355 | 1068 | 380 | 4.7e−35 |

| Protein name | Locus Name | Acc# |
|---|---|---|
| phospho-2-dehydro-3-deoxyheptonate aldolase/chorismate mutase | pir:A75449 | A75449 |

Description

| ORF Name | NTID | AAID | NT Length | AA Length | Score | Probability |
|---|---|---|---|---|---|---|
| 31726635_f3_64 | 2220 | 7442 | 300 | 903 | 363 | 3.0e−33 |

| Protein name | Locus Name | Acc# |
|---|---|---|
| | sp:PHEA_ERWHE | Q02286 |

Description

| ORF Name | NTID | AAID | NT Length | AA Length | Score | Probability |
|---|---|---|---|---|---|---|
| 35234800_c1_88 | 2221 | 7443 | 521 | 1566 | 254 | 1.3e−38 |

| Protein name | Locus Name | Acc# |
|---|---|---|
| | sp:STS_MOUSE | P50427 |

Description

SULFATE SULFOHYDROLASE) (ARYLSULFATASE C) (ASC)

| ORF Name | NTID | AAID | NT Length | AA Length | Score | Probability |
|---|---|---|---|---|---|---|
| 3910875_f3_84 | 2222 | 7444 | 63 | 192 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 3930163_c3_129 | 2223 | 7445 | 313 | 942 | 167 | 4.3e−10 |

| Protein name | Locus Name | Acc# |
|---|---|---|
| transmembrane sensor | gp:AF051691 | AF051691 |

Description

*Pseudomonas aeruginosa* stress factor A (psfA), ECF sigma factor (fiuI), transmembrane sensor (fiuR), and hydroxamate-typeferrisiderophore receptor (fiuA) genes, complete cds.

| ORF Name | NTID | AAID | NT Length | AA Length | Score | Probability |
|---|---|---|---|---|---|---|
| 3937927_f3_83 | 2224 | 7446 | 99 | 300 | 106 | 1.3e−05 |

| Protein name | Locus Name | Acc# |
|---|---|---|
| unknown | gp:SPU59236 | U59236 |

Description

*Synechococcus* PCC7942 ribosomal protein S1 of 30S ribosome (rps1), ORF271, ORF231, ORF341, carboxyltransferase alpha subunit (accA), ORF245, ORF227, and GTP cyclohydrolase I (folE) genes, complete cds, and ORF205 gene, partial cds.

| ORF Name | NTID | AAID | NT Length | AA Length | Score | Probability |
|---|---|---|---|---|---|---|
| 3985936_c3_128 | 2225 | 7447 | 195 | 588 | 163 | 4.7e−12 |

| Protein name | Locus Name | Acc# |
|---|---|---|
| RNA polymerase sigma factor SigZ-like protein | gp:AF137263 | AF137263 |

Description

*Bacteroides thetaiotaomicron* 30S ribosomal protein S16-like protein, fucose gene cluster, and RNA polymerase sigma factor SigZ-like protein (sigZ) genes, complete cds.

| ORF Name | NTID | AAID | NT Length | AA Length | Score | Probability |
|---|---|---|---|---|---|---|
| 4117167_c3_130 | 2226 | 7448 | 1128 | 3387 | 737 | 4.6e−71 |

| Protein name | Locus Name | Acc# |
|---|---|---|
| receptor antigen (RagA) | gp:PGI130872 | AJ130872 |

Description

*Porphyromonas gingivalis* W50 receptor antigen (rag) locus encoding a major immunodominant 55 kDa antigen.

| ORF Name | NTID | AAID | NT Length | AA Length | Score | Probability |
|---|---|---|---|---|---|---|
| 4875001_c2_126 | 2227 | 7449 | 493 | 1482 | 172 | 9.1e−14 |

| Protein name | Locus Name | Acc# |
|---|---|---|
| unknown | gp:U96771 | U96771 |

Description

*Prevotella bryantii* putative polygalacturonase, B-1,4-endoglucanase, and mannanase genes, complete cds; and unknown genes.

| ORF Name | NTID | AAID | NT Length | AA Length | Score | Probability |
|---|---|---|---|---|---|---|
| 5941260_c2_106 | 2228 | 7450 | 199 | 600 | 557 | 8.3e−54 |

| Protein name | Locus Name | Acc# |
|---|---|---|
|  | sp:GCH1_SYNY3 | Q55759 |

Description

GTP CYCLOHYDROLASE I, (GTP-CH-I)

-continued

| ORF Name | NTID | AAID | NT Length | AA Length | Score | Probability |
|---|---|---|---|---|---|---|
| 678385_c1_103 | 2229 | 7451 | 286 | 861 | 168 | 1.2e−11 |

| Protein name | Locus Name | Acc# |
|---|---|---|
| | sp:YCBG_BACSU | P42239 |

Description (ORF6)

| ORF Name | NTID | AAID | NT Length | AA Length | Score | Probability |
|---|---|---|---|---|---|---|
| 9953161_c1_87 | 2230 | 7452 | 542 | 1629 | 171 | 4.3e−13 |

| Protein name | Locus Name | Acc# |
|---|---|---|
| unknown | gp:U96771 | U96771 |

Description

*Prevotella bryantii* putative polygalacturonase, B-1,4-endoglucanase, and mannanase genes, complete cds; and unknown genes.

| ORF Name | NTID | AAID | NT Length | AA Length | Score | Probability |
|---|---|---|---|---|---|---|
| 11953382_f2_22 | 2231 | 7453 | 133 | 402 | 98 | 0.00012 |

| Protein name | Locus Name | Acc# |
|---|---|---|
| hypothetical protein F19H6.4 | pir:T21123 | T21123 |

Description

| ORF Name | NTID | AAID | NT Length | AA Length | Score | Probability |
|---|---|---|---|---|---|---|
| 14507137_f1_12 | 2232 | 7454 | 201 | 606 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 16116655_c2_76 | 2233 | 7455 | 183 | 552 | 323 | 5.2e−29 |

| Protein name | Locus Name | Acc# |
|---|---|---|
| | sp:DYR_NEIGO | P04174 |

Description

DIHYDROFOLATE REDUCTASE,

| ORF Name | NTID | AAID | NT Length | AA Length | Score | Probability |
|---|---|---|---|---|---|---|
| 16832885_f1_18 | 2234 | 7456 | 405 | 1218 | 1614 | 8.2e−166 |

| Protein name | Locus Name | Acc# |
|---|---|---|
| hypothetical protein | pir:JQ1020 | JQ1020 |

Description

-continued

| ORF Name | NTID | AAID | NT Length | AA Length | Score | Probability |
|---|---|---|---|---|---|---|
| 16882762_c1_55 | 2235 | 7457 | 291 | 876 | 112 | 0.0015 |

| Protein name | | | | Locus Name | | Acc# |
|---|---|---|---|---|---|---|
| hypothetical protein | | | | pir:T29116 | | T29116 |

Description

| ORF Name | NTID | AAID | NT Length | AA Length | Score | Probability |
|---|---|---|---|---|---|---|
| 16884630_f1_1 | 2236 | 7458 | 88 | 267 | 123 | 5.6e−07 |

| Protein name | | | | Locus Name | | Acc# |
|---|---|---|---|---|---|---|
| probable oxidoreductase | | | | pir:F70970 | | F70970 |

Description

| ORF Name | NTID | AAID | NT Length | AA Length | Score | Probability |
|---|---|---|---|---|---|---|
| 16886405_c3_107 | 2237 | 7459 | 132 | 399 | 120 | 2.6e−07 |

| Protein name | | | | Locus Name | | Acc# |
|---|---|---|---|---|---|---|
| hypothetical protein PH1073 | | | | pir:F71101 | | F71101 |

Description

| ORF Name | NTID | AAID | NT Length | AA Length | Score | Probability |
|---|---|---|---|---|---|---|
| 20901531_c3_99 | 2238 | 7460 | 271 | 816 | 1030 | 6.3e−104 |

| Protein name | | | | Locus Name | | Acc# |
|---|---|---|---|---|---|---|
| thymidylate synthase | | | | gp:NGU86637 | | U86637 |

Description

*Neisseria gonorrhoeae* thymidylate synthase (thyA) gene, complete cds.

| ORF Name | NTID | AAID | NT Length | AA Length | Score | Probability |
|---|---|---|---|---|---|---|
| 22165933_c1_51 | 2239 | 7461 | 190 | 573 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 22860128_f2_34 | 2240 | 7462 | 83 | 252 | 64 | 0.031 |

| Protein name | | | | Locus Name | | Acc# |
|---|---|---|---|---|---|---|
| | | | | sp:SPRC_XENLA | | P36378 |

Description (OSTEONECTIN) (ON) (BASEMENT MEMBRANE PROTEIN BM-40)

-continued

| ORF Name | NTID | AAID | NT Length | AA Length | Score | Probability |
|---|---|---|---|---|---|---|
| 2370340_f3_37 | 2241 | 7463 | 526 | 1581 | 604 | 8.7e−59 |

| Protein name | Locus Name | Acc# |
|---|---|---|
| probable oxidoreductase | pir:F70970 | F70970 |

Description

| ORF Name | NTID | AAID | NT Length | AA Length | Score | Probability |
|---|---|---|---|---|---|---|
| 24222175_f1_10 | 2242 | 7464 | 281 | 846 | 208 | 8.0e−17 |

| Protein name | Locus Name | Acc# |
|---|---|---|
|  | sp:YA22_METTH | O27101 |

Description

PUTATIVE BIOPOLYMER TRANSPORT PROTEIN EXBB HOMOLOG

| ORF Name | NTID | AAID | NT Length | AA Length | Score | Probability |
|---|---|---|---|---|---|---|
| 24509675_f3_44 | 2243 | 7465 | 155 | 468 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 26382062_f1_6 | 2244 | 7466 | 239 | 720 | 139 | 2.2e−07 |

| Protein name | Locus Name | Acc# |
|---|---|---|
| siderophore-mediated iron transport protein | pir:F71829 | F71829 |

Description

| ORF Name | NTID | AAID | NT Length | AA Length | Score | Probability |
|---|---|---|---|---|---|---|
| 32244077_f3_38 | 2245 | 7467 | 290 | 873 | 377 | 9.9e−35 |

| Protein name | Locus Name | Acc# |
|---|---|---|
| UBE-1a | gp:AB030503 | AB030503 |

Description

*Mus musculus* mRNA for UBE-1a, complete cds.

| ORF Name | NTID | AAID | NT Length | AA Length | Score | Probability |
|---|---|---|---|---|---|---|
| 3242201_f2_30 | 2246 | 7468 | 69 | 210 |  |  |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 34417255_f1_11 | 2247 | 7469 | 158 | 477 | 107 | 0.00056 |

| Protein name | Locus Name | Acc# |
|---|---|---|
| hypothetical protein PH1889 | pir:D71202 | D71202 |

Description

| ORF Name | NTID | AAID | NT Length | AA Length | Score | Probability |
|---|---|---|---|---|---|---|
| 34504015_f1_8 | 2248 | 7470 | 244 | 735 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 34573385_f3_43 | 2249 | 7471 | 347 | 1044 | 517 | 1.4e−49 |

| Protein name | Locus Name | Acc# |
|---|---|---|
| bifunctional short chain isoprenyl diphosphate synthase (idsA) homolog | pir:F69535 | F69535 |

Description

| ORF Name | NTID | AAID | NT Length | AA Length | Score | Probability |
|---|---|---|---|---|---|---|
| 35756562_f3_36 | 2250 | 7472 | 457 | 1374 | 972 | 8.8e−98 |

| Protein name | Locus Name | Acc# |
|---|---|---|
| citrate synthase | gp:AF088222 | AF088222 |

Description

*Lactococcus lactis* subsp. *lactis* citrate synthase, aconitatehydratase, and truncated isocitrate dehydrogenase genes, complete cds.

| ORF Name | NTID | AAID | NT Length | AA Length | Score | Probability |
|---|---|---|---|---|---|---|
| 36367125_f1_16 | 2251 | 7473 | 160 | 483 | 311 | 9.7e−28 |

| Protein name | Locus Name | Acc# |
|---|---|---|
| | sp:ASNC_HAEIN | P44337 |

Description

REGULATORY PROTEIN ASNC

| ORF Name | NTID | AAID | NT Length | AA Length | Score | Probability |
|---|---|---|---|---|---|---|
| 4428518_c1_67 | 2252 | 7474 | 317 | 954 | 428 | 3.9e−40 |

| Protein name | Locus Name | Acc# |
|---|---|---|
| LytB protein | pir:G70449 | G70449 |

Description

-continued

| ORF Name | NTID | AAID | NT Length | AA Length | Score | Probability |
|---|---|---|---|---|---|---|
| 4881510_c3_109 | 2253 | 7475 | 278 | 837 | 464 | 6.0e−44 |

| Protein name | Locus Name | Acc# |
|---|---|---|
| | sp:KCY_BACSU | P38493 |

Description (CMP KINASE)

| ORF Name | NTID | AAID | NT Length | AA Length | Score | Probability |
|---|---|---|---|---|---|---|
| 5114062_c3_111 | 2254 | 7476 | 331 | 996 | 834 | 3.7e−83 |

| Protein name | Locus Name | Acc# |
|---|---|---|
| | sp:K6P1_THETH | P21777 |

Description (PFK1)

| ORF Name | NTID | AAID | NT Length | AA Length | Score | Probability |
|---|---|---|---|---|---|---|
| 5884637_f1_9 | 2255 | 7477 | 259 | 780 | 411 | 2.5e−38 |

| Protein name | Locus Name | Acc# |
|---|---|---|
| | sp:YABD_BACSU | P37545 |

Description

HYPOTHETICAL 29.2 KD PROTEIN IN METS-KSGA INTERGENIC REGION

| ORF Name | NTID | AAID | NT Length | AA Length | Score | Probability |
|---|---|---|---|---|---|---|
| 829417_f1_13 | 2256 | 7478 | 61 | 186 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 9894067_c2_78 | 2257 | 7479 | 213 | 642 | 130 | 4.5−06 |

| Protein name | Locus Name | Acc# |
|---|---|---|
| hypothetical protein | pir:T29116 | T29116 |

Description

| ORF Name | NTID | AAID | NT Length | AA Length | Score | Probability |
|---|---|---|---|---|---|---|
| 10555302_f3_105 | 2258 | 7480 | 350 | 1053 | 255 | 8.4e−22 |

| Protein name | Locus Name | Acc# |
|---|---|---|
| conserved hypothetical protein AF2231 | pir:G69528 | G69528 |

Description

-continued

| ORF Name | NTID | AAID | NT Length | AA Length | Score | Probability |
|---|---|---|---|---|---|---|
| 10757817_c1_149 | 2259 | 7481 | 152 | 459 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 10805308_c2_174 | 2260 | 7482 | 62 | 189 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 12147561_c1_120 | 2261 | 7483 | 705 | 2118 | 169 | 8.1e−10 |

| Protein name | | | | Locus Name | | Acc# |
|---|---|---|---|---|---|---|
| immunoreactive 53 kD antigen PG123 | | | | gp:AF144641 | | AF144641 |

Description

*Porphyromonas gingivalis* strain W50 immunoreactive 53 kD antigen PG123 gene, complete cds.

| ORF Name | NTID | AAID | NT Length | AA Length | Score | Probability |
|---|---|---|---|---|---|---|
| 12697180_c3_207 | 2262 | 7484 | 378 | 1137 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 16140752_f1_27 | 2263 | 7485 | 69 | 210 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 16621087_f1_10 | 2264 | 7486 | 134 | 405 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 1954412_f1_29 | 2265 | 7487 | 173 | 522 | 181 | 5.8e−14 |

| Protein name | Locus Name | Acc# |
|---|---|---|
| RNA polymerase ECF-type sigma factor sigW | pir:H69706 | H69706 |

Description

| ORF Name | NTID | AAID | NT Length | AA Length | Score | Probability |
|---|---|---|---|---|---|---|
| 22145627_c2_180 | 2266 | 7488 | 565 | 1698 | 263 | 1.1e−19 |

| Protein name | Locus Name | Acc# |
|---|---|---|
| hypothetical protein aq_1220 | pir:C70405 | C70405 |

Description

| ORF Name | NTID | AAID | NT Length | AA Length | Score | Probability |
|---|---|---|---|---|---|---|
| 23486536_f2_65 | 2267 | 7489 | 85 | 258 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 23704675_f3_114 | 2268 | 7490 | 551 | 1656 | 2162 | 6.9e−224 |

| Protein name | Locus Name | Acc# |
|---|---|---|
| chaperonin groEL | pir:S47530 | S47530 |

Description

| ORF Name | NTID | AAID | NT Length | AA Length | Score | Probability |
|---|---|---|---|---|---|---|
| 24347332_f1_8 | 2269 | 7491 | 338 | 1017 | 896 | 9.9e−90 |

| Protein name | Locus Name | Acc# |
|---|---|---|
| cysteine synthase | gp:MLCB22 | Z98741 |

Description

*Mycobacterium leprae* cosmid B22.

| ORF Name | NTID | AAID | NT Length | AA Length | Score | Probability |
|---|---|---|---|---|---|---|
| 24414553_c1_143 | 2270 | 7492 | 63 | 192 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24415892_c1_121 | 2271 | 7493 | 181 | 546 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 2463451_f3_79 | 2272 | 7494 | 270 | 813 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 24805302_f1_16 | 2273 | 7495 | 232 | 699 | 432 | 1.5e−40 |
| Protein name | | | Locus Name | | | Acc# |
| hypothetical protein yugP | | | pir:F70011 | | | F70011 |
| Description | | | | | | |

| ORF Name | NTID | AAID | NT Length | AA Length | Score | Probability |
|---|---|---|---|---|---|---|
| 24806517_f2_49 | 2274 | 7496 | 684 | 2055 | 231 | 1.6e−26 |
| Protein name | | | Locus Name | | | Acc# |
| dipeptidyl peptidase III | | | gp:D89340 | | | D89340 |
| Description | | | | | | |

*Rattus norvegicus* mRNA for dipeptidyl peptidase III, complete cds.

| ORF Name | NTID | AAID | NT Length | AA Length | Score | Probability |
|---|---|---|---|---|---|---|
| 25429837_c2_154 | 2275 | 7497 | 294 | 885 | 1200 | 6.1e−122 |
| Protein name | | | Locus Name | | | Acc# |
| hypothetical protein | | | pir:JQ1020 | | | JQ1020 |
| Description | | | | | | |

| ORF Name | NTID | AAID | NT Length | AA Length | Score | Probability |
|---|---|---|---|---|---|---|
| 25585781_c3_234 | 2276 | 7498 | 225 | 678 | 167 | 5.5e−12 |
| Protein name | | | Locus Name | | | Acc# |
| | | | sp:Y374_METJA | | | Q57819 |
| Description | | | | | | |

HYPOTHETICAL PROTEIN MJ0374

| ORF Name | NTID | AAID | NT Length | AA Length | Score | Probability |
|---|---|---|---|---|---|---|
| 25641942_c3_219 | 2277 | 7499 | 231 | 696 | | |
| Protein name | | | Locus Name | | | Acc# |
| Description | | | | | | |

NO-HIT

-continued

| ORF Name | NTID | AAID | NT Length | AA Length | Score | Probability |
|---|---|---|---|---|---|---|
| 25911662_f2_52 | 2278 | 7500 | 166 | 501 | 216 | 1.1e−17 |

| Protein name | Locus Name | Acc# |
|---|---|---|
| | sp:FUR_CAMJE | |

Description

FERRIC UPTAKE REGULATION PROTEIN (FERRIC UPTAKE REGULATOR)

| ORF Name | NTID | AAID | NT Length | AA Length | Score | Probability |
|---|---|---|---|---|---|---|
| 25978462_c1_142 | 2279 | 7501 | 608 | 1827 | 1308 | 2.2e−133 |

| Protein name | Locus Name | Acc# |
|---|---|---|
| | sp:RECQ_HAEIN | P71359 |

Description

ATP-DEPENDENT DNA HELICASE RECQ,

| ORF Name | NTID | AAID | NT Length | AA Length | Score | Probability |
|---|---|---|---|---|---|---|
| 26598467_f3_106 | 2280 | 7502 | 194 | 585 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 2923517_f1_17 | 2281 | 7503 | 395 | 1188 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 29455156_c1_129 | 2282 | 7504 | 624 | 1875 | 434 | 2.1e−40 |

| Protein name | Locus Name | Acc# |
|---|---|---|
| acylamino-acid-releasing enzyme, (acyl-peptide hydrolase) (aph) (acylaminoacyl-peptidase) PAB1300 | pir:H75007 | H75007 |

Description

| ORF Name | NTID | AAID | NT Length | AA Length | Score | Probability |
|---|---|---|---|---|---|---|
| 29926562_c3_208 | 2283 | 7505 | 276 | 831 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 31447702_c1_128 | 2284 | 7506 | 273 | 822 | 535 | 2.9e−51 |

| Protein name | Locus Name | Acc# |
|---|---|---|
| immunoreactive 89 kD antigen PG87 | gp:AF175722 | AF175722 |

Description

*Porphyromonas gingivalis* strain W50 immunoreactive 89 kD antigen PG87 gene, complete cds.

| ORF Name | NTID | AAID | NT Length | AA Length | Score | Probability |
|---|---|---|---|---|---|---|
| 3323437_f2_77 | 2285 | 7507 | 345 | 1038 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 33238187_c2_159 | 2286 | 7508 | 389 | 1170 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 33287775_c2_158 | 2287 | 7509 | 506 | 1521 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 33402001_c2_160 | 2288 | 7510 | 375 | 1128 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 35781576_f1_30 | 2289 | 7511 | 297 | 894 | 582 | 1.9e−56 |

| Protein name | Locus Name | Acc# |
|---|---|---|
| conserved hypothetical protein | pir:D75557 | D75557 |

Description

-continued

| ORF Name | NTID | AAID | NT Length | AA Length | Score | Probability |
|---|---|---|---|---|---|---|
| 3906380_f2_54 | 2290 | 7512 | 69 | 210 | 70 | 0.033 |

| Protein name | Locus Name | Acc# |
|---|---|---|
| hypothetical protein Y68A4B.3 | pir:T27307 | T27307 |

Description

| ORF Name | NTID | AAID | NT Length | AA Length | Score | Probability |
|---|---|---|---|---|---|---|
| 4022312_f3_113 | 2291 | 7513 | 93 | 282 | 393 | 2.0e−36 |

| Protein name | Locus Name | Acc# |
|---|---|---|
| | sp:CH10_PORGI | P42376 |

Description

10 KD CHAPERONIN (PROTEIN CPN10) (PROTEIN GROES)

| ORF Name | NTID | AAID | NT Length | AA Length | Score | Probability |
|---|---|---|---|---|---|---|
| 4695302_c2_175 | 2292 | 7514 | 422 | 1269 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 4718760_f3_88 | 2293 | 7515 | 300 | 903 | 193 | 4.1e−13 |

| Protein name | Locus Name | Acc# |
|---|---|---|
| conserved hypothetical protein MTH83 | pir:F69210 | F69210 |

Description

| ORF Name | NTID | AAID | NT Length | AA Length | Score | Probability |
|---|---|---|---|---|---|---|
| 4798465_f1_26 | 2294 | 7516 | 386 | 1161 | 291 | 1.3e−25 |

| Protein name | Locus Name | Acc# |
|---|---|---|
| conserved hypothetical protein | pir:C72340 | C72340 |

Description

| ORF Name | NTID | AAID | NT Length | AA Length | Score | Probability |
|---|---|---|---|---|---|---|
| 4883437_f1_15 | 2295 | 7517 | 426 | 1281 | 967 | 3.0e−97 |

| Protein name | Locus Name | Acc# |
|---|---|---|
| | sp:PURA_YEAST | P80210 |

Description

ADENYLOSUCCINATE SYNTHETASE, (IMP--ASPARTATE LIGASE)

-continued

| ORF Name | NTID | AAID | NT Length | AA Length | Score | Probability |
|---|---|---|---|---|---|---|
| 526637_f3_96 | 2296 | 7518 | 457 | 1374 | 429 | 3.0e−40 |

| Protein name | Locus Name | Acc# |
|---|---|---|
| probable glycosyl hydrolase | pir:T36467 | T36467 |

Description

| ORF Name | NTID | AAID | NT Length | AA Length | Score | Probability |
|---|---|---|---|---|---|---|
| 5351687_f2_67 | 2297 | 7519 | 68 | 207 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 643818_c3_233 | 2298 | 7520 | 504 | 1515 | 424 | 5.9e−42 |

| Protein name | Locus Name | Acc# |
|---|---|---|
| | sp:YC46_HAEIN | P44135 |

Description

HYPOTHETICAL PROTEIN HI1246

| ORF Name | NTID | AAID | NT Length | AA Length | Score | Probability |
|---|---|---|---|---|---|---|
| 6462751_f2_50 | 2299 | 7521 | 221 | 666 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 7222125_c3_218 | 2300 | 7522 | 474 | 1425 | 545 | 1.6e−52 |

| Protein name | Locus Name | Acc# |
|---|---|---|
| putative secreted protein | gp:SCM11 | AL133278 |

Description

*Streptomyces coelicolor* cosmid M11.

| ORF Name | NTID | AAID | NT Length | AA Length | Score | Probability |
|---|---|---|---|---|---|---|
| 822137_c2_195 | 2301 | 7523 | 713 | 2142 | 121 | 5.4e−10 |

| Protein name | Locus Name | Acc# |
|---|---|---|
| heme receptor | gp:VIBHUTA | L27149 |

Description

*Vibrio cholerae* heme receptor (hutA) gene, complete cds.

-continued

| ORF Name | NTID | AAID | NT Length | AA Length | Score | Probability |
|---|---|---|---|---|---|---|
| 9797180_f1_18 | 2302 | 7524 | 471 | 1416 | 535 | 1.5e−65 |

| Protein name | Locus Name | Acc# |
|---|---|---|
| | sp:SYH_HUMAN | P12081 |

Description (HISRS)

| ORF Name | NTID | AAID | NT Length | AA Length | Score | Probability |
|---|---|---|---|---|---|---|
| 9883507_c3_238 | 2303 | 7525 | 359 | 1080 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 9953556_f3_91 | 2304 | 7526 | 158 | 477 | 135 | 3.2e−08 |

| Protein name | Locus Name | Acc# |
|---|---|---|
| response regulator | gp:SPAJ6396 | AJ006396 |

Description

*Streptococcus pneumoniae* rr07 and hk07 genes; two component system07.

| ORF Name | NTID | AAID | NT Length | AA Length | Score | Probability |
|---|---|---|---|---|---|---|
| 11906705_c1_6 | 2305 | 7527 | 303 | 912 | 1115 | 6.2e−113 |

| Protein name | Locus Name | Acc# |
|---|---|---|
| beta-glucosidase | gp:AF006658 | AF006658 |

Description

*Bacteroides fragilis* beta-glucosidase gene, complete cds.

| ORF Name | NTID | AAID | NT Length | AA Length | Score | Probability |
|---|---|---|---|---|---|---|
| 19578130_f2_3 | 2306 | 7528 | 66 | 201 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 1276700_f1_1 | 2307 | 7529 | 102 | 309 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 162937_f2_83 | 2308 | 7530 | 707 | 2124 | 1709 | 7.0e−176 |

| Protein name | Locus Name | Acc# |
|---|---|---|
| 115K outer membrane protein precursor:SusC protein | pir:JC6027 | JC6027 |

Description

| ORF Name | NTID | AAID | NT Length | AA Length | Score | Probability |
|---|---|---|---|---|---|---|
| 16500342_c3_176 | 2309 | 7531 | 1335 | 4008 | 280 | 1.4e−39 |

| Protein name | Locus Name | Acc# |
|---|---|---|
| hybrid histidine kinase | gp:AF029704 | AF029704 |

Description

*Dictyostelium discoideum* hybrid histidine kinase (dhkD) mRNA, complete cds.

| ORF Name | NTID | AAID | NT Length | AA Length | Score | Probability |
|---|---|---|---|---|---|---|
| 19564077_c3_177 | 2310 | 7532 | 180 | 543 | 247 | 2.1e−20 |

| Protein name | Locus Name | Acc# |
|---|---|---|
| probable chromate transport protein | pir:G71379 | G71379 |

Description

| ORF Name | NTID | AAID | NT Length | AA Length | Score | Probability |
|---|---|---|---|---|---|---|
| 20830137_c2_135 | 2311 | 7533 | 459 | 1380 | 267 | 7.9e−25 |

| Protein name | Locus Name | Acc# |
|---|---|---|
| sucrose transporter 1 | gp:AF191024 | AF191024 |

Description

*Asarina barclaiana* sucrose transporter 1 (SUT1) mRNA, complete cds.

| ORF Name | NTID | AAID | NT Length | AA Length | Score | Probability |
|---|---|---|---|---|---|---|
| 22534633_c3_175 | 2312 | 7534 | 1294 | 3885 | 1006 | 2.8e−207 |

| Protein name | Locus Name | Acc# |
|---|---|---|
|  | sp:PUR4_DROME | P35421 |

Description (ADENOSINE-2) (FGAMS) (FORMYLGLYCINAMIDE RIBOTIDE SYNTHETASE)

| ORF Name | NTID | AAID | NT Length | AA Length | Score | Probability |
|---|---|---|---|---|---|---|
| 22712880_c1_123 | 2313 | 7535 | 1021 | 3066 | 661 | 3.6e−62 |

| Protein name | Locus Name | Acc# |
|---|---|---|
| cation efflux system (AcrB/AcrD/AcrF family) | pir:F70342 | F70342 |

Description

-continued

| ORF Name | NTID | AAID | NT Length | AA Length | Score | Probability |
|---|---|---|---|---|---|---|
| 24234676_c3_174 | 2314 | 7536 | 437 | 1314 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24486562_f2_36 | 2315 | 7537 | 165 | 498 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24509680_c3_165 | 2316 | 7538 | 354 | 1065 | 254 | 1.1e−21 |

| Protein name | | | | Locus Name | | Acc# |
|---|---|---|---|---|---|---|
| cation efflux system (czcB-like) | | | | pir:C70415 | | C70415 |

Description

| ORF Name | NTID | AAID | NT Length | AA Length | Score | Probability |
|---|---|---|---|---|---|---|
| 24644812_c3_164 | 2317 | 7539 | 773 | 2322 | 1663 | 5.2e−171 |

| Protein name | | | | Locus Name | | Acc# |
|---|---|---|---|---|---|---|
| | | | | sp:YVDK_BACSU | | O06993 |

Description

HYPOTHETICAL 88.3 KD PROTEIN IN CLPP-CRH INTERGENIC REGION

| ORF Name | NTID | AAID | NT Length | AA Length | Score | Probability |
|---|---|---|---|---|---|---|
| 2928461_f1_27 | 2318 | 7540 | 97 | 294 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 29892568_f3_91 | 2319 | 7541 | 80 | 243 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 30116437_c3_163 | 2320 | 7542 | 341 | 1026 | 451 | 1.4e−42 |

| Protein name | | | | Locus Name | | Acc# |
|---|---|---|---|---|---|---|
| transcription regulator, LacI family | | | | pir:F72282 | | F72282 |

Description

-continued

| ORF Name | NTID | AAID | NT Length | AA Length | Score | Probability |
|---|---|---|---|---|---|---|
| 3944562_f3_90 | 2321 | 7543 | 279 | 840 | 645 | 3.9e−63 |

| Protein name | Locus Name | Acc# |
|---|---|---|
| YngK | gp:AF184956 | AF184956 |

Description

*Bacillus subtilis* mycosubtilin operon, complete sequence.

| ORF Name | NTID | AAID | NT Length | AA Length | Score | Probability |
|---|---|---|---|---|---|---|
| 422776_c3_181 | 2322 | 7544 | 937 | 2814 | 1529 | 4.7e−234 |

| Protein name | Locus Name | Acc# |
|---|---|---|
| excinuclease ABC chain A:uvrA protein | pir:H69157 | H69157 |

Description

| ORF Name | NTID | AAID | NT Length | AA Length | Score | Probability |
|---|---|---|---|---|---|---|
| 4583338_f3_84 | 2323 | 7545 | 256 | 771 | 293 | 7.9e−26 |

| Protein name | Locus Name | Acc# |
|---|---|---|
| *H. influenzae* predicted coding region HI1127 | gp:U32792 | |

Description

*Haemophilus influenzae* Rd section 107 of 163 of the complete genome.

| ORF Name | NTID | AAID | NT Length | AA Length | Score | Probability |
|---|---|---|---|---|---|---|
| 5109662_c1_128 | 2324 | 7546 | 184 | 555 | 254 | 1.1e−21 |

| Protein name | Locus Name | Acc# |
|---|---|---|
| probable chromate transport protein | pir:C70068 | C70068 |

Description

| ORF Name | NTID | AAID | NT Length | AA Length | Score | Probability |
|---|---|---|---|---|---|---|
| 5110712_c1_124 | 2325 | 7547 | 426 | 1281 | 182 | 5.2e−11 |

| Protein name | Locus Name | Acc# |
|---|---|---|
| immunoreactive 52 kD antigen PG41 | gp:AF175716 | AF175716 |

Description

*Porphyromonas gingivalis* strain W50 immunoreactive 52 kD antigen PG41 gene, complete cds.

| ORF Name | NTID | AAID | NT Length | AA Length | Score | Probability |
|---|---|---|---|---|---|---|
| 7032127_f2_70 | 2326 | 7548 | 89 | 270 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 838142_f1_4 | 2327 | 7549 | 254 | 765 | 374 | 2.1e−34 |

| Protein name | Locus Name | Acc# |
|---|---|---|
| YngK | gp:AF184956 | AF184956 |

Description

*Bacillus subtilis* mycosubtilin operon, complete sequence.

| ORF Name | NTID | AAID | NT Length | AA Length | Score | Probability |
|---|---|---|---|---|---|---|
| 17048331_c3_60 | 2328 | 7550 | 406 | 1221 | 367 | 1.2e−32 |

| Protein name | Locus Name | Acc# |
|---|---|---|
| | sp:AMPN_STRLI | Q11010 |

Description (ALANINE AMINOPEPTIDASE)

| ORF Name | NTID | AAID | NT Length | AA Length | Score | Probability |
|---|---|---|---|---|---|---|
| 24644575_c1_50 | 2329 | 7551 | 522 | 1569 | 155 | 2.0e−07 |

| Protein name | Locus Name | Acc# |
|---|---|---|
| | sp:AAP1_YEAST | P37898 |

Description

ALANINE/ARGININE AMINOPEPTIDASE,

| ORF Name | NTID | AAID | NT Length | AA Length | Score | Probability |
|---|---|---|---|---|---|---|
| 24649017_c3_58 | 2330 | 7552 | 415 | 1248 | 651 | 2.1e−66 |

| Protein name | Locus Name | Acc# |
|---|---|---|
| hypothetical protein SC4H2.17 SC4H2.17 | pir:T35116 | T35116 |

Description

| ORF Name | NTID | AAID | NT Length | AA Length | Score | Probability |
|---|---|---|---|---|---|---|
| 26365961_c1_47 | 2331 | 7553 | 470 | 1413 | 139 | 2.1e−07 |

| Protein name | Locus Name | Acc# |
|---|---|---|
| receptor antigen B (RagB) | gp:PGI130872 | AJ130872 |

Description

*Porphyromonas gingivalis* W50 receptor antigen (rag) locus encoding a major immunodominant 55 kDa antigen.

| ORF Name | NTID | AAID | NT Length | AA Length | Score | Probability |
|---|---|---|---|---|---|---|
| 29350375_c3_59 | 2332 | 7554 | 468 | 1407 | 345 | 1.9e−30 |

| Protein name | Locus Name | Acc# |
|---|---|---|
| hypothetical protein TP0851 | pir:C71274 | C71274 |

Description

-continued

| ORF Name | NTID | AAID | NT Length | AA Length | Score | Probability |
|---|---|---|---|---|---|---|
| 31496067_c1_49 | 2333 | 7555 | 227 | 684 | | |
| Protein name | | | | Locus Name | | Acc# |
| Description | | | | | | |
| NO-HIT | | | | | | |

| ORF Name | NTID | AAID | NT Length | AA Length | Score | Probability |
|---|---|---|---|---|---|---|
| 33439010_c3_57 | 2334 | 7556 | 982 | 2949 | 448 | 4.6e−86 |
| Protein name | | | | Locus Name | | Acc# |
| 115K outer membrane protein precursor:SusC protein | | | | pir:JC6027 | | JC6027 |
| Description | | | | | | |

| ORF Name | NTID | AAID | NT Length | AA Length | Score | Probability |
|---|---|---|---|---|---|---|
| 4738761_c2_55 | 2335 | 7557 | 433 | 1299 | 1622 | 1.2e−166 |
| Protein name | | | | Locus Name | | Acc# |
| fumarate hydratase, fumB, iron-dependent:fumarase B | | | | pir:B44511 | | |
| Description | | | | | | |

| ORF Name | NTID | AAID | NT Length | AA Length | Score | Probability |
|---|---|---|---|---|---|---|
| 48828124_c1_4 | 2336 | 7558 | 178 | 537 | 410 | 3.1e−38 |
| Protein name | | | | Locus Name | | Acc# |
| hypothetical protein F36H12.3 | | | | pir:T33457 | | T33457 |
| Description | | | | | | |

| ORF Name | NTID | AAID | NT Length | AA Length | Score | Probability |
|---|---|---|---|---|---|---|
| 48828124_c2_5 | 2337 | 7559 | 179 | 540 | 407 | 6.5e−38 |
| Protein name | | | | Locus Name | | Acc# |
| hypothetical protein F36H12.3 | | | | pir:T33457 | | T33457 |
| Description | | | | | | |

| ORF Name | NTID | AAID | NT Length | AA Length | Score | Probability |
|---|---|---|---|---|---|---|
| 48828124_c3_6 | 2338 | 7560 | 188 | 567 | 412 | 1.9e−38 |
| Protein name | | | | Locus Name | | Acc# |
| hypothetical protein F36H12.3 | | | | pir:T33457 | | T33457 |
| Description | | | | | | |

| ORF Name | NTID | AAID | NT Length | AA Length | Score | Probability |
|---|---|---|---|---|---|---|
| 4485917_c2_3 | 2339 | 7561 | 104 | 312 | | |
| Protein name | | | | Locus Name | | Acc# |
| Description | | | | | | |
| NO-HIT | | | | | | |

-continued

| ORF Name | NTID | AAID | NT Length | AA Length | Score | Probability |
|---|---|---|---|---|---|---|
| 10742905_f2_80 | 2340 | 7562 | 97 | 294 | 105 | 4.2e−05 |

| Protein name | | | Locus Name | | | Acc# |
|---|---|---|---|---|---|---|
| conserved hypothetical protein | | | pir:A72220 | | | A72220 |

Description

| ORF Name | NTID | AAID | NT Length | AA Length | Score | Probability |
|---|---|---|---|---|---|---|
| 11210313_c3_276 | 2341 | 7563 | 281 | 846 | 645 | 3.9e−63 |

| Protein name | | | Locus Name | | | Acc# |
|---|---|---|---|---|---|---|
| CysQ protein | | | pir:A70330 | | | A70330 |

Description

| ORF Name | NTID | AAID | NT Length | AA Length | Score | Probability |
|---|---|---|---|---|---|---|
| 11796876_c3_240 | 2342 | 7564 | 159 | 480 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 1296950_c2_225 | 2343 | 7565 | 522 | 1569 | 381 | 6.0e−67 |

| Protein name | | | Locus Name | | | Acc# |
|---|---|---|---|---|---|---|
| | | | sp:Y640_SYNY3 | | | P72958 |

Description

HYPOTHETICAL 66.7 KD PROTEIN SLL0640

| ORF Name | NTID | AAID | NT Length | AA Length | Score | Probability |
|---|---|---|---|---|---|---|
| 1348563_c1_151 | 2344 | 7566 | 166 | 501 | 715 | 1.5e−70 |

| Protein name | | | Locus Name | | | Acc# |
|---|---|---|---|---|---|---|
| hypothetical protein | | | pir:JQ1020 | | | JQ1020 |

Description

| ORF Name | NTID | AAID | NT Length | AA Length | Score | Probability |
|---|---|---|---|---|---|---|
| 13837817_f2_54 | 2345 | 7567 | 272 | 819 | 101 | 0.0055 |

| Protein name | | | Locus Name | | | Acc# |
|---|---|---|---|---|---|---|
| otnG protein | | | pir:S70954 | | | S70954 |

Description

| ORF Name | NTID | AAID | NT Length | AA Length | Score | Probability |
|---|---|---|---|---|---|---|
| 13859376_f2_77 | 2346 | 7568 | 391 | 1176 | 687 | 1.3e−67 |

| Protein name | | | Locus Name | | | Acc# |
|---|---|---|---|---|---|---|
| galactokinase | | | pir:C72283 | | | C72283 |

Description

-continued

| ORF Name | NTID | AAID | NT Length | AA Length | Score | Probability |
|---|---|---|---|---|---|---|
| 14648312_c1_199 | 2347 | 7569 | 376 | 1131 | 363 | 3.0e−33 |

| Protein name | Locus Name | Acc# |
|---|---|---|
| immunoreactive 42 kD antigen PG33 | gp:AF175715 | AF175715 |

Description

*Porphyromonas gingivalis* strain W50 immunoreactive 42 kD antigen PG33 gene, complete cds.

| ORF Name | NTID | AAID | NT Length | AA Length | Score | Probability |
|---|---|---|---|---|---|---|
| 16801507_f1_32 | 2348 | 7570 | 280 | 843 | 226 | 9.9e−19 |

| Protein name | Locus Name | Acc# |
|---|---|---|
| glutamine ABC transporter, periplasmic glutamine-binding protein (glnH) homolog | pir:G69278 | G69278 |

Description

| ORF Name | NTID | AAID | NT Length | AA Length | Score | Probability |
|---|---|---|---|---|---|---|
| 16832885_f2_51 | 2349 | 7571 | 90 | 273 | 312 | 7.6e−28 |

| Protein name | Locus Name | Acc# |
|---|---|---|
| hypothetical protein | pir:JQ1020 | JQ1020 |

Description

| ORF Name | NTID | AAID | NT Length | AA Length | Score | Probability |
|---|---|---|---|---|---|---|
| 17187_c3_273 | 2350 | 7572 | 64 | 195 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 187502_c2_235 | 2351 | 7573 | 364 | 1095 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 187502_f1_10 | 2352 | 7574 | 522 | 1569 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 20110930_f2_82 | 2353 | 7575 | 63 | 192 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 22470301_f2_73 | 2354 | 7576 | 131 | 396 | 71 | 0.026 |

| Protein name | Locus Name | Acc# |
|---|---|---|
| unknown protein | gp:BACATPA | |

Description

*B. megaterium* ATP synthase i, a, c, b, delta, alpha, gamma, beta and epsilon subunit genes, complete cds, and ORF.

| ORF Name | NTID | AAID | NT Length | AA Length | Score | Probability |
|---|---|---|---|---|---|---|
| 22660002_f3_129 | 2355 | 7577 | 103 | 312 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 22860128_f3_106 | 2356 | 7578 | 83 | 252 | 64 | 0.031 |

| Protein name | Locus Name | Acc# |
|---|---|---|
| | sp:SPRC_XENLA | P36378 |

Description (OSTEONECTIN) (ON) (BASEMENT MEMBRANE PROTEIN BM-40)

| ORF Name | NTID | AAID | NT Length | AA Length | Score | Probability |
|---|---|---|---|---|---|---|
| 23554687_f1_35 | 2357 | 7579 | 305 | 918 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 23631562_f3_133 | 2358 | 7580 | 460 | 1383 | 330 | 9.4e−30 |

| Protein name | Locus Name | Acc# |
|---|---|---|
| | sp:GLUP_BRUAB | Q44623 |

Description

GLUCOSE/GALACTOSE TRANSPORTER

-continued

| ORF Name | NTID | AAID | NT Length | AA Length | Score | Probability |
|---|---|---|---|---|---|---|
| 23907956_f1_22 | 2359 | 7581 | 83 | 252 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24069755_c2_222 | 2360 | 7582 | 279 | 840 | 503 | 4.4e−48 |

| Protein name | | | | Locus Name | | Acc# |
|---|---|---|---|---|---|---|
| hypothetical protein slr1117 | | | | pir:S74480 | | S74480 |

Description

| ORF Name | NTID | AAID | NT Length | AA Length | Score | Probability |
|---|---|---|---|---|---|---|
| 24237507_f1_28 | 2361 | 7583 | 396 | 1191 | 747 | 6.1e−74 |

| Protein name | | | | Locus Name | | Acc# |
|---|---|---|---|---|---|---|
| | | | | sp:GALM_ACICA | | P05149 |

Description

ALDOSE 1-EPIMERASE PRECURSOR, (MUTAROTASE)

| ORF Name | NTID | AAID | NT Length | AA Length | Score | Probability |
|---|---|---|---|---|---|---|
| 24242327_f3_143 | 2362 | 7584 | 173 | 522 | 140 | 1.3e−09 |

| Protein name | | | | Locus Name | | Acc# |
|---|---|---|---|---|---|---|
| | | | | sp:RFAY_XANCP | | P46358 |

Description

PROBABLE RNA POLYMERASE SIGMA FACTOR RFAY

| ORF Name | NTID | AAID | NT Length | AA Length | Score | Probability |
|---|---|---|---|---|---|---|
| 24253316_c3_239 | 2363 | 7585 | 209 | 630 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24260885_c1_153 | 2364 | 7586 | 480 | 1443 | 213 | 1.43-16 |

| Protein name | | | | Locus Name | | Acc# |
|---|---|---|---|---|---|---|
| vitellogenin | | | | gp:CHKVITB | | K02113 |

Description

*Gallus gallus* vitellogenin gene coding for phosvitin, exons 23 and 24.

-continued

| ORF Name | NTID | AAID | NT Length | AA Length | Score | Probability |
|---|---|---|---|---|---|---|
| 24298137_f2_65 | 2365 | 7587 | 66 | 201 | | |

| Protein name | | Locus Name | | Acc# |
|---|---|---|---|---|
| | | | | |

Description

NO-HIT

| ORF Name | NTID | AAID | NT Length | AA Length | Score | Probability |
|---|---|---|---|---|---|---|
| 24353377_f2_81 | 2366 | 7588 | 76 | 231 | 170 | 8.5e−13 |

| Protein name | | Locus Name | | Acc# |
|---|---|---|---|---|
| hypothetical protein TM1758 | | pir:G72214 | | G72214 |

Description

| ORF Name | NTID | AAID | NT Length | AA Length | Score | Probability |
|---|---|---|---|---|---|---|
| 24406536_f2_79 | 2367 | 7589 | 149 | 450 | 367 | 1.1e−33 |

| Protein name | | Locus Name | | Acc# |
|---|---|---|---|---|
| sugar-phosphate isomerase | | pir:H72296 | | H72296 |

Description

| ORF Name | NTID | AAID | NT Length | AA Length | Score | Probability |
|---|---|---|---|---|---|---|
| 24415877_c3_272 | 2368 | 7590 | 166 | 501 | 99 | 0.0018 |

| Protein name | | Locus Name | | Acc# |
|---|---|---|---|---|
| | | | | |

Description

HYPOTHETICAL PROTEIN HI0896

| ORF Name | NTID | AAID | NT Length | AA Length | Score | Probability |
|---|---|---|---|---|---|---|
| 24415888_c1_154 | 2369 | 7591 | 528 | 1587 | 69 | 0.0075 |

| Protein name | | Locus Name | | Acc# |
|---|---|---|---|---|
| outer membrane protein | | gp:HEAOMPP1B | | |

Description

*Haemophilus influenzae* outer membrane protein (OMPP1) gene, complete CDS.

| ORF Name | NTID | AAID | NT Length | AA Length | Score | Probability |
|---|---|---|---|---|---|---|
| 24645262_f3_109 | 2370 | 7592 | 375 | 1128 | 377 | 9.9e−35 |

| Protein name | | Locus Name | | Acc# |
|---|---|---|---|---|
| immunoreactive 42kD antigen PG33 | | gp:AF175715 | | AF175715 |

Description

*Porphyromonas gingivalis* strain W50 immunoreactive 42kD antigen PG33 gene, complete cds.

-continued

| ORF Name | NTID | AAID | NT Length | AA Length | Score | Probability |
|---|---|---|---|---|---|---|
| 24648563_c3_271 | 2371 | 7593 | 258 | 777 | 575 | 1.0e−55 |

| Protein name | Locus Name | Acc# |
|---|---|---|
| PksB | gp:AF019986 | AF019986 |

Description

*Dictyostelium discoideum* PksB (pksB) mRNA, complete cds.

| ORF Name | NTID | AAID | NT Length | AA Length | Score | Probability |
|---|---|---|---|---|---|---|
| 24692212_c1_187 | 2372 | 7594 | 293 | 882 | 940 | 2.2e−94 |

| Protein name | Locus Name | Acc# |
|---|---|---|
| sulfate adenylyltransferase, small chain:ATP-sulfurylase:sulfurylase | pir:D65056 | |

Description

| ORF Name | NTID | AAID | NT Length | AA Length | Score | Probability |
|---|---|---|---|---|---|---|
| 24890887_f2_89 | 2373 | 7595 | 75 | 228 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 25600262_c3_278 | 2374 | 7596 | 79 | 240 | 174 | 6.6e−13 |

| Protein name | Locus Name | Acc# |
|---|---|---|
| ATP sulfurylase small subunit | gp:AF035608 | AF035608 |

Description

*Pseudomonas aeruginosa* ATP sulfurylase small subunit (cysD) and ATP sulfurylase GTP-binding subunit/APS kinase (cysN) genes, complete cds.

| ORF Name | NTID | AAID | NT Length | AA Length | Score | Probability |
|---|---|---|---|---|---|---|
| 25792127_f3_124 | 2375 | 7597 | 84 | 255 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 26289761_c3_279 | 2376 | 7598 | 491 | 1476 | 1334 | 3.8e−136 |

| Protein name | Locus Name | Acc# |
|---|---|---|
| ATP sulfurylase GTP-binding subunit/APS kinase | gp:AF035608 | AF035608 |

Description

*Pseudomonas aeruginosa* ATP sulfurylase small subunit (cysD) and ATP sulfurylase GTP-binding subunit/APS kinase (cysN) genes, complete cds.

-continued

| ORF Name | NTID | AAID | NT Length | AA Length | Score | Probability |
|---|---|---|---|---|---|---|
| 26359760_c1_152 | 2377 | 7599 | 82 | 249 | 61 | 0.048 |

| Protein name | Locus Name | Acc# |
|---|---|---|
| | sp:COX3_PYLLI | Q37600 |

Description

CYTOCHROME C OXIDASE POLYPEPTIDE III,

| ORF Name | NTID | AAID | NT Length | AA Length | Score | Probability |
|---|---|---|---|---|---|---|
| 29298205_c2_237 | 2378 | 7600 | 145 | 438 | 202 | 3.5e−16 |

| Protein name | Locus Name | Acc# |
|---|---|---|
| hypothetical protein | pir:S76868 | S76868 |

Description

| ORF Name | NTID | AAID | NT Length | AA Length | Score | Probability |
|---|---|---|---|---|---|---|
| 29722915_f3_107 | 2379 | 7601 | 356 | 1071 | 1412 | 2.1e−144 |

| Protein name | Locus Name | Acc# |
|---|---|---|
| hypothetical protein | pir:JQ1020 | JQ1020 |

Description

| ORF Name | NTID | AAID | NT Length | AA Length | Score | Probability |
|---|---|---|---|---|---|---|
| 31878250_f3_147 | 2380 | 7602 | 185 | 558 | 396 | 9.6e−37 |

| Protein name | Locus Name | Acc# |
|---|---|---|
| conserved hypothetical protein yknA | pir:F69857 | F69857 |

Description

| ORF Name | NTID | AAID | NT Length | AA Length | Score | Probability |
|---|---|---|---|---|---|---|
| 32304817_f2_90 | 2381 | 7603 | 216 | 651 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 32422553_f1_31 | 2382 | 7604 | 659 | 1980 | 96 | 0.044 |

| Protein name | Locus Name | Acc# |
|---|---|---|
| | sp:YC8B_METJA | P81319 |

Description

HYPOTHETICAL PROTEIN MJ1282.2

-continued

| ORF Name | NTID | AAID | NT Length | AA Length | Score | Probability |
|---|---|---|---|---|---|---|
| 33476517_f1_30 | 2383 | 7605 | 369 | 1110 | 994 | 4.1e−100 |

| Protein name | Locus Name | Acc# |
|---|---|---|
| hypothetical protein TM1759 | pir:H72214 | H72214 |

Description

| ORF Name | NTID | AAID | NT Length | AA Length | Score | Probability |
|---|---|---|---|---|---|---|
| 34191425_f2_50 | 2384 | 7606 | 332 | 999 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 34242212_f3_145 | 2385 | 7607 | 153 | 462 | 92 | 0.039 |

| Protein name | Locus Name | Acc# |
|---|---|---|
| PfEMP1 fragment PFB1045w | pir:F71600 | F71600 |

Description

| ORF Name | NTID | AAID | NT Length | AA Length | Score | Probability |
|---|---|---|---|---|---|---|
| 34407937_f3_142 | 2386 | 7608 | 330 | 993 | 260 | 2.5e−22 |

| Protein name | Locus Name | Acc# |
|---|---|---|
| | sp:YISS_BACSU | |

Description

HYPOTHETICAL 37.5 KD PROTEIN IN DEGA-NPRB INTERGENIC REGION

| ORF Name | NTID | AAID | NT Length | AA Length | Score | Probability |
|---|---|---|---|---|---|---|
| 34609450_c3_242 | 2387 | 7609 | 376 | 1131 | 117 | 0.0016 |

| Protein name | Locus Name | Acc# |
|---|---|---|
| complement C7 | gp:AF162274 | AF162274 |

Description

*Sus scrofa* complement C7 mRNA, complete cds.

| ORF Name | NTID | AAID | NT Length | AA Length | Score | Probability |
|---|---|---|---|---|---|---|
| 36226562_c1_190 | 2388 | 7610 | 325 | 978 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 36604663_f1_27 | 2389 | 7611 | 411 | 1236 | 992 | 6.7e−100 |

| Protein name | | | | Locus Name | | Acc# |
|---|---|---|---|---|---|---|
| | | | | sp:RHLE_ECOLI | | P25888 |

Description

PUTATIVE ATP-DEPENDENT RNA HELICASE RHLE

| ORF Name | NTID | AAID | NT Length | AA Length | Score | Probability |
|---|---|---|---|---|---|---|
| 3917130_c3_268 | 2390 | 7612 | 332 | 999 | 488 | 1.7e−46 |

| Protein name | | | | Locus Name | | Acc# |
|---|---|---|---|---|---|---|
| mannose-6-phosphate isomersae homolog yjdE | | | | pir:H69848 | | H69848 |

Description

| ORF Name | NTID | AAID | NT Length | AA Length | Score | Probability |
|---|---|---|---|---|---|---|
| 4485917_f2_56 | 2395 | 7617 | 135 | 408 | 98 | 0.00035 |

| Protein name | | | | Locus Name | | Acc# |
|---|---|---|---|---|---|---|
| XylS/AraC family transcriptional regulatory | | | | gp:AF039207 | | AF039207 |

Description

*Listeria monocytogenes* putative transcriptional attenuator leader peptide (attM), LapA (lapA), XylS/AraC family transcriptional regulatory protein homolog (lapB), and NADH-dependent dehydrogenase homolog (lapC) genes, complete cds.

| ORF Name | NTID | AAID | NT Length | AA Length | Score | Probability |
|---|---|---|---|---|---|---|
| 4719011_c3_277 | 2396 | 7618 | 205 | 618 | 476 | 3.2e−45 |

| Protein name | | | | Locus Name | | Acc# |
|---|---|---|---|---|---|---|
| | | | | sp:NODQ_AZOBR | | P28604 |

Description

SULFURYLASE) (NODULATION PROTEIN Q)

| ORF Name | NTID | AAID | NT Length | AA Length | Score | Probability |
|---|---|---|---|---|---|---|
| 4722176_f3_121 | 2397 | 7619 | 898 | 2697 | 367 | 4.0e−85 |

| Protein name | | | | Locus Name | | Acc# |
|---|---|---|---|---|---|---|
| | | | | sp:BGAL_THEET | | P77989 |

Description

BETA-GALACTOSIDASE, (LACTASE)

| ORF Name | NTID | AAID | NT Length | AA Length | Score | Probability |
|---|---|---|---|---|---|---|
| 4867167_c1_198 | 2398 | 7620 | 418 | 1257 | | |

| Protein name | | | | Locus Name | | Acc# |
|---|---|---|---|---|---|---|

Description

NO-HIT

-continued

| ORF Name | NTID | AAID | NT Length | AA Length | Score | Probability |
|---|---|---|---|---|---|---|
| 5259437_c3_287 | 2399 | 7621 | 253 | 762 | 106 | 0.00070 |

| Protein name | Locus Name | Acc# |
|---|---|---|
| otnG protein | pir:S70954 | S70954 |

Description

| ORF Name | NTID | AAID | NT Length | AA Length | Score | Probability |
|---|---|---|---|---|---|---|
| 5273312_f3_128 | 2400 | 7622 | 73 | 222 | 81 | 0.0035 |

| Protein name | Locus Name | Acc# |
|---|---|---|
| gas vesicle protein GvpP | gp:AF053765 | AF053765 |

Description

*Bacillus megaterium* Arac (araC) gene, partial cds; gas vesicle proteins GvpU (gvpu), GvpT (gvpT), GvpJ (gvpJ), GvpK (gvpK), GvpS (gvpS), GvpL (gvpL), GvpG (gvpG), GvpF (gvpF), GvpN (gvpN), GvpR (gvpR), GvpB (gvpB), GvpQ (gvpQ), GvpP (gvpP), and GvpA (gvpA) genes, complete cds; and unknown gene.

| ORF Name | NTID | AAID | NT Length | AA Length | Score | Probability |
|---|---|---|---|---|---|---|
| 5284453_c2_202 | 2401 | 7623 | 138 | 417 | 114 | 1.2e-06 |

| Protein name | Locus Name | Acc# |
|---|---|---|
| hypothetical protein (eggshell protein gene region) | pir:D44805 | D44805 |

Description

| ORF Name | NTID | AAID | NT Length | AA Length | Score | Probability |
|---|---|---|---|---|---|---|
| 6143800_c1_189 | 2402 | 7624 | 390 | 1173 | 393 | 2.0e-36 |

| Protein name | Locus Name | Acc# |
|---|---|---|
|  | sp:YU43_MYCTU | Q50695 |

Description

HYPOTHETICAL 46.1 KD PROTEIN CY339.43

| ORF Name | NTID | AAID | NT Length | AA Length | Score | Probability |
|---|---|---|---|---|---|---|
| 6381932_f2_53 | 2403 | 7625 | 269 | 810 |  |  |

| Protein name | Locus Name | Acc# |
|---|---|---|
|  |  |  |

Description

NO-HIT

| ORF Name | NTID | AAID | NT Length | AA Length | Score | Probability |
|---|---|---|---|---|---|---|
| 6647927_f1_36 | 2404 | 7626 | 64 | 195 |  |  |

| Protein name | Locus Name | Acc# |
|---|---|---|
|  |  |  |

Description

NO-HIT

-continued

| ORF Name | NTID | AAID | NT Length | AA Length | Score | Probability |
|---|---|---|---|---|---|---|
| 6851562_f2_83 | 2405 | 7627 | 257 | 774 | 633 | 7.3e−62 |

| Protein name | Locus Name | Acc# |
|---|---|---|
| 2-oxoacid - - ferredoxin oxidorectuctase, beta chain:2-oxoisovalerate oxidoreductase alpha chain (midentification) | pir:B69194 | B69194 |

Description

| ORF Name | NTID | AAID | NT Length | AA Length | Score | Probability |
|---|---|---|---|---|---|---|
| 687_c2_234 | 2406 | 7628 | 410 | 1233 | 389 | 5.3e−36 |

| Protein name | Locus Name | Acc# |
|---|---|---|
| integrase | gp:BFU75371 | U75371 |

Description

*Bacteroides fragilis* transposon Tn4555 TnpA (tnpA), integrase (int), TnpC (tnpC), excisionase (xis), mobilization protein (mobA) ,and beta-lactamase (cfxA) genes, complete cds; and unknown genes.

| ORF Name | NTID | AAID | NT Length | AA Length | Score | Probability |
|---|---|---|---|---|---|---|
| 9782302_f1_43 | 2407 | 7629 | 83 | 252 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 10369011_f3_154 | 2408 | 7630 | 283 | 852 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 1057958_f2_73 | 2409 | 7631 | 188 | 567 | 212 | 3.0e−17 |

| Protein name | Locus Name | Acc# |
|---|---|---|
| sensory transduction system regulatory protein slr1982:protein slr1982:protein slr1982 | pir:S75663 | S75663 |

Description

| ORF Name | NTID | AAID | NT Length | AA Length | Score | Probability |
|---|---|---|---|---|---|---|
| 1176517_f1_52 | 2410 | 7632 | 66 | 201 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 12343962_f2_59 | 2411 | 7633 | 742 | 2229 | 156 | 1.1e−06 |

| Protein name | Locus Name | Acc# |
|---|---|---|
| hypothetical protein | pir:C72351 | C72351 |

Description

| ORF Name | NTID | AAID | NT Length | AA Length | Score | Probability |
|---|---|---|---|---|---|---|
| 13787952_f1_53 | 2412 | 7634 | 312 | 939 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 13861037_f1_46 | 2413 | 7635 | 156 | 471 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 13865891_c2_277 | 2414 | 7636 | 428 | 1287 | 712 | 3.1e−70 |

| Protein name | Locus Name | Acc# |
|---|---|---|
| | sp:BIOF_BACSH | P22806 |

Description

LIGASE)

| ORF Name | NTID | AAID | NT Length | AA Length | Score | Probability |
|---|---|---|---|---|---|---|
| 13882887_f1_44 | 2415 | 7637 | 146 | 441 | 155 | 3.3e−11 |

| Protein name | Locus Name | Acc# |
|---|---|---|
| hypothetical protein | gp:AF158372 | AF158372 |

Description

*Flavobacterium johnsoniae* hypothetical protein gene, partial cds; GldB (gldB), GldC (gldC), and hypothetical protein genes, complete cds; and hypothetical protein gene, partial cds.

| ORF Name | NTID | AAID | NT Length | AA Length | Score | Probability |
|---|---|---|---|---|---|---|
| 14459637_f1_49 | 2416 | 7638 | 605 | 1818 | 207 | 4.3e−14 |

| Protein name | Locus Name | Acc# |
|---|---|---|
| hypothetical protein | gp:AF158372 | AF158372 |

Description

*Flavobacterium johnsoniae* hypothetical protein gene, partial cds; GldB (gldB), GldC (gldC), and hypothetical protein genes, complete cds; and hypothetical protein gene, partial cds.

-continued

| ORF Name | NTID | AAID | NT Length | AA Length | Score | Probability |
|---|---|---|---|---|---|---|
| 14492062_f3_147 | 2417 | 7639 | 143 | 432 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 14564003_f2_71 | 2418 | 7640 | 290 | 873 | 140 | 4.2e−07 |

| Protein name | | | Locus Name | | | Acc# |
|---|---|---|---|---|---|---|
| MigA | | | gp:PAU70729 | | | U70729 |

Description

*Pseudomonas aeruginosa* MigA (migA) gene, complete cds.

| ORF Name | NTID | AAID | NT Length | AA Length | Score | Probability |
|---|---|---|---|---|---|---|
| 14631406_f1_14 | 2419 | 7641 | 322 | 969 | 257 | 2.6e−25 |

| Protein name | | | Locus Name | | | Acc# |
|---|---|---|---|---|---|---|
| glycosyltransferase | | | gp:AF146532 | | | AF146532 |

Description

*Klebsiella pneumoniae* waa gene cluster.

| ORF Name | NTID | AAID | NT Length | AA Length | Score | Probability |
|---|---|---|---|---|---|---|
| 14642175_f1_38 | 2420 | 7642 | 1035 | 3108 | 96 | 4.2e−07 |

| Protein name | | | Locus Name | | | Acc# |
|---|---|---|---|---|---|---|
| DNA helicase homolog | | | pir:G69494 | | | G69494 |

Description

| ORF Name | NTID | AAID | NT Length | AA Length | Score | Probability |
|---|---|---|---|---|---|---|
| 14646926_f3_144 | 2421 | 7643 | 141 | 426 | 175 | 2.5e−13 |

| Protein name | | | Locus Name | | | Acc# |
|---|---|---|---|---|---|---|
| hypothetical protein | | | gp:AF158372 | | | AF158372 |

Description

*Flavobacterium johnsoniae* hypothetical protein gene, partial cds; GldB (gldB), GldC (gldC), and hypothetical protein genes, complete cds; and hypothetical protein gene, partial cds.

| ORF Name | NTID | AAID | NT Length | AA Length | Score | Probability |
|---|---|---|---|---|---|---|
| 14651638_f2_68 | 2422 | 7644 | 120 | 363 | | |

| Protein name | | | Locus Name | | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 1550_f2_88 | 2423 | 7645 | 259 | 780 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 15761062_c2_283 | 2424 | 7646 | 72 | 219 | 209 | 1.2e−16 |

| Protein name | | | Locus Name | | | Acc# |
|---|---|---|---|---|---|---|
| integrase | | | gp:D50438 | | | D50438 |

Description

*Serratia marcescens* DNA tor integrase,
metallo-bata-lactamase, aminoglycoside acetyltransferase, complete cds.

| ORF Name | NTID | AAID | NT Length | AA Length | Score | Probability |
|---|---|---|---|---|---|---|
| 16100927_c1_194 | 2425 | 7647 | 280 | 843 | 109 | 0.00011 |

| Protein name | | | Locus Name | | | Acc# |
|---|---|---|---|---|---|---|
| | | | sp:YBEU_ECOLI | | | P77427 |

Description

HYPOTHETICAL 27.0 KD PROTEIN IN LEUS-GLTL INTERGENIC REGION

| ORF Name | NTID | AAID | NT Length | AA Length | Score | Probability |
|---|---|---|---|---|---|---|
| 16603377_f1_51 | 2426 | 7648 | 326 | 981 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 194765_c3_348 | 2427 | 7649 | 135 | 408 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 19695302_f2_58 | 2428 | 7650 | 293 | 882 | | |

| Protein name | | | Locus Name | | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 20026537_c1_190 | 2429 | 7651 | 330 | 993 | 297 | 3.0e−26 |

| Protein name | Locus Name | Acc# |
|---|---|---|
| | sp:Y4QK_RHISN | P55632 |

Description

PUTATIVE INTEGRASE/RECOMBINASE Y4QK

| ORF Name | NTID | AAID | NT Length | AA Length | Score | Probability |
|---|---|---|---|---|---|---|
| 20705385_c2_281 | 2430 | 7652 | 227 | 684 | 110 | 0.00019 |

| Protein name | Locus Name | Acc# |
|---|---|---|
| LanK | gp:AF080235 | AF080235 |

Description

*Streptomyces cyanogenus* landomycin biosynthetic gene cluster, complete sequence.

| ORF Name | NTID | AAID | NT Length | AA Length | Score | Probability |
|---|---|---|---|---|---|---|
| 20912537_f3_151 | 2431 | 7653 | 235 | 708 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 20953211_f3_124 | 2432 | 7654 | 251 | 756 | 136 | 9.7e−07 |

| Protein name | Locus Name | Acc# |
|---|---|---|
| hypothetical protein | pir:F75494 | F75494 |

Description

| ORF Name | NTID | AAID | NT Length | AA Length | Score | Probability |
|---|---|---|---|---|---|---|
| 212762_f1_43 | 2433 | 7655 | 828 | 2487 | 827 | 4.1e−145 |

| Protein name | Locus Name | Acc# |
|---|---|---|
| ClpB | gp:AB012390 | AB012390 |

Description

*Thermus thermophilus* genes for DnaK, GrpE, DnaJ, DafA, ClpB, complete cds.

| ORF Name | NTID | AAID | NT Length | AA Length | Score | Probability |
|---|---|---|---|---|---|---|
| 21507765_c3_369 | 2434 | 7656 | 76 | 231 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 23547157_c2_286 | 2435 | 7657 | 162 | 489 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 23632793_c1_189 | 2436 | 7658 | 87 | 264 | 72 | 0.048 |

| Protein name | | | | Locus Name | | Acc# |
|---|---|---|---|---|---|---|
| ubiquinone biosynthesis protein coq7 (coq7) RP190 | | | | pir:A71730 | | A71730 |

Description

| ORF Name | NTID | AAID | NT Length | AA Length | Score | Probability |
|---|---|---|---|---|---|---|
| 24063450_f3_101 | 2437 | 7659 | 419 | 1260 | 115 | 0.0028 |

| Protein name | | | | Locus Name | | Acc# |
|---|---|---|---|---|---|---|
| outer membrane protein | | | | pir:C70412 | | C70412 |

Description

| ORF Name | NTID | AAID | NT Length | AA Length | Score | Probability |
|---|---|---|---|---|---|---|
| 24065927_f2_90 | 2438 | 7660 | 293 | 882 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24257700_c3_353 | 2439 | 7661 | 584 | 1755 | 1657 | 2.3e−170 |

| Protein name | | | | Locus Name | | Acc# |
|---|---|---|---|---|---|---|
| | | | | sp:YJJK_ECOLI | | P37797 |

Description

ABC TRANSPORTER APT-BINDING PROTEIN YJJK

| ORF Name | NTID | AAID | NT Length | AA Length | Score | Probability |
|---|---|---|---|---|---|---|
| 24258437_f3_103 | 2440 | 7662 | 306 | 921 | 271 | 5.1e−32 |

| Protein name | | | | Locus Name | | Acc# |
|---|---|---|---|---|---|---|
| rhamnosyl transferase related protein PAB0795 | | | | pir:F75099 | | F75099 |

Description

-continued

| ORF Name | NTID | AAID | NT Length | AA Length | Score | Probability |
|---|---|---|---|---|---|---|
| 24398442_f1_45 | 2441 | 7663 | 152 | 459 | 94 | 0.00014 |

| Protein name | Locus Name | Acc# |
|---|---|---|
| hypothetical protein | gp:AF158372 | AF158372 |

Description

*Flavobacterium johnsoniae* hypothetical protein gene, partial cds; GldB (gldB), GldC (gldC), and hypothetical protein genes, complete cds; and hypothetical protein gene, partial cds.

| ORF Name | NTID | AAID | NT Length | AA Length | Score | Probability |
|---|---|---|---|---|---|---|
| 24407563_f3_155 | 2442 | 7664 | 389 | 1170 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24640881_f1_24 | 2443 | 7665 | 408 | 1227 | 210 | 1.2e−14 |

| Protein name | Locus Name | Acc# |
|---|---|---|
| hyaluronan synthase related PAB1314 | pir:G75005 | G75005 |

Description

| ORF Name | NTID | AAID | NT Length | AA Length | Score | Probability |
|---|---|---|---|---|---|---|
| 24640952_c1_193 | 2444 | 7666 | 152 | 459 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24843877_f3_148 | 2445 | 7667 | 150 | 453 | 77 | 0.024 |

| Protein name | Locus Name | Acc# |
|---|---|---|
| | gP:AB030825 | AB030825 |

Description

*Pseudomonas aeruginosa* genomic DNA, partial sequence, strain:PAO1.

| ORF Name | NTID | AAID | NT Length | AA Length | Score | Probability |
|---|---|---|---|---|---|---|
| 25584626_c1_191 | 2446 | 7668 | 132 | 399 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 25906913_f3_104 | 2447 | 7669 | 437 | 1314 | 184 | 3.3e−11 |
| Protein name | | | Locus Name | | | Acc# |
| | | | gP:PWQRRMP | | | L39794 |

Description

Plasmid pWQ799 RNAII and RNAI genes, complete sequence; RNAI modulator protein (Rom), mobilization proteins (mbeC, mbeA, mbeB, and mbeD), N-acetylmannosamine transferase (wbbE), wbbF, and UDP-N-acetylglucosamine 2-epimerase (wecB) genes, complete cds.

| ORF Name | NTID | AAID | NT Length | AA Length | Score | Probability |
|---|---|---|---|---|---|---|
| 2929813_c2_306 | 2448 | 7670 | 93 | 282 | 66 | 0.035 |
| Protein name | | | Locus Name | | | Acc# |
| plasma membrane protein | | | pir:T03680 | | | T03680 |

Description

| ORF Name | NTID | AAID | NT Length | AA Length | Score | Probability |
|---|---|---|---|---|---|---|
| 29479667_f1_34 | 2449 | 7671 | 100 | 303 | | |
| Protein name | | | Locus Name | | | Acc# |

Description

NO-HIT

| ORF Name | NTID | AAID | NT Length | AA Length | Score | Probability |
|---|---|---|---|---|---|---|
| 29820341_f3_102 | 2450 | 7672 | 467 | 1404 | 116 | 0.0010 |
| Protein name | | | Locus Name | | | Acc# |
| | | | sp:RFC_SALMU | | | Q00474 |

Description

O-ANTIGEN POLYMERASE

| ORF Name | NTID | AAID | NT Length | AA Length | Score | Probability |
|---|---|---|---|---|---|---|
| 32225307_c3_350 | 2451 | 7673 | 149 | 450 | | |
| Protein name | | | Locus Name | | | Acc# |

Description

NO-HIT

| ORF Name | NTID | AAID | NT Length | AA Length | Score | Probability |
|---|---|---|---|---|---|---|
| 32698450_f3_153 | 2452 | 7674 | 269 | 810 | 197 | 1.2e−15 |
| Protein name | | | Locus Name | | | Acc# |
| outer membrane protein mom72, 72K:hypothetical protein sll1667:hypothetical protein sll1667 | | | pir:S74665 | | | S74665 |

Description

-continued

| ORF Name | NTID | AAID | NT Length | AA Length | Score | Probability |
|---|---|---|---|---|---|---|
| 33400252_c2_290 | 2453 | 7675 | 632 | 1899 | 82 | 0.028 |

| Protein name | Locus Name | Acc# |
|---|---|---|
| MHC class II protein | gp:AF030872 | AF030872 |

Description

*Poeciliopsis occidentalis occidentalis* MHC class II protein gene, partial exon II, and partial cds.

| ORF Name | NTID | AAID | NT Length | AA Length | Score | Probability |
|---|---|---|---|---|---|---|
| 34022837_f1_42 | 2454 | 7676 | 464 | 1395 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 34164777_f1_25 | 2455 | 7677 | 801 | 2406 | 390 | 2.4e−36 |

| Protein name | Locus Name | Acc# |
|---|---|---|
| sensory transduction histidine kinase slr2104:protein slr2104:protein slr2104 | pir:S75136 | S75136 |

Description

| ORF Name | NTID | AAID | NT Length | AA Length | Score | Probability |
|---|---|---|---|---|---|---|
| 34179562_f1_41 | 2456 | 7678 | 154 | 465 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 34569676_c3_354 | 2457 | 7679 | 934 | 2805 | 178 | 1.5e−10 |

| Protein name | Locus Name | Acc# |
|---|---|---|
| 115K outer membrane protein precursor:SusC protein | pir:JC6027 | JC6027 |

Description

| ORF Name | NTID | AAID | NT Length | AA Length | Score | Probability |
|---|---|---|---|---|---|---|
| 35156933_c1_192 | 2458 | 7680 | 84 | 255 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 35188568_f1_13 | 2459 | 7681 | 72 | 219 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 35351502_f1_54 | 2460 | 7682 | 495 | 1488 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 39660_f3_152 | 2461 | 7683 | 262 | 789 | 292 | 1.0e−25 |

| Protein name | | | | Locus Name | | Acc# |
|---|---|---|---|---|---|---|
| outer membrane protein mom72, 72K:hypothetical protein sll1667:hypothetical protein sll1667 | | | | pir:S74665 | | S74665 |

Description

| ORF Name | NTID | AAID | NT Length | AA Length | Score | Probability |
|---|---|---|---|---|---|---|
| 3984442_f2_84 | 2462 | 7684 | 60 | 183 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 4100635_f1_50 | 2463 | 7685 | 771 | 2316 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 4109715_f1_56 | 2464 | 7686 | 321 | 966 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 4110211_f1_21 | 2465 | 7687 | 307 | 924 | | |

| Protein name | | | | Locus Name | | Acc# |
|---|---|---|---|---|---|---|

Description

NO-HIT

-continued

| ORF Name | NTID | AAID | NT Length | AA Length | Score | Probability |
|---|---|---|---|---|---|---|
| 4119010_c2_285 | 2466 | 7688 | 158 | 477 | 97 | 0.0046 |
| Protein name | | | Locus Name | | | Acc# |
| ABC transporter protein | | | gp:CJAJ0856 | | | AJ000856 |
| Description | | | | | | |

*Campylobacter jejuni* kpsM, kpsT genes.

| ORF Name | NTID | AAID | NT Length | AA Length | Score | Probability |
|---|---|---|---|---|---|---|
| 4566502_f1_33 | 2467 | 7689 | 106 | 321 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 4798388_f3_141 | 2468 | 7690 | 64 | 195 | 114 | 7.3e−07 |
| Protein name | | | Locus Name | | | Acc# |
| hypothetical protein MTH1606 | | | pir:E69081 | | | E69081 |
| Description | | | | | | |

| ORF Name | NTID | AAID | NT Length | AA Length | Score | Probability |
|---|---|---|---|---|---|---|
| 4884686_c2_284 | 2469 | 7691 | 287 | 864 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 5339133_c3_367 | 2470 | 7692 | 65 | 198 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 6338916_f3_157 | 2471 | 7692 | 112 | 336 | | |
| Protein name | | | Locus Name | | | Acc# |
| Description | | | | | | |

NO-HIT

-continued

| ORF Name | NTID | AAID | NT Length | AA Length | Score | Probability |
|---|---|---|---|---|---|---|
| 644125_c2_309 | 2472 | 7694 | 104 | 315 | 87 | 0.00083 |

| Protein name | Locus Name | Acc# |
|---|---|---|
| | sp:INVA_BARBA | P35640 |

Description

INVASION PROTEIN A

| ORF Name | NTID | AAID | NT Length | AA Length | Score | Probability |
|---|---|---|---|---|---|---|
| 6814062_f2_70 | 2473 | 7695 | 1248 | 3747 | 423 | 2.7e−38 |

| Protein name | Locus Name | Acc# |
|---|---|---|
| biosynthesis of teichuronic acid tuaB | pir:D69727 | D69727 |

Description

| ORF Name | NTID | AAID | NT Length | AA Length | Score | Probability |
|---|---|---|---|---|---|---|
| 6851660_f2_96 | 2474 | 7696 | 70 | 213 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 6923378_f3_150 | 2475 | 7697 | 488 | 1467 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 85901_c3_366 | 2476 | 7698 | 119 | 360 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 915912_f3_143 | 2477 | 7699 | 130 | 393 | 194 | 2.4e−15 |

| Protein name | Locus Name | Acc# |
|---|---|---|
| hypothetical protein | gp:AF158372 | AF158372 |

Description

*Flavobacterium johnsoniae* hypothetical protein gene, partial cds; GldB (gldB), GldC (gldC), and hypothetical protein genes, complete cds; and hypothetical protein gene, partial cds.

-continued

| ORF Name | NTID | AAID | NT Length | AA Length | Score | Probability |
|---|---|---|---|---|---|---|
| 975262_f3_149 | 2478 | 7700 | 611 | 1836 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 979137_f1_26 | 2479 | 7701 | 183 | 552 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 9959463_f3_146 | 2480 | 7702 | 331 | 996 | 150 | 9.7e−07 |
| Protein name | | | Locus Name | | | Acc# |
| serine/threonine specific protein kinase, PFB0150c | | | pir:H71621 | | | H71621 |
| Description | | | | | | |

| ORF Name | NTID | AAID | NT Length | AA Length | Score | Probability |
|---|---|---|---|---|---|---|
| 2350306_f3_12 | 2481 | 7703 | 100 | 303 | 105 | 6.6e−06 |
| Protein name | | | Locus Name | | | Acc# |
| hypothetical protein PH0217 | | | pir:G71244 | | | G71244 |
| Description | | | | | | |

| ORF Name | NTID | AAID | NT Length | AA Length | Score | Probability |
|---|---|---|---|---|---|---|
| 24335131_f2_8 | 2482 | 7704 | 63 | 192 | 106 | 5.1e−06 |
| Protein name | | | Locus Name | | | Acc# |
| hypothetical protein PH0219 | | | pir:A71245 | | | A71245 |
| Description | | | | | | |

| ORF Name | NTID | AAID | NT Length | AA Length | Score | Probability |
|---|---|---|---|---|---|---|
| 31539640_c1_14 | 2483 | 7705 | 62 | 189 | | |
| Protein name | | | Locus Name | | | Acc# |
| Description | | | | | | |
| NO-HIT | | | | | | |

-continued

| ORF Name | NTID | AAID | NT Length | AA Length | Score | Probability |
|---|---|---|---|---|---|---|
| 11756280_f2_12 | 2484 | 7706 | 667 | 2004 | 1546 | 1.3e−158 |

| Protein name | Locus Name | Acc# |
|---|---|---|
| | gP:CEY51H4A | AL132952 |

Description

*Caenorhabditis elegans* cosmid Y51H4A, complete sequence.

| ORF Name | NTID | AAID | NT Length | AA Length | Score | Probability |
|---|---|---|---|---|---|---|
| 1198528_c1_58 | 2485 | 7707 | 81 | 246 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 1203442_f2_15 | 2486 | 7708 | 211 | 636 | 364 | 2.4e−33 |

| Protein name | Locus Name | Acc# |
|---|---|---|
| | sp:SCE4_METEX | Q49135 |

Description

PUTATIVE SERINE CYCLE ENZYME (ORF4)

| ORF Name | NTID | AAID | NT Length | AA Length | Score | Probability |
|---|---|---|---|---|---|---|
| 12673767_f1_3 | 2487 | 7709 | 327 | 984 | 510 | 7.9e−49 |

| Protein name | Locus Name | Acc# |
|---|---|---|
| histidine ammonia-lyase | pir:F75610 | F75610 |

Description

| ORF Name | NTID | AAID | NT Length | AA Length | Score | Probability |
|---|---|---|---|---|---|---|
| 12947255_f1_1 | 2488 | 7710 | 309 | 930 | 855 | 2.2e−85 |

| Protein name | Locus Name | Acc# |
|---|---|---|
| hypothetical protein TM0843 | pir:D72326 | D72326 |

Description

| ORF Name | NTID | AAID | NT Length | AA Length | Score | Probability |
|---|---|---|---|---|---|---|
| 21680317_f3_40 | 2489 | 7711 | 102 | 309 | 73 | 0.016 |

| Protein name | Locus Name | Acc# |
|---|---|---|
| hypothetical protein aq_862 | pir:F70374 | F70374 |

Description

-continued

| ORF Name | NTID | AAID | NT Length | AA Length | Score | Probability |
|---|---|---|---|---|---|---|
| 21932163_f3_45 | 2490 | 7712 | 75 | 228 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 2350306_c2_69 | 2491 | 7713 | 100 | 303 | 111 | 1.5e−06 |

| Protein name | Locus Name | Acc# |
|---|---|---|
| hypothetical protein PH0217 | pir:G71244 | G71244 |

Description

| ORF Name | NTID | AAID | NT Length | AA Length | Score | Probability |
|---|---|---|---|---|---|---|
| 24431500_f3_42 | 2492 | 7714 | 310 | 933 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24804561_f1_5 | 2493 | 7715 | 220 | 663 | 122 | 4.7e−06 |

| Protein name | Locus Name | Acc# |
|---|---|---|
| probable transcription regulator | pir:T29062 | T29062 |

Description

| ORF Name | NTID | AAID | NT Length | AA Length | Score | Probability |
|---|---|---|---|---|---|---|
| 25813300_f3_39 | 2494 | 7716 | 1021 | 3066 | 1244 | 1.3e−1126 |

| Protein name | Locus Name | Acc# |
|---|---|---|
| acriflavine resistance protein (acrB) | gp:AE001125 | |

Description

*Borrelia burgdorferi* (sectin 11 of 70) of the complete genome.

| ORF Name | NTID | AAID | NT Length | AA Length | Score | Probability |
|---|---|---|---|---|---|---|
| 26204716_f2_18 | 2495 | 7717 | 64 | 195 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 33398568_c3_101 | 2496 | 7718 | 75 | 228 | 61 | 0.44 |

| Protein name | Locus Name | Acc# |
|---|---|---|
| MADS box-like protein | gp:AB003323 | AB003323 |

Description

*Oryza sativa* mRNA for MADS box-like protein, complete cds, clone:E20969.

| ORF Name | NTID | AAID | NT Length | AA Length | Score | Probability |
|---|---|---|---|---|---|---|
| 34409692_f1_2 | 2497 | 7719 | 419 | 1260 | 847 | 1.5e−84 |

| Protein name | Locus Name | Acc# |
|---|---|---|
|  | sp:HUTI_BACSU | P42084 |

Description

HYDROLASE)

| ORF Name | NTID | AAID | NT Length | AA Length | Score | Probability |
|---|---|---|---|---|---|---|
| 34651386_f2_24 | 2498 | 7720 | 489 | 1470 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 3916638_f3_30 | 2499 | 7721 | 213 | 642 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 4103137_f1_6 | 2500 | 7722 | 309 | 930 | 200 | 6.7e−18 |

| Protein name | Locus Name | Acc# |
|---|---|---|
| hypothetical protein sll0141 | pir:S76434 | S76434 |

Description

| ORF Name | NTID | AAID | NT Length | AA Length | Score | Probability |
|---|---|---|---|---|---|---|
| 4141887_f3_38 | 2501 | 7723 | 453 | 1362 | 840 | 8.5e−84 |

| Protein name | Locus Name | Acc# |
|---|---|---|
| immunoreactive 52kD antigen PG41 | gp:AF175716 | AF175716 |

Description

*Porphyromonas gingivalis* strain W50 immunoreactive 52kD antigen PG41 gene, complete cds.

-continued

| ORF Name | NTID | AAID | NT Length | AA Length | Score | Probability |
|---|---|---|---|---|---|---|
| 4422500_f3_37 | 2502 | 7724 | 159 | 480 | 308 | 1.4e−26 |
| Protein name | | | | Locus Name | | Acc# |
| | | | | sp:HUTH_HUMAN | | P42357 |

Description

HISTIDINE AMMONIA-LYASE, (HISTIDASE)

| ORF Name | NTID | AAID | NT Length | AA Length | Score | Probability |
|---|---|---|---|---|---|---|
| 5331665_f1_9 | 2503 | 7725 | 525 | 1578 | 745 | 1.1e−77 |
| Protein name | | | | Locus Name | | Acc# |
| AlgI | | | | gp:AF027499 | | AF027499 |

Description

*Azotobacter vinelandii* mannuronan C-5-epimerase (algG) gene, partial cds; and AlgX, alginate lyase (algL), AlgI, and AlgV genes, complete cds.

| ORF Name | NTID | AAID | NT Length | AA Length | Score | Probability |
|---|---|---|---|---|---|---|
| 7057792_f2_19 | 2504 | 7726 | 63 | 192 | 88 | 0.0036 |
| Protein name | | | | Locus Name | | Acc# |
| | | | | gp:D85752 | | D85752 |

Description

*Enterococcus faecalis* plasmid pPD1 bacA, bacB, bacC, bacD, bacE, bacF, bacG, bacH and bad genes, complete cds.

| ORF Name | NTID | AAID | NT Length | AA Length | Score | Probability |
|---|---|---|---|---|---|---|
| 14664052_c1_25 | 2505 | 7727 | 197 | 594 | 217 | 8.9e−18 |
| Protein name | | | | Locus Name | | Acc# |
| RNA polymerase sigma factor SigZ-like protein | | | | gp:AF137263 | | AF137263 |

Description

Bacteroides thetaiotaomicron 30S ribosomal protein S16-like protein, fucose gene cluster, and RNA polymerase sigma factor SigZ-like protein (sigZ) genes, complete cds.

| ORF Name | NTID | AAID | NT Length | AA Length | Score | Probability |
|---|---|---|---|---|---|---|
| 23495336_c1_24 | 2506 | 7728 | 77 | 234 | | |
| Protein name | | | | Locus Name | | Acc# |

Description

NO-HIT

| ORF Name | NTID | AAID | NT Length | AA Length | Score | Probability |
|---|---|---|---|---|---|---|
| 24035707_c1_27 | 2507 | 7729 | 811 | 2436 | 515 | 5.2e−46 |
| Protein name | | | | Locus Name | | Acc# |
| 115K outer membrane protein precursor:SusC protein | | | | pir:JC6027 | | JC6027 |

Description

-continued

| ORF Name | NTID | AAID | NT Length | AA Length | Score | Probability |
|---|---|---|---|---|---|---|
| 29296910_c1_26 | 2508 | 7730 | 346 | 1041 | 113 | 0.00087 |

| Protein name | Locus Name | Acc# |
|---|---|---|
|  | sp:FECR_ECOLI | P23485 |

Description

FECR PROTEIN

| ORF Name | NTID | AAID | NT Length | AA Length | Score | Probability |
|---|---|---|---|---|---|---|
| 35328313_c2_31 | 2509 | 7731 | 381 | 1146 | 328 | 2.6e−28 |

| Protein name | Locus Name | Acc# |
|---|---|---|
| receptor antigen (RagA) | gp:PGI130872 | AJ130872 |

Description

*Porphyromonas gingivalis* W50 receptor antigen (rag) locus encoding a major immunodominant 55 kDa antigen.

| ORF Name | NTID | AAID | NT Length | AA Length | Score | Probability |
|---|---|---|---|---|---|---|
| 3906250_f2_14 | 2510 | 7732 | 167 | 504 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 3947287_c3_38 | 2511 | 7733 | 95 | 285 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 10250001_c2_207 | 2512 | 7734 | 109 | 330 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 10735692_f1_26 | 2513 | 7735 | 431 | 1296 | 967 | 3.0e−97 |

| Protein name | Locus Name | Acc# |
|---|---|---|
|  | sp:PUR2_HAEIN | P43845 |

Description

RIBONUCLEOTIDE SYNTHETASE) (PHOSPHORIBOSYLGLYCINAMIDE SYNTHETASE)

-continued

| ORF Name | NTID | AAID | NT Length | AA Length | Score | Probability |
|---|---|---|---|---|---|---|
| 10937551_c2_210 | 2514 | 7736 | 246 | 741 | 94 | 0.036 |

| Protein name | | | Locus Name | | Acc# | |
|---|---|---|---|---|---|---|
| DNA alkylation repair enzyme | | | gp:BAJ10128 | | AJ10128 | |

Description

*Bacillus cereus* bc297a, alkD genes and partial glyS gene.

| ORF Name | NTID | AAID | NT Length | AA Length | Score | Probability |
|---|---|---|---|---|---|---|
| 11203138_c2_205 | 2515 | 7737 | 65 | 198 | 60 | 0.048 |

| Protein name | | | Locus Name | | Acc# | |
|---|---|---|---|---|---|---|
| alph 1,2 fucosyltransferase | | | gp:AF042743 | | AF042743 | |

Description

*Rattus norvegicus* alpha 1,2 fucosyltransferase mRNA, partial cds.

| ORF Name | NTID | AAID | NT Length | AA Length | Score | Probability |
|---|---|---|---|---|---|---|
| 1194632_c3_244 | 2516 | 7738 | 68 | 207 | | |

| Protein name | | | Locus Name | | Acc# | |
|---|---|---|---|---|---|---|

Description

NO-HIT

| ORF Name | NTID | AAID | NT Length | AA Length | Score | Probability |
|---|---|---|---|---|---|---|
| 12350205_f3_94 | 2517 | 7739 | 614 | 1845 | 1095 | 8.1e−111 |

| Protein name | | | Locus Name | | Acc# | |
|---|---|---|---|---|---|---|
| | | | sp:UVRC_BACSU | | P14951 | |

Description

EXCINUCLEASE ABC SUBUNIT C

| ORF Name | NTID | AAID | NT Length | AA Length | Score | Probability |
|---|---|---|---|---|---|---|
| 12542657_f3_111 | 2518 | 7740 | 288 | 867 | 533 | 2.9e−51 |

| Protein name | | | Locus Name | | Acc# | |
|---|---|---|---|---|---|---|
| ABC-type transport protein slr2044:protein slr2044:protein slr2044 | | | pir:S75197 | | S75197 | |

Description

| ORF Name | NTID | AAID | NT Length | AA Length | Score | Probability |
|---|---|---|---|---|---|---|
| 12973466_c1_168 | 2519 | 7741 | 530 | 1593 | 175 | 1.0e−16 |

| Protein name | | | Locus Name | | Acc# | |
|---|---|---|---|---|---|---|
| Cps2J | | | gP:AF026471 | | AF026471 | |

Description

*Streptococcus pneumoniae* DexB (dexB) gene, partial cds; putative transposase gene, complete cds; type 2 capsular polysaccharide biosynthesis operon, complete sequence; and AliA (aliA) gene, partial cds.

-continued

| ORF Name | NTID | AAID | NT Length | AA Length | Score | Probability |
|---|---|---|---|---|---|---|
| 16047502_f1_4 | 2520 | 7742 | 451 | 1356 | 434 | 9.0e−41 |

| Protein name | | | Locus Name | | | Acc# |
|---|---|---|---|---|---|---|
| spore maturation protein B:hypothetical protein sll1677:hypothetical protein sll1677 | | | pir:S74647 | | | S74647 |

Description

| ORF Name | NTID | AAID | NT Length | AA Length | Score | Probability |
|---|---|---|---|---|---|---|
| 16228385_f3_108 | 2521 | 7743 | 159 | 480 | 163 | 4.7e−12 |

| Protein name | | | Locus Name | | | Acc# |
|---|---|---|---|---|---|---|
| alkaline phosphatase homolog ykoX | | | pir:B69861 | | | B69861 |

Description

| ORF Name | NTID | AAID | NT Length | AA Length | Score | Probability |
|---|---|---|---|---|---|---|
| 16508444_c1_123 | 2522 | 7744 | 408 | 1227 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 20734688_c1_146 | 2523 | 7745 | 253 | 762 | 231 | 2.9e−19 |

| Protein name | | | Locus Name | | | Acc# |
|---|---|---|---|---|---|---|
| | | | sp:YEHT_ECOLI | | | |

Description

HYPOTHETICAL 27.9 KD PROTEIN IN MOLR-BGLX INTERGENIC REGION

| ORF Name | NTID | AAID | NT Length | AA Length | Score | Probability |
|---|---|---|---|---|---|---|
| 20798338_f1_27 | 2524 | 7746 | 245 | 738 | 86 | 0.0026 |

| Protein name | | | Locus Name | | | Acc# |
|---|---|---|---|---|---|---|
| orf98 | | | gp:AF160864 | | | AF160864 |

Description

*Tetrahymena pyriformis* mitochondrial DNA, complete genome.

| ORF Name | NTID | AAID | NT Length | AA Length | Score | Probability |
|---|---|---|---|---|---|---|
| 20882827_f1_34 | 2525 | 7747 | 1119 | 3360 | | |

| Protein name | | | Locus Name | | | Acc# |
|---|---|---|---|---|---|---|

Description

NO-HIT

-continued

| ORF Name | NTID | AAID | NT Length | AA Length | Score | Probability |
|---|---|---|---|---|---|---|
| 21907892_f2_67 | 2526 | 7748 | 305 | 918 | 175 | 2.2e−26 |
| Protein name | | | Locus Name | | | Acc# |
| conserved hypothetical protein | | | pir:C75368 | | | C75368 |
| Description | | | | | | |

| ORF Name | NTID | AAID | NT Length | AA Length | Score | Probability |
|---|---|---|---|---|---|---|
| 21991666_f1_28 | 2527 | 7749 | 323 | 972 | 498 | 1.5e−47 |
| Protein name | | | Locus Name | | | Acc# |
| adhesion protein | | | pir:C69180 | | | C69180 |
| Description | | | | | | |

| ORF Name | NTID | AAID | NT Length | AA Length | Score | Probability |
|---|---|---|---|---|---|---|
| 23477186_f1_14 | 2528 | 7750 | 243 | 732 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 23595331_c3_251 | 2529 | 7751 | 293 | 879 | 343 | 1.7e−30 |
| Protein name | | | Locus Name | | | Acc# |
| hypothetical protein sll1151 | | | pir:S74882 | | | S74882 |
| Description | | | | | | |

| ORF Name | NTID | AAID | NT Length | AA Length | Score | Probability |
|---|---|---|---|---|---|---|
| 23631937_f3_88 | 2530 | 7752 | 143 | 432 | 177 | 1.5e−13 |
| Protein name | | | Locus Name | | | Acc# |
| conserved hypothetical protein TP0650 | | | pir:A71300 | | | A71300 |
| Description | | | | | | |

| ORF Name | NTID | AAID | NT Length | AA Length | Score | Probability |
|---|---|---|---|---|---|---|
| 24259677_f3_101 | 2531 | 7753 | 120 | 363 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 24651660_c3_243 | 2532 | 7754 | 409 | 1230 | | |
| Protein name | | | Locus Name | | | Acc# |
| Description | | | | | | |
| NO-HIT | | | | | | |

-continued

| ORF Name | NTID | AAID | NT Length | AA Length | Score | Probability |
|---|---|---|---|---|---|---|
| 2516025_c1_126 | 2533 | 7755 | 405 | 1218 | | |
| Protein name | | | | Locus Name | | Acc# |
| Description | | | | | | |

NO-HIT

| ORF Name | NTID | AAID | NT Length | AA Length | Score | Probability |
|---|---|---|---|---|---|---|
| 26359436_f1_17 | 2534 | 7756 | 140 | 423 | 91 | 0.015 |
| Protein name | | | | Locus Name | | Acc# |
| | | | | gp:PFMAL3P8 | | |
| Description | | | | | | |

*Plasmodium falciparum* MAL3P8, complete sequence.

| ORF Name | NTID | AAID | NT Length | AA Length | Score | Probability |
|---|---|---|---|---|---|---|
| 26598453_f3_96 | 2535 | 7757 | 302 | 909 | 544 | 2.0e−52 |
| Protein name | | | | Locus Name | | Acc# |
| | | | | sp:DEOC_CAEEL | | Q19264 |
| Description | | | | | | |

(PHOSPHODEOXYRIBOALDOLASE) (DEOXYRIBOALDOLASE)

| ORF Name | NTID | AAID | NT Length | AA Length | Score | Probability |
|---|---|---|---|---|---|---|
| 29558432_f1_25 | 2536 | 7758 | 627 | 1884 | 818 | 1.8e−81 |
| Protein name | | | | Locus Name | | Acc# |
| X-Pro dipeptidyl-peptidase, | | | | pir:JC5142 | | JC5142 |
| Description | | | | | | |

| ORF Name | NTID | AAID | NT Length | AA Length | Score | Probability |
|---|---|---|---|---|---|---|
| 30276587_c1_157 | 2537 | 7759 | 132 | 399 | | |
| Protein name | | | | Locus Name | | Acc# |
| Description | | | | | | |

NO-HIT

| ORF Name | NTID | AAID | NT Length | AA Length | Score | Probability |
|---|---|---|---|---|---|---|
| 30479750_f2_56 | 2538 | 7760 | 151 | 456 | 191 | 5.1e−15 |
| Protein name | | | | Locus Name | | Acc# |
| | | | | sp:YPJD_BACSU | | P42979 |
| Description | | | | | | |

HYPOTHETICAL 13.0 KD PROTEIN IN QCRC-DAPB INTERGENIC REGION

-continued

| ORF Name | NTID | AAID | NT Length | AA Length | Score | Probability |
|---|---|---|---|---|---|---|
| 30664678_c2_173 | 2539 | 7761 | 377 | 1134 | 131 | 1.8e-05 |
| Protein name | | | Locus Name | | | Acc# |
| glucose-binding protein | | | gp:PPU74323 | | | U74323 |
| Description | | | | | | |

*Pseudomonas putida* glucose-binding protein (gltB) gene, complete cds.

| ORF Name | NTID | AAID | NT Length | AA Length | Score | Probability |
|---|---|---|---|---|---|---|
| 31444012_c1_161 | 2540 | 7762 | 304 | 915 | 91 | 0.017 |
| Protein name | | | Locus Name | | | Acc# |
| Gly1ORF1 | | | gP:AF003941 | | | AF003941 |
| Description | | | | | | |

*Neisseria gonorrhoeae* Gly1ORF1 and Gly1ORF2 genes, complete cds.

| ORF Name | NTID | AAID | NT Length | AA Length | Score | Probability |
|---|---|---|---|---|---|---|
| 33400260_f1_6 | 2541 | 7763 | 544 | 1635 | 123 | 0.00055 |
| Protein name | | | Locus Name | | | Acc# |
| hypothetical protein F56H9.1 | | | pir:T22808 | | | T22808 |
| Description | | | | | | |

| ORF Name | NTID | AAID | NT Length | AA Length | Score | Probability |
|---|---|---|---|---|---|---|
| 33678186_c2_202 | 2542 | 7764 | 154 | 465 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 33992811_f3_95 | 2543 | 7765 | 158 | 477 | 379 | 6.1e-35 |
| Protein name | | | Locus Name | | | Acc# |
| hypothetical protein | | | pir:S39974 | | | S39974 |
| Description | | | | | | |

| ORF Name | NTID | AAID | NT Length | AA Length | Score | Probability |
|---|---|---|---|---|---|---|
| 34183407_f2_72 | 2544 | 7766 | 191 | 576 | | |
| Protein name | | | Locus Name | | | Acc# |
| Description | | | | | | |

NO-HIT

-continued

| ORF Name | NTID | AAID | NT Length | AA Length | Score | Probability |
|---|---|---|---|---|---|---|
| 4314637_f1_22 | 2545 | 7767 | 303 | 912 | 698 | 9.5e−69 |

| Protein name | Locus Name | Acc# |
|---|---|---|
|  | sp:SRPH_SYNP7 | Q59967 |

Description

SERINE ACETYLTRANSFERAE, PLASMID, (SAT)

| ORF Name | NTID | AAID | NT Length | AA Length | Score | Probability |
|---|---|---|---|---|---|---|
| 4490938_f3_93 | 2546 | 7768 | 631 | 1896 | 1457 | 3.5e−149 |

| Protein name | Locus Name | Acc# |
|---|---|---|
|  | sp:GIDA_PSEPU | P25756 |

Description

GLUCOSE INHIBITED DIVISION PROTEIN A

| ORF Name | NTID | AAID | NT Length | AA Length | Score | Probability |
|---|---|---|---|---|---|---|
| 4579011_f3_100 | 2547 | 7769 | 454 | 1365 | 667 | 1.8e−65 |

| Protein name | Locus Name | Acc# |
|---|---|---|
|  | sp:Y064_SYNY3 | Q55156 |

Description

HYPOTHETICAL 43.0 KD PROTEIN SLR0064

| ORF Name | NTID | AAID | NT Length | AA Length | Score | Probability |
|---|---|---|---|---|---|---|
| 4687767_c3_242 | 2548 | 7770 | 566 | 1701 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 4719628_f1_36 | 2549 | 7771 | 312 | 939 | 541 | 4.1e−52 |

| Protein name | Locus Name | Acc# |
|---|---|---|
|  | sp:YJES_ECOLI | P39288 |

Description

HYPOTHETICAL 43.1 KD PROTEIN IN PSD-AMIB INTERGENIC REGION (F379)

| ORF Name | NTID | AAID | NT Length | AA Length | Score | Probability |
|---|---|---|---|---|---|---|
| 4766461_f2_52 | 2550 | 7772 | 240 | 723 | 396 | 9.6e−37 |

| Protein name | Locus Name | Acc# |
|---|---|---|
|  | sp:APT1_WHEAT | Q43199 |

Description

ADENINE PHOSPHORIBOSYLTRANSFERASE 1, (APRT)

-continued

| ORF Name | NTID | AAID | NT Length | AA Length | Score | Probability |
|---|---|---|---|---|---|---|
| 4804652_c1_145 | 2551 | 7773 | 679 | 2040 | 225 | 3.6e−15 |

| Protein name | Locus Name | Acc# |
|---|---|---|
| | gp:D90868 | |

Description

*E. coli* genomic DNA, Kohara clone #414 (53.8–54.2 min.).

| ORF Name | NTID | AAID | NT Length | AA Length | Score | Probability |
|---|---|---|---|---|---|---|
| 5292206_f2_75 | 2552 | 7774 | 207 | 624 | 222 | 2.6e−18 |

| Protein name | Locus Name | Acc# |
|---|---|---|
| | sp:YFU2_BACST | Q04729 |

Description (ORF2)

| ORF Name | NTID | AAID | NT Length | AA Length | Score | Probability |
|---|---|---|---|---|---|---|
| 6254457_c3_248 | 2553 | 7775 | 371 | 1116 | 989 | 1.4e−99 |

| Protein name | Locus Name | Acc# |
|---|---|---|
| | sp:RUVB_PSEAE | Q51426 |

Description

HOLLIDAY JUNCTION DNA HELICASE RUVB

| ORF Name | NTID | AAID | NT Length | AA Length | Score | Probability |
|---|---|---|---|---|---|---|
| 6525_c1_151 | 2554 | 7776 | 354 | 1065 | 478 | 2.0e−45 |

| Protein name | Locus Name | Acc# |
|---|---|---|
| octylprenyl diphosphate synthase-like protein | gp:AF153713 | AF153713 |

Description

*Pseudomonas* sp. BG33R strain BG33R octylprenyl diphosphate synthase-like protein gene, complete cds.

| ORF Name | NTID | AAID | NT Length | AA Length | Score | Probability |
|---|---|---|---|---|---|---|
| 7078137_c2_200 | 2555 | 7777 | 136 | 411 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 894058_f2_60 | 2556 | 7778 | 1001 | 3006 | 2069 | 5.0e−214 |

| Protein name | Locus Name | Acc# |
|---|---|---|
| DNA polymerase I | gp:AF121780 | AF121780 |

Description

*Thodothermus obamensis* DNA polymerase I (polA) gene, complete cds.

-continued

| ORF Name | NTID | AAID | NT Length | AA Length | Score | Probability |
|---|---|---|---|---|---|---|
| 10187642_f1_26 | 2557 | 7779 | 256 | 771 | 112 | 6.3e−05 |
| Protein name | | | Locus Name | | | Acc# |
| immunity region protein in prophage homolog ydcM | | | pir:B69774 | | | B69774 |

Description

| ORF Name | NTID | AAID | NT Length | AA Length | Score | Probability |
|---|---|---|---|---|---|---|
| 1035311_f2_115 | 2558 | 7780 | 71 | 216 | | |
| Protein name | | | Locus Name | | | Acc# |

Description

NO-HIT

| ORF Name | NTID | AAID | NT Length | AA Length | Score | Probability |
|---|---|---|---|---|---|---|
| 10354011_f2_312 | 2559 | 7781 | 266 | 801 | | |
| Protein name | | | Locus Name | | | Acc# |

Description

NO-HIT

| ORF Name | NTID | AAID | NT Length | AA Length | Score | Probability |
|---|---|---|---|---|---|---|
| 10550306_c3_436 | 2560 | 7782 | 352 | 1059 | | |
| Protein name | | | Locus Name | | | Acc# |

Description

NO-HIT

| ORF Name | NTID | AAID | NT Length | AA Length | Score | Probability |
|---|---|---|---|---|---|---|
| 11989088_c2_364 | 2561 | 7783 | 92 | 279 | | |
| Protein name | | | Locus Name | | | Acc# |

Description

NO-HIT

| ORF Name | NTID | AAID | NT Length | AA Length | Score | Probability |
|---|---|---|---|---|---|---|
| 1220317_f2_113 | 2562 | 7784 | 309 | 930 | 264 | 9.3e−23 |
| Protein name | | | Locus Name | | | Acc# |
| | | | sp:DDH_CORGL | | | P04964 |

Description

MESO-DIAMINOPIMELATE D-DEHYDROGENASE,

-continued

| ORF Name | NTID | AAID | NT Length | AA Length | Score | Probability |
|---|---|---|---|---|---|---|
| 12306502_f1_44 | 2563 | 7785 | 205 | 618 | 353 | 3.4e−32 |

| Protein name | Locus Name | Acc# |
|---|---|---|
| | sp:KGUA_YEAST | P15454 |

Description

GUANYLATE KINASE, (GMP KINSE)

| ORF Name | NTID | AAID | NT Length | AA Length | Score | Probability |
|---|---|---|---|---|---|---|
| 12391401_f1_34 | 2564 | 7786 | 152 | 459 | 385 | 1.4e−35 |

| Protein name | Locus Name | Acc# |
|---|---|---|
| probable permease b1828 | pir:D64944 | D64944 |

Description

| ORF Name | NTID | AAID | NT Length | AA Length | Score | Probability |
|---|---|---|---|---|---|---|
| 12774028_f3_202 | 2565 | 7787 | 819 | 2460 | 355 | 3.5e−71 |

| Protein name | Locus Name | Acc# |
|---|---|---|
| | sp:NRDD_HAEIN | P43752 |

Description

ANAEROBIC RIBONUCLEOSIDE-TRIPHOSPHATE REDUCTASE,

| ORF Name | NTID | AAID | NT Length | AA Length | Score | Probability |
|---|---|---|---|---|---|---|
| 1281260_c3_372 | 2566 | 7788 | 481 | 1446 | 454 | 6.8e−43 |

| Protein name | Locus Name | Acc# |
|---|---|---|
| O-unit flippase−like protein | gp:YPE251713 | AJ251713 |

Description

*Yersinia pestis* strain EV76 hemH gene (partial) and O-antigen gene cluster for ddhD gene, ddhA gene, ddhB pseudogene, ddhC gene, prt gene, wbyH gene, wzx gene, wbyI pseudogene, wbyJ gene, wzy pseudo gene, wbyK gene, gmd pseudogene, fcl pseudogene, manC gene, wbyL gene, manB gene, wzz gene and gsk gene (partial)

| ORF Name | NTID | AAID | NT Length | AA Length | Score | Probability |
|---|---|---|---|---|---|---|
| 14496090_c2_321 | 2567 | 7789 | 94 | 285 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 15812885_c3_448 | 2568 | 7790 | 334 | 1005 | 358 | 1.0e−32 |

| Protein name | Locus Name | Acc# |
|---|---|---|
| galactosyl transferase | gp:AF030373 | AF030373 |

Description

*Streptococcus pneumoniae* strain SP-264 alpha, 1-6-glucosidase(dexB) gene, complete cds; capsular polysaccharide biosyntheticlocus, complete sequence; and oligopeptide binding protein (aliA)gene, complete cds.

-continued

| ORF Name | NTID | AAID | NT Length | AA Length | Score | Probability |
|---|---|---|---|---|---|---|
| 16056682_c1_245 | 2569 | 7791 | 96 | 291 | 74 | 0.013 |

| Protein name | Locus Name | Acc# |
|---|---|---|
| hypothetical protein | gp:SSU18930 | Y18930 |

Description

*Sulfolobus solfataricus* 281 kb genomic DNA fragment, strain P2.

| ORF Name | NTID | AAID | NT Length | AA Length | Score | Probability |
|---|---|---|---|---|---|---|
| 19551535_f3_192 | 2570 | 7792 | 118 | 357 | 113 | 9.3e−07 |

| Protein name | Locus Name | Acc# |
|---|---|---|
| unknown | gp:LLU356929 | U35629 |

Description

*Lactococcus lactis* plasmid pSRQ802 abortive infection protein K(abiK) gene, complete cds.

| ORF Name | NTID | AAID | NT Length | AA Length | Score | Probability |
|---|---|---|---|---|---|---|
| 1994055_c3_451 | 2571 | 7793 | 239 | 720 | 104 | 0.0028 |

| Protein name | Locus Name | Acc# |
|---|---|---|
| capsular polysaccharide biosynthesis homolog ywqE | pir:H70066 | H70066 |

Description

| ORF Name | NTID | AAID | NT Length | AA Length | Score | Probability |
|---|---|---|---|---|---|---|
| 20492137_f3_188 | 2572 | 7794 | 167 | 504 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 22292513_f2_109 | 2573 | 7795 | 185 | 558 | 179 | 9.5e−14 |

| Protein name | Locus Name | Acc# |
|---|---|---|
| Phosphinothricin acetyltransferase (EC | gp:D90784 | |

Description

*E. coli* genomic DNA, Kohara clone #273 (32.5–32.8 min.).

| ORF Name | NTID | AAID | NT Length | AA Length | Score | Probability |
|---|---|---|---|---|---|---|
| 23486536_c2_340 | 2574 | 7796 | 60 | 183 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 23554651_c2_349 | 2575 | 7797 | 370 | 1113 | 1086 | 7.3e−110 |

| Protein name | Locus Name | Acc# |
|---|---|---|
| PhnW | gp:STU69493 | U69493 |

Description

*Salmonella typhimurium* ThiJ and Orf1 genes, partial cds, and PhnX, PhnW, PhnR, PhnS, PhnT, PhnU and PhnV genes, complete cds.

| ORF Name | NTID | AAID | NT Length | AA Length | Score | Probability |
|---|---|---|---|---|---|---|
| 23565628_f3_241 | 2576 | 7798 | 69 | 210 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 23625311_c3_415 | 2577 | 7799 | 388 | 1167 | 745 | 5.0e−96 |

| Protein name | Locus Name | Acc# |
|---|---|---|
| dTDP glucose 4,6-dehydratase, :dTDP-D-glucose−4,6-dehydratase :dTDP-glucose dehydratase | pir:T00102 | T00102 |

Description

| ORF Name | NTID | AAID | NT Length | AA Length | Score | Probability |
|---|---|---|---|---|---|---|
| 2361627_c2_346 | 2578 | 7800 | 456 | 1371 | 340 | 8.2e−31 |

| Protein name | Locus Name | Acc# |
|---|---|---|
| conserved hypothetical protein aq_1964 | pir:D70468 | D70468 |

Description

| ORF Name | NTID | AAID | NT Length | AA Length | Score | Probability |
|---|---|---|---|---|---|---|
| 23632211_f3_239 | 2579 | 7801 | 221 | 666 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 23632880_c2_341 | 2580 | 7802 | 245 | 738 | 199 | 7.2e−16 |

| Protein name | Locus Name | Acc# |
|---|---|---|
| hypothetical protein | gp:EFY17797 | Y17797 |

Description

*Enterococcus faecalis* gph, ydjH, ydjG, ydjI, pbp4 and ydiC, ORF2 and ORF3 genes, partial.

-continued

| ORF Name | NTID | AAID | NT Length | AA Length | Score | Probability |
|---|---|---|---|---|---|---|
| 23697051_c2_357 | 2581 | 7803 | 305 | 918 | 305 | 4.2e−27 |

| Protein name | | | | Locus Name | | Acc# |
|---|---|---|---|---|---|---|
| | | | | sp:RUVA_PSEAE | | Q51425 |

Description

HOLLIDAY JUNCTION DNA HELICASE RUVA

| ORF Name | NTID | AAID | NT Length | AA Length | Score | Probability |
|---|---|---|---|---|---|---|
| 24066055_f3_173 | 2582 | 7804 | 310 | 933 | 107 | 0.022 |

| Protein name | | | | Locus Name | | Acc# |
|---|---|---|---|---|---|---|
| | | | | gp:SCYDL057W | | |

Description

*S. cerevisiae* chromosome IV reading frame ORF YDL057w.

| ORF Name | NTID | AAID | NT Length | AA Length | Score | Probability |
|---|---|---|---|---|---|---|
| 24353386_f1_45 | 2583 | 7805 | 202 | 609 | 301 | 1.1e−26 |

| Protein name | | | | Locus Name | | Acc# |
|---|---|---|---|---|---|---|
| | | | | sp:YQEJ_BACSU | | P54455 |

Description

HYPOTHETICAL 22.2 KD PROTEIN IN AROD-COMER INTERGENIC REGION

| ORF Name | NTID | AAID | NT Length | AA Length | Score | Probability |
|---|---|---|---|---|---|---|
| 24412952_c3_452 | 2584 | 7806 | 146 | 441 | 128 | 2.4e−08 |

| Protein name | | | | Locus Name | | Acc# |
|---|---|---|---|---|---|---|
| cold shock protein homolog cspC | | | | pir:S43618 | | |

Description

| ORF Name | NTID | AAID | NT Length | AA Length | Score | Probability |
|---|---|---|---|---|---|---|
| 24469555_c1_275 | 2585 | 7807 | 438 | 1317 | 988 | 1.8e−99 |

| Protein name | | | | Locus Name | | Acc# |
|---|---|---|---|---|---|---|
| UDP-N-acetylglucosamine 1-carboxyvinyltransferase (murA) homolog | | | | pir:G70158 | | G70158 |

Description

| ORF Name | NTID | AAID | NT Length | AA Length | Score | Probability |
|---|---|---|---|---|---|---|
| 24644068_f3_203 | 2586 | 7808 | 154 | 465 | 322 | 6.6e−29 |

| Protein name | | | | Locus Name | | Acc# |
|---|---|---|---|---|---|---|
| | | | | sp:NRDG_HAEIN | | P45080 |

Description (EC 1.97.1.—)

-continued

| ORF Name | NTID | AAID | NT Length | AA Length | Score | Probability |
|---|---|---|---|---|---|---|
| 24645138_c3_444 | 2587 | 7809 | 210 | 633 | 110 | 3.5e−06 |

| Protein name | Locus Name | Acc# |
|---|---|---|
| unknown | gp:AF048749 | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 24648443_c3_394 | 2588 | 7810 | 474 | 1425 | 451 | 1.4e−42 |

| Protein name | Locus Name | Acc# |
|---|---|---|
|  | sp:YEBU_ECOLI |  |

Description

HYPOTHETICAL 53.2 KD PROTEIN IN PRC-PRPA INTERGENIC REGION

| ORF Name | NTID | AAID | NT Length | AA Length | Score | Probability |
|---|---|---|---|---|---|---|
| 24804691_f2_152 | 2589 | 7811 | 1032 | 3099 | 1980 | 1.3e−204 |

| Protein name | Locus Name | Acc# |
|---|---|---|
| cation efflux system protein czcA-1:protein slr0794:protein slr0794 | pir:S77008 | S77008 |

Description

| ORF Name | NTID | AAID | NT Length | AA Length | Score | Probability |
|---|---|---|---|---|---|---|
| 2538562_c3_406 | 2590 | 7812 | 139 | 420 | 191 | 5.1e−15 |

| Protein name | Locus Name | Acc# |
|---|---|---|
| response regulator homolog | pir:A69531 | A69531 |

Description

| ORF Name | NTID | AAID | NT Length | AA Length | Score | Probability |
|---|---|---|---|---|---|---|
| 2540885_f1_5 | 2591 | 7813 | 483 | 1452 | 119 | 0.00070 |

| Protein name | Locus Name | Acc# |
|---|---|---|
| receptor antigen B (RagB) | gp:PGI130872 | AJ130872 |

Description

*Porphyromonas gingivalis* W50 receptor antigen (rag) locus encodinga major immunodominant 55 kDa antigen.

| ORF Name | NTID | AAID | NT Length | AA Length | Score | Probability |
|---|---|---|---|---|---|---|
| 25510927_f3_242 | 2592 | 7814 | 429 | 1290 | 677 | 1.6e−66 |

| Protein name | Locus Name | Acc# |
|---|---|---|
|  | sp:YWNE_BACSU | P71040 |

Description

HYPOTHETICAL 55.8 KD PROTEIN IN SPOIIQ-MTA INTERGENIC REGION

-continued

| ORF Name | NTID | AAID | NT Length | AA Length | Score | Probability |
|---|---|---|---|---|---|---|
| 25594152_c1_269 | 2593 | 7815 | 448 | 1347 | 262 | 4.2e−22 |

| Protein name | Locus Name | Acc# |
|---|---|---|
| probable phosphoesterase, ykuE | pir:B69865 | B69865 |

Description

| ORF Name | NTID | AAID | NT Length | AA Length | Score | Probability |
|---|---|---|---|---|---|---|
| 26212837_c3_465 | 2594 | 7816 | 482 | 1449 | 1671 | 7.4e−172 |

| Protein name | Locus Name | Acc# |
|---|---|---|
| polyA polymerase | gp:AB022867 | AB022867 |

Description

*Prevotella ruminicola* genes for polyA polymerase, D-alanineglycinepermease and cellulase, complete cds.

| ORF Name | NTID | AAID | NT Length | AA Length | Score | Probability |
|---|---|---|---|---|---|---|
| 26305136_c3_418 | 2595 | 7817 | 205 | 618 | 130 | 1.5e−08 |

| Protein name | Locus Name | Acc# |
|---|---|---|
|  | sp:RIMM_HAEIN | P44568 |

Description

16S RRNA PROCESSING PROTEIN RIMM

| ORF Name | NTID | AAID | NT Length | AA Length | Score | Probability |
|---|---|---|---|---|---|---|
| 26360762_c2_352 | 2596 | 7818 | 98 | 297 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 26367332_f3_232 | 2597 | 7819 | 404 | 1215 | 135 | 4.7e−06 |

| Protein name | Locus Name | Acc# |
|---|---|---|
| cation efflux system membrane protein czcC | pir:C33830 | C33830 |

Description

| ORF Name | NTID | AAID | NT Length | AA Length | Score | Probability |
|---|---|---|---|---|---|---|
| 26600682_f2_110 | 2598 | 7820 | 176 | 531 |  |  |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 2775312_f2_96 | 2599 | 7821 | 300 | 903 | 153 | 9.6e−09 |

| Protein name | Locus Name | Acc# |
|---|---|---|
| hypothetical protein aq_1477 | pir:D70428 | D70428 |

Description

| ORF Name | NTID | AAID | NT Length | AA Length | Score | Probability |
|---|---|---|---|---|---|---|
| 29347260_c3_438 | 2600 | 7822 | 105 | 318 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 29412901_c2_334 | 2601 | 7823 | 295 | 888 | 1030 | 6.3e−104 |

| Protein name | Locus Name | Acc# |
|---|---|---|
| glucose-1-phosphate thymidylyltransferase, | pir:C69106 | C69106 |

Description

| ORF Name | NTID | AAID | NT Length | AA Length | Score | Probability |
|---|---|---|---|---|---|---|
| 29475312_c1_276 | 2602 | 7824 | 395 | 1188 | 866 | 1.5e−86 |

| Protein name | Locus Name | Acc# |
|---|---|---|
| | sp:DXR_SYNY3 | Q55663 |

Description (REDUCTOISOMERASE)

| ORF Name | NTID | AAID | NT Length | AA Length | Score | Probability |
|---|---|---|---|---|---|---|
| 30164137_c3_422 | 2603 | 7825 | 292 | 879 | 460 | 1.6e−43 |

| Protein name | Locus Name | Acc# |
|---|---|---|
| 2-phosphonoacetaldehyde hydrolase | gp:PAU45309 | U45309 |

Description

*Pseudomonas aeruginosa* 2-phosphonoacetaldehyde hydrolase gene, complete cds.

| ORF Name | NTID | AAID | NT Length | AA Length | Score | Probability |
|---|---|---|---|---|---|---|
| 31307880_f2_133 | 2604 | 7826 | 108 | 327 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 31836562_f1_56 | 2605 | 7827 | 95 | 288 | 115 | 1.6e−06 |

| Protein name | Locus Name | Acc# |
|---|---|---|
| sperm-specific protein component | gp:DMU90537 | U90537 |

Description

*Drosophila melanogaster* sperm-specific protein component (dj) mRNA, complete cds.

| ORF Name | NTID | AAID | NT Length | AA Length | Score | Probability |
|---|---|---|---|---|---|---|
| 32614052_f3_204 | 2606 | 7828 | 562 | 1689 | 921 | 2.2e−92 |

| Protein name | Locus Name | Acc# |
|---|---|---|
| probable permease b1828 | pir:D64944 | D64944 |

Description

| ORF Name | NTID | AAID | NT Length | AA Length | Score | Probability |
|---|---|---|---|---|---|---|
| 33252182_c3_437 | 2607 | 7829 | 237 | 714 | 392 | 2.5e−36 |

| Protein name | Locus Name | Acc# |
|---|---|---|
| ribose 5-phosphate isomerase (rpi) homolog | pir:G69367 | G69367 |

Description

| ORF Name | NTID | AAID | NT Length | AA Length | Score | Probability |
|---|---|---|---|---|---|---|
| 33400268_c3_467 | 2608 | 7830 | 701 | 2106 | 170 | 1.1e−09 |

| Protein name | Locus Name | Acc# |
|---|---|---|
| | sp:YE09_SYNY3 | P73594 |

Description

HYPOTHETICAL WD-REPEAT PROTEIN SLR1409

| ORF Name | NTID | AAID | NT Length | AA Length | Score | Probability |
|---|---|---|---|---|---|---|
| 33992130_f1_57 | 2609 | 7831 | 138 | 417 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 34022765_f3_184 | 2610 | 7832 | 99 | 300 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 34172765_c3_449 | 2611 | 7833 | 373 | 1122 | 122 | 0.00018 |

| Protein name | Locus Name | Acc# |
|---|---|---|
| hypothetical protein 4 | pir:E22845 | E22845 |

Description

| ORF Name | NTID | AAID | NT Length | AA Length | Score | Probability |
|---|---|---|---|---|---|---|
| 34181500_f1_6 | 2612 | 7834 | 955 | 2868 | 651 | 1.1e−61 |

| Protein name | Locus Name | Acc# |
|---|---|---|
| immunoreactive 106 kDa antigen PG115 | gp:AF153767 | AF153767 |

Description

*Porphyromonas gingivalis* strain W50 immunoreactive 106 kDa antigenPG115 gene, complete cds.

| ORF Name | NTID | AAID | NT Length | AA Length | Score | Probability |
|---|---|---|---|---|---|---|
| 34181587_f2_103 | 2613 | 7835 | 720 | 2163 | 202 | 4.6e−15 |

| Protein name | Locus Name | Acc# |
|---|---|---|
|  | gp:U93688 | U93688 |

Description

*Staphylococcus aureus* toxic shock syndrome toxin-1 (tst), enterotoxin (ent), and integrase (int) genes, complete cds.

| ORF Name | NTID | AAID | NT Length | AA Length | Score | Probability |
|---|---|---|---|---|---|---|
| 34572182_c3_468 | 2614 | 7836 | 921 | 2766 | 127 | 0.00026 |

| Protein name | Locus Name | Acc# |
|---|---|---|
| conserved hypothetical protein aq_854 | pir:B70374 | B70374 |

Description

| ORF Name | NTID | AAID | NT Length | AA Length | Score | Probability |
|---|---|---|---|---|---|---|
| 36329426_f1_54 | 2615 | 7837 | 700 | 2103 | 1174 | 3.4e−119 |

| Protein name | Locus Name | Acc# |
|---|---|---|
|  | sp:PPK_ECOLI | P28688 |

Description

POLYPHOSPHATE KINASE,

| ORF Name | NTID | AAID | NT Length | AA Length | Score | Probability |
|---|---|---|---|---|---|---|
| 39242137_c2_306 | 2616 | 7838 | 120 | 363 | 464 | 6.0e−44 |

| Protein name | Locus Name | Acc# |
|---|---|---|
| hypothetical protein | pir:JQ1020 | JQ1020 |

Description

-continued

| ORF Name | NTID | AAID | NT Length | AA Length | Score | Probability |
|---|---|---|---|---|---|---|
| 3960126_c1_249 | 2617 | 7839 | 377 | 1134 | 108 | 0.0045 |

| Protein name | Locus Name | Acc# |
|---|---|---|
| | gp:UMCRG1 | X92509 |

Description

*U. maydis* crg1 gene.

| ORF Name | NTID | AAID | NT Length | AA Length | Score | Probability |
|---|---|---|---|---|---|---|
| 4023452_f3_175 | 2618 | 7840 | 400 | 1203 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4062817_f1_58 | 2619 | 7841 | 417 | 1254 | 233 | 1.0e−17 |

| Protein name | Locus Name | Acc# |
|---|---|---|
| cation efflux system (czcB-like) | pir:E70342 | E70342 |

Description

| ORF Name | NTID | AAID | NT Length | AA Length | Score | Probability |
|---|---|---|---|---|---|---|
| 4094787_f3_174 | 2620 | 7842 | 1019 | 3060 | 745 | 1.9e−73 |

| Protein name | Locus Name | Acc# |
|---|---|---|
| receptor antigen (RagA) | gp:PGI130872 | AJ130872 |

Description

*Porphyromonas gingivalis* W50 receptor antigen (rag) locus encodinga major immunodominant 55 kDa antigen.

| ORF Name | NTID | AAID | NT Length | AA Length | Score | Probability |
|---|---|---|---|---|---|---|
| 4100377_c2_370 | 2621 | 7843 | 166 | 501 | 201 | 4.4e−16 |

| Protein name | Locus Name | Acc# |
|---|---|---|
| unknown | gp:AF048749 | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 4104687_f1_20 | 2622 | 7844 | 105 | 318 | 116 | 4.5e−07 |

| Protein name | Locus Name | Acc# |
|---|---|---|
| | sp:Y4DJ_RHISN | P55409 |

Description

HYPOTHETICAL TRANSCRIPTIONAL REGULATOR Y4DJ

-continued

| ORF Name | NTID | AAID | NT Length | AA Length | Score | Probability |
|---|---|---|---|---|---|---|
| 4110262_c3_446 | 2623 | 7845 | 179 | 540 | 312 | 7.6e−28 |

| Protein name | Locus Name | Acc# |
|---|---|---|
| | sp:CAPG_STAAU | P39856 |

Description

CAPG PROTEIN

| ORF Name | NTID | AAID | NT Length | AA Length | Score | Probability |
|---|---|---|---|---|---|---|
| 4114692_f3_229 | 2624 | 7846 | 547 | 1644 | 1069 | 4.6e−108 |

| Protein name | Locus Name | Acc# |
|---|---|---|
| ABC-type transport protein slr0864:protein slr0864:protein slr0864 | pir:S74849 | S74849 |

Description

| ORF Name | NTID | AAID | NT Length | AA Length | Score | Probability |
|---|---|---|---|---|---|---|
| 4141886_f3_187 | 2625 | 7847 | 473 | 1422 | 107 | 0.029 |

| Protein name | Locus Name | Acc# |
|---|---|---|
| middle molecular weight neurofilament protein | gp:XLU85969 | U85969 |

Description

*Xenopus laevis* middle molecular weight neurofilament protein NF-M (1) mRNA, complete cds.

| ORF Name | NTID | AAID | NT Length | AA Length | Score | Probability |
|---|---|---|---|---|---|---|
| 4187767_c3_414 | 2626 | 7848 | 189 | 570 | 120 | 1.2e−06 |

| Protein name | Locus Name | Acc# |
|---|---|---|
| | sp:YH74_METTH | O27802 |

Description

HYPOTHETICAL PROTEIN MJ1774

| ORF Name | NTID | AAID | NT Length | AA Length | Score | Probability |
|---|---|---|---|---|---|---|
| 4412550_f2_104 | 2627 | 7849 | 165 | 498 | 105 | 6.6e−06 |

| Protein name | Locus Name | Acc# |
|---|---|---|
| | sp:IHFA_HAEIN | P43723 |

Description

INTEGRATION HOST FACTOR ALPHA-SUBUNIT (IHF-ALPHA)

| ORF Name | NTID | AAID | NT Length | AA Length | Score | Probability |
|---|---|---|---|---|---|---|
| 4457750_c2_342 | 2628 | 7850 | 208 | 627 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 4719385_c2_344 | 2629 | 7851 | 290 | 873 | 235 | 1.1e−19 |

| Protein name | Locus Name | Acc# |
|---|---|---|
| lipoprotein | gp:AF000945 | AF000945 |

Description

*Vibrio cholerae* lipoprotein (nlpD) gene, partial cds, sigma S (rpoS) gene, complete cds, and methyl-directed mismatch repairprotein (mutS) gene, partial cds.

| ORF Name | NTID | AAID | NT Length | AA Length | Score | Probability |
|---|---|---|---|---|---|---|
| 4726557_f2_160 | 2630 | 7852 | 185 | 558 | 246 | 7.5e−21 |

| Protein name | Locus Name | Acc# |
|---|---|---|
| AlgT | gp:AF190580 | AF190580 |

Description

*Pseudomonas syringae* pv. *syringae* AlgT (algT) gene, complete cds.

| ORF Name | NTID | AAID | NT Length | AA Length | Score | Probability |
|---|---|---|---|---|---|---|
| 4876252_c3_447 | 2631 | 7853 | 341 | 1026 | 108 | 0.0038 |

| Protein name | Locus Name | Acc# |
|---|---|---|
| galactosyl transferase | gp:SPN239004 | AJ239004 |

Description

*Streptococcus pneumoniae* type 8 capsular gene cluster.

| ORF Name | NTID | AAID | NT Length | AA Length | Score | Probability |
|---|---|---|---|---|---|---|
| 4885937_f1_49 | 2632 | 7854 | 301 | 906 | 446 | 4.8e−42 |

| Protein name | Locus Name | Acc# |
|---|---|---|
| putative 1,4-dihydroxy-2-naphthoate | gp:AF101047 | |

Description

*Haemophilus ducreyi* putative 1,4-dihydroxy-2-naphthoateoctaprenyltransferase, YadR (yadR), cytidine 5'monophosphateN-acetylneuraminic acid synthetase (neuA), lipooligosaccharidesialyltransferase (lst), and putative dTDP-D-glucose4,6-dehydratase (rmlB) genes, complete cds; and

| ORF Name | NTID | AAID | NT Length | AA Length | Score | Probability |
|---|---|---|---|---|---|---|
| 5178800_f2_114 | 2633 | 7855 | 240 | 723 | 325 | 3.2e−29 |

| Protein name | Locus Name | Acc# |
|---|---|---|
| | sp:HLY3_BACCE | P54176 |

Description

HEMOLYSIN III (HLY-III)

-continued

| ORF Name | NTID | AAID | NT Length | AA Length | Score | Probability |
|---|---|---|---|---|---|---|
| 5863277_c2_371 | 2634 | 7856 | 368 | 1107 | 406 | 8.3e−38 |

| Protein name | Locus Name | Acc# |
|---|---|---|
| IIm protein | pir:A55856 | A55856 |

Description

| ORF Name | NTID | AAID | NT Length | AA Length | Score | Probability |
|---|---|---|---|---|---|---|
| 5892183_f3_198 | 2635 | 7857 | 143 | 432 | 121 | 1.3e−07 |

| Protein name | Locus Name | Acc# |
|---|---|---|
| conserved hypothetical protein MTH700 | pir:E69193 | E69193 |

Description

| ORF Name | NTID | AAID | NT Length | AA Length | Score | Probability |
|---|---|---|---|---|---|---|
| 5937787_f3_227 | 2636 | 7858 | 775 | 2328 | 152 | 2.0e−10 |

| Protein name | Locus Name | Acc# |
|---|---|---|
| | sp:YG04_HAEIN | P45268 |

Description

PUTATIVE PHOSPHATE PERMEASE HI1604

| ORF Name | NTID | AAID | NT Length | AA Length | Score | Probability |
|---|---|---|---|---|---|---|
| 6066040_f3_208 | 2637 | 7859 | 297 | 894 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 6345012_f1_43 | 2638 | 7860 | 304 | 915 | 360 | 6.2e−33 |

| Protein name | Locus Name | Acc# |
|---|---|---|
| conserved hypothetical protein yloC | pir:A69878 | A69878 |

Description

| ORF Name | NTID | AAID | NT Length | AA Length | Score | Probability |
|---|---|---|---|---|---|---|
| 6428430_c3_450 | 2639 | 7861 | 376 | 1131 | 746 | 7.8e−74 |

| Protein name | Locus Name | Acc# |
|---|---|---|
| cpsF protein, 40.6K | pir:S70157 | S70157 |

Description

| ORF Name | NTID | AAID | NT Length | AA Length | Score | Probability |
|---|---|---|---|---|---|---|
| 6835285_c3_393 | 2640 | 7862 | 125 | 378 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 7148412_f3_240 | 2641 | 7863 | 113 | 342 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 14178177_c3_105 | 2642 | 7864 | 64 | 195 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 19744643_c2_85 | 2643 | 7865 | 151 | 456 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 23468752_c2_84 | 2644 | 7866 | 206 | 621 | 97 | 0.010 |

| Protein name | | | | Locus Name | | Acc# |
|---|---|---|---|---|---|---|
| | | | | sp:VGP8_EBV | | P03224 |

Description

PROBABLE MEMBRANE ANTIGEN GP85

| ORF Name | NTID | AAID | NT Length | AA Length | Score | Probability |
|---|---|---|---|---|---|---|
| 24337765_f1_23 | 2645 | 7867 | 267 | 804 | 365 | 3.0e−32 |

| Protein name | | | | Locus Name | | Acc# |
|---|---|---|---|---|---|---|
| 115K outer membrane protein precursor:SusC protein | | | | pir:JC6027 | | JC6027 |

Description

| ORF Name | NTID | AAID | NT Length | AA Length | Score | Probability |
|---|---|---|---|---|---|---|
| 24390925_f2_41 | 2646 | 7868 | 540 | 1623 | 2188 | 1.2e−226 |

| Protein name | | | | Locus Name | | Acc# |
|---|---|---|---|---|---|---|
| | | | | sp:PPCK_ANASU | | O09460 |

Description

-continued

| ORF Name | NTID | AAID | NT Length | AA Length | Score | Probability |
|---|---|---|---|---|---|---|
| 24432692_c2_78 | 2647 | 7869 | 538 | 1617 | 92 | 0.031 |
| Protein name | | | Locus Name | | | Acc# |
| MerC protein | | | gp:EAMMRTRAN | | | Y08992 |
| Description | | | | | | |

*E. agglomerans* pKLH272 incomplete unit of mosaic mercury resistancetransposon.

| ORF Name | NTID | AAID | NT Length | AA Length | Score | Probability |
|---|---|---|---|---|---|---|
| 2477187_f1_22 | 2648 | 7870 | 60 | 183 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 24803760_f2_36 | 2649 | 7871 | 637 | 1914 | 1489 | 1.4e−152 |
| Protein name | | | Locus Name | | | Acc# |
| putative oxidoreductase alpha-subunit | | | gp:SCAH10 | | | AL132824 |
| Description | | | | | | |

*Streptomyces coelicolor* cosmid AH10.

| ORF Name | NTID | AAID | NT Length | AA Length | Score | Probability |
|---|---|---|---|---|---|---|
| 25444787_c3_98 | 2650 | 7872 | 222 | 669 | 784 | 7.3e−78 |
| Protein name | | | Locus Name | | | Acc# |
| Uracil phosphoribosyltransferase | | | gp:AB016085 | | | AB016085 |
| Description | | | | | | |

*Porphyromonas gingivalis* PorT, upp, and prtQ genes, complete cds.

| ORF Name | NTID | AAID | NT Length | AA Length | Score | Probability |
|---|---|---|---|---|---|---|
| 26056588_f2_37 | 2651 | 7873 | 337 | 1014 | 819 | 1.4e−81 |
| Protein name | | | Locus Name | | | Acc# |
| probable oxidoreductase | | | pir:E70864 | | | E70864 |
| Description | | | | | | |

| ORF Name | NTID | AAID | NT Length | AA Length | Score | Probability |
|---|---|---|---|---|---|---|
| 26364836_c1_70 | 2652 | 7874 | 60 | 183 | | |
| Protein name | | | Locus Name | | | Acc# |
| Description | | | | | | |

NO-HIT

-continued

| ORF Name | NTID | AAID | NT Length | AA Length | Score | Probability |
|---|---|---|---|---|---|---|
| 26562750_c1_69 | 2653 | 7875 | 415 | 1248 | 196 | 9.6e−13 |

| Protein name | Locus Name | Acc# |
|---|---|---|
| transposase | gp:AF038866 | AF038866 |

Description

*Bacteroides fragilis* transposon Tn5520 transposase (bipH) and mobilization protein BmpH (bmpH) genes, complete cds.

| ORF Name | NTID | AAID | NT Length | AA Length | Score | Probability |
|---|---|---|---|---|---|---|
| 26854808_f1_2 | 2654 | 7876 | 117 | 354 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 2929000_f1_11 | 2655 | 7877 | 300 | 903 | 148 | 4.2e−08 |

| Protein name | Locus Name | Acc# |
|---|---|---|
| | sp:MSMR_STRMU | Q00753 |

Description

MSM OPERON REGULATORY PROTEIN

| ORF Name | NTID | AAID | NT Length | AA Length | Score | Probability |
|---|---|---|---|---|---|---|
| 32455077_c1_73 | 2656 | 7878 | 261 | 786 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 32602012_f2_43 | 2657 | 7879 | 81 | 246 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 33647142_c2_76 | 2658 | 7880 | 277 | 834 | 280 | 1.9e−24 |

| Protein name | Locus Name | Acc# |
|---|---|---|
| glycerophosphodiester phosphodiesterase homolog yhdW | pir:E69827 | E69827 |

Description

-continued

| ORF Name | NTID | AAID | NT Length | AA Length | Score | Probability |
|---|---|---|---|---|---|---|
| 35235700_c1_60 | 2659 | 7881 | 62 | 189 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 36520931_f2_42 | 2660 | 7882 | 798 | 2397 | 376 | 5.7e−31 |
| Protein name | | | Locus Name | | | Acc# |
| 115K outer membrane protein precursor:SusC protein | | | pir:JC6027 | | | JC6027 |
| Description | | | | | | |

| ORF Name | NTID | AAID | NT Length | AA Length | Score | Probability |
|---|---|---|---|---|---|---|
| 392005_c1_72 | 2661 | 7883 | 579 | 1740 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 3959677_c1_71 | 2662 | 7884 | 189 | 570 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 4876450_c2_88 | 2663 | 7885 | 392 | 1179 | 88 | 0.00068 |
| Protein name | | | Locus Name | | | Acc# |
| | | | gp:D42067 | | | D42067 |
| Description | | | | | | |
| *Porphyromonas gingivalis* DNA for Fimbrilin, ORF1-4, complete cds. | | | | | | |

| ORF Name | NTID | AAID | NT Length | AA Length | Score | Probability |
|---|---|---|---|---|---|---|
| 822135_c3_106 | 2664 | 7886 | 90 | 273 | | |
| Protein name | | | Locus Name | | | Acc# |
| Description | | | | | | |
| NO-HIT | | | | | | |

-continued

| ORF Name | NTID | AAID | NT Length | AA Length | Score | Probability |
|---|---|---|---|---|---|---|
| 9933530_c2_77 | 2665 | 7887 | 66 | 201 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 23487680_f2_13 | 2666 | 7888 | 443 | 1332 | 110 | 3.1e−10 |
| Protein name | | | Locus Name | | | Acc# |
| conserved hypothetical protein yknZ | | | pir:E69858 | | | E69858 |
| Description | | | | | | |

| ORF Name | NTID | AAID | NT Length | AA Length | Score | Probability |
|---|---|---|---|---|---|---|
| 24641677_f2_14 | 2667 | 7889 | 425 | 1278 | 128 | 1.4e−05 |
| Protein name | | | Locus Name | | | Acc# |
| conserved hypothetical protein yvrM | | | pir:G70047 | | | G70047 |
| Description | | | | | | |

| ORF Name | NTID | AAID | NT Length | AA Length | Score | Probability |
|---|---|---|---|---|---|---|
| 24664700_f3_22 | 2668 | 7890 | 113 | 342 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 30347807_c3_46 | 2669 | 7891 | 304 | 915 | 132 | 3.4e−08 |
| Protein name | | | Locus Name | | | Acc# |
| | | | gp:AP000342 | | | AP000342 |
| Description | | | | | | |

Plasmid R100 genomic DNA.

| ORF Name | NTID | AAID | NT Length | AA Length | Score | Probability |
|---|---|---|---|---|---|---|
| 32072162_f2_12 | 2670 | 7892 | 429 | 1290 | 123 | 0.00013 |
| Protein name | | | Locus Name | | | Acc# |
| | | | sp:Y797_METJA | | | Q58207 |
| Description | | | | | | |

HYPOTHETICAL PROTEIN MJ0797

-continued

| ORF Name | NTID | AAID | NT Length | AA Length | Score | Probability |
|---|---|---|---|---|---|---|
| 3932937_f2_17 | 2671 | 7893 | 427 | 1284 | 219 | 7.5e–15 |

| Protein name | Locus Name | Acc# |
|---|---|---|
|  | sp:YBJZ_ECOLI | P75831 |

Description

HYPOTHETICAL ABC TRANSPORTER ATP-BINDING PROTEIN YBJZ

| ORF Name | NTID | AAID | NT Length | AA Length | Score | Probability |
|---|---|---|---|---|---|---|
| 3960882_f3_23 | 2672 | 7894 | 224 | 675 | 602 | 1.4e–58 |

| Protein name | Locus Name | Acc# |
|---|---|---|
|  | sp:YF08_METJA | Q58903 |

Description

HYPOTHETICAL ABC TRANSPORTER ATP-BINDING PROTEIN MJ1508

| ORF Name | NTID | AAID | NT Length | AA Length | Score | Probability |
|---|---|---|---|---|---|---|
| 4898552_f1_10 | 2673 | 7895 | 401 | 1206 | 120 | 0.00028 |

| Protein name | Locus Name | Acc# |
|---|---|---|
|  | gp:D85752 | D85752 |

Description

*Enterococcus faecalis* plasmid pPD1 bacA, bacB, bacC, bacD, bacE, bacF, bacG, bacH and bacI genes, complete cds.

| ORF Name | NTID | AAID | NT Length | AA Length | Score | Probability |
|---|---|---|---|---|---|---|
| 7220142_f2_11 | 2674 | 7896 | 215 | 648 | 127 | 3.1e–06 |

| Protein name | Locus Name | Acc# |
|---|---|---|
| conserved hypothetical protein yvrM | pir:G70047 | G70047 |

Description

| ORF Name | NTID | AAID | NT Length | AA Length | Score | Probability |
|---|---|---|---|---|---|---|
| 10289015_f1_15 | 2675 | 7897 | 81 | 246 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 10328155_c1_403 | 2676 | 7898 | 133 | 402 | 88 | 0.035 |

| Protein name | Locus Name | Acc# |
|---|---|---|
| hypothetical protein sll0241 | pir:S75099 | S75099 |

Description

-continued

| ORF Name | NTID | AAID | NT Length | AA Length | Score | Probability |
|---|---|---|---|---|---|---|
| 1054188_c1_358 | 2677 | 7899 | 127 | 384 | | |
| Protein name | | | Locus Name | | | Acc# |

Description

NO-HIT

| ORF Name | NTID | AAID | NT Length | AA Length | Score | Probability |
|---|---|---|---|---|---|---|
| 10970392_f1_119 | 2678 | 7900 | 107 | 324 | | |
| Protein name | | | Locus Name | | | Acc# |

Description

NO-HIT

| ORF Name | NTID | AAID | NT Length | AA Length | Score | Probability |
|---|---|---|---|---|---|---|
| 11109662_f1_92 | 2679 | 7901 | 203 | 612 | 515 | 2.3e−49 |
| Protein name | | | Locus Name | | | Acc# |
| immunoreactive 21 kD antigen PG10 | | | gp:AF144077 | | | AF144077 |

Description

*Porphyromonas gingivalis* strain W50 immunoreactive 21 kD antigenPG10 gene, complete cds.

| ORF Name | NTID | AAID | NT Length | AA Length | Score | Probability |
|---|---|---|---|---|---|---|
| 11132800_f1_31 | 2680 | 7902 | 499 | 1500 | 1616 | 5.0e−166 |
| Protein name | | | Locus Name | | | Acc# |
| | | | sp:SAHH_MESCR | | | P93253 |

Description (HYDROLASE) (ADOHCYASE)

| ORF Name | NTID | AAID | NT Length | AA Length | Score | Probability |
|---|---|---|---|---|---|---|
| 11725312_f3_261 | 2681 | 7903 | 120 | 363 | 240 | 3.2e−20 |
| Protein name | | | Locus Name | | | Acc# |
| | | | sp:RS15_BORBU | | | O51744 |

Description

30S RIBOSOMAL PROTEIN S15

| ORF Name | NTID | AAID | NT Length | AA Length | Score | Probability |
|---|---|---|---|---|---|---|
| 1219437_c1_425 | 2682 | 7904 | 532 | 1599 | 255 | 1.1e−34 |
| Protein name | | | Locus Name | | | Acc# |
| | | | sp:STS_HUMAN | | | P08842 |

Description (SULFATE SULFOHYDROLASE) (ARYLSULFATASE C) (ASC)

-continued

| ORF Name | NTID | AAID | NT Length | AA Length | Score | Probability |
|---|---|---|---|---|---|---|
| 13757180_f2_220 | 2683 | 7905 | 60 | 183 | 70 | 0.033 |
| Protein name | | | Locus Name | | | Acc# |
| hypothetical protein APE1598 | | | pir:A72539 | | | A72539 |
| Description | | | | | | |

| ORF Name | NTID | AAID | NT Length | AA Length | Score | Probability |
|---|---|---|---|---|---|---|
| 14063750_f1_124 | 2684 | 7906 | 452 | 1359 | 114 | 2.6e−05 |
| Protein name | | | Locus Name | | | Acc# |
| hypothetical protein PH0212 | | | pir:B71244 | | | B71244 |
| Description | | | | | | |

| ORF Name | NTID | AAID | NT Length | AA Length | Score | Probability |
|---|---|---|---|---|---|---|
| 14173331_c2_516 | 2685 | 7907 | 113 | 342 | 103 | 1.1e−05 |
| Protein name | | | Locus Name | | | Acc# |
| hypothetical protein APE0625 | | | pir:C72649 | | | C72649 |
| Description | | | | | | |

| ORF Name | NTID | AAID | NT Length | AA Length | Score | Probability |
|---|---|---|---|---|---|---|
| 14536453_c1_372 | 2686 | 7908 | 78 | 237 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 14720052_f3_345 | 2687 | 7909 | 329 | 990 | 553 | 2.2e−53 |
| Protein name | | | Locus Name | | | Acc# |
| clindamycin resistance transfer factor btgB | | | pir:B41656 | | | B41656 |
| Description | | | | | | |

| ORF Name | NTID | AAID | NT Length | AA Length | Score | Probability |
|---|---|---|---|---|---|---|
| 14885826_f3_296 | 2688 | 7910 | 64 | 195 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 15039137_c2_505 | 2689 | 7911 | 682 | 2049 | | |
| Protein name | | | Locus Name | | | Acc# |
| Description | | | | | | |
| NO-HIT | | | | | | |

-continued

| ORF Name | NTID | AAID | NT Length | AA Length | Score | Probability |
|---|---|---|---|---|---|---|
| 167802_f3_342 | 2690 | 7912 | 323 | 972 | 151 | 5.7e−15 |

| Protein name | Locus Name | Acc# |
|---|---|---|
| hypothetical protein SCJ12.27c | pir:T37044 | T37044 |

Description

| ORF Name | NTID | AAID | NT Length | AA Length | Score | Probability |
|---|---|---|---|---|---|---|
| 16986252_c2_479 | 2691 | 7913 | 261 | 786 | 595 | 7.8e−58 |

| Protein name | Locus Name | Acc# |
|---|---|---|
| hypothetical protein jhp1180 | pir:A71838 | A71838 |

Description

| ORF Name | NTID | AAID | NT Length | AA Length | Score | Probability |
|---|---|---|---|---|---|---|
| 19551337_c2_474 | 2692 | 7914 | 262 | 789 | 225 | 1.3e−18 |

| Protein name | Locus Name | Acc# |
|---|---|---|
| hypothetical protein b2381 | pir:B65012 | B65012 |

Description

| ORF Name | NTID | AAID | NT Length | AA Length | Score | Probability |
|---|---|---|---|---|---|---|
| 19625177_f2_232 | 2693 | 7915 | 353 | 1062 | 423 | 1.3e−39 |

| Protein name | Locus Name | Acc# |
|---|---|---|
| thiamin monphosphate kinase | pir:G69052 | G69052 |

Description

| ORF Name | NTID | AAID | NT Length | AA Length | Score | Probability |
|---|---|---|---|---|---|---|
| 19719812_f3_346 | 2694 | 7916 | 440 | 1323 | 432 | 1.5e−40 |

| Protein name | Locus Name | Acc# |
|---|---|---|
| NcoI DNA modification methyltransferase | gp:AF068761 | AF068761 |

Description

*Nocardia corallina* NcoI DNA modification methyltransferase (ncoIM) and NcoI restriction endonuclease (ncoIR) genes, complete cds.

| ORF Name | NTID | AAID | NT Length | AA Length | Score | Probability |
|---|---|---|---|---|---|---|
| 1992707_c1_402 | 2695 | 7917 | 167 | 504 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 20742167_f3_344 | 2696 | 7918 | 112 | 339 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 210937_c2_462 | 2697 | 7919 | 232 | 699 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 21520936_f3_348 | 2698 | 7920 | 180 | 543 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 21600627_f2_230 | 2699 | 7921 | 613 | 1842 | 888 | 7.0e−89 |

| Protein name | | | Locus Name | | | Acc# |
|---|---|---|---|---|---|---|
| | | | sp:SPPA_SYNY3 | | | P73689 |

Description

PROTEASE IV HOMOLOG, (ENDOPEPTIDASE IV)

| ORF Name | NTID | AAID | NT Length | AA Length | Score | Probability |
|---|---|---|---|---|---|---|
| 21673205_c1_423 | 2700 | 7922 | 1178 | 3537 | 633 | 2.2e−62 |

| Protein name | | | Locus Name | | | Acc# |
|---|---|---|---|---|---|---|
| receptor antigen (RagA) | | | gp:PGI130872 | | | AJ130872 |

Description

*Porphyromonas gingivalis* W50 receptor antigen (rag) locus encoding a major immunodominant 55 kDa antigen.

| ORF Name | NTID | AAID | NT Length | AA Length | Score | Probability |
|---|---|---|---|---|---|---|
| 21673332_c1_424 | 2701 | 7923 | 656 | 1971 | | |

| Protein name | | | Locus Name | | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 21757701_f1_93 | 2702 | 7924 | 95 | 288 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 22064087_c2_458 | 2703 | 7925 | 66 | 201 | 51 | 0.016 |
| Protein name | | | Locus Name | | | Acc# |
| cytochrome oxidase subunit II | | | gp:TIMY18821 | | | Y18821 |
| Description | | | | | | |

*Timarcha metallica* mitochondrial tRNA-Leu and partial COII genes, isolate Forest d'Anlier.

| ORF Name | NTID | AAID | NT Length | AA Length | Score | Probability |
|---|---|---|---|---|---|---|
| 22078391_f3_333 | 2704 | 7926 | 62 | 189 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 22462842_c1_397 | 2705 | 7927 | 375 | 1128 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 22687827_c3_551 | 2706 | 7928 | 443 | 1332 | 136 | 9.8e−05 |
| Protein name | | | Locus Name | | | Acc# |
| hypothetical protein | | | pir:H75507 | | | H75507 |
| Description | | | | | | |

| ORF Name | NTID | AAID | NT Length | AA Length | Score | Probability |
|---|---|---|---|---|---|---|
| 22838405_c3_598 | 2707 | 7929 | 1251 | 3756 | 333 | 5.6e−47 |
| Protein name | | | Locus Name | | | Acc# |
| hybrid histidine kinase | | | gp:AF029704 | | | AF029704 |
| Description | | | | | | |

*Dictyostelium discoideum* hybrid histidine kinase (dhkD) mRNA, complete cds.

| ORF Name | NTID | AAID | NT Length | AA Length | Score | Probability |
|---|---|---|---|---|---|---|
| 23492786_c1_395 | 2708 | 7930 | 85 | 258 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 2350306_f1_106 | 2709 | 7931 | 100 | 303 | 105 | 6.6e−06 |
| Protein name | | | Locus Name | | | Acc# |
| hypothetical protein PH0217 | | | pir:G71244 | | | G71244 |
| Description | | | | | | |

| ORF Name | NTID | AAID | NT Length | AA Length | Score | Probability |
|---|---|---|---|---|---|---|
| 23537750_f2_168 | 2710 | 7932 | 567 | 1704 | 269 | 3.5e−21 |
| Protein name | | | Locus Name | | | Acc# |
| immunoreactive 53 kD antigen PG123 | | | gp:AF144641 | | | AF144641 |
| Description | | | | | | |

*Porphyromonas gingivalis* strain W50 immunoreactive 53 kD antigen PG123 gene, complete cds.

| ORF Name | NTID | AAID | NT Length | AA Length | Score | Probability |
|---|---|---|---|---|---|---|
| 23625061_f2_247 | 2711 | 7933 | 246 | 741 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 23629407_f2_244 | 2712 | 7934 | 410 | 1233 | 184 | 1.3e−13 |
| Protein name | | | Locus Name | | | Acc# |
| hypothetical protein (avrc 3' region) | | | pir:C43649 | | | C43649 |
| Description | | | | | | |

| ORF Name | NTID | AAID | NT Length | AA Length | Score | Probability |
|---|---|---|---|---|---|---|
| 23633430_c3_552 | 2713 | 7935 | 435 | 1308 | | |
| Protein name | | | Locus Name | | | Acc# |
| Description | | | | | | |

NO-HIT

-continued

| ORF Name | NTID | AAID | NT Length | AA Length | Score | Probability |
|---|---|---|---|---|---|---|
| 23875636_f2_151 | 2714 | 7936 | 87 | 264 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 23876527_c1_356 | 2715 | 7937 | 61 | 186 | 53 | 0.016 |

| Protein name | | | | Locus Name | | Acc# |
|---|---|---|---|---|---|---|
| TrkA | | | | gp:BSU62055 | | U62055 |

Description

*Bacillus subtilis* CzcD (czcD) gene, partial cds, TrkA (trkA) gene, complete cds.

| ORF Name | NTID | AAID | NT Length | AA Length | Score | Probability |
|---|---|---|---|---|---|---|
| 23939825_f3_341 | 2716 | 7938 | 633 | 1902 | 224 | 4.5e−30 |

| Protein name | | | | Locus Name | | Acc# |
|---|---|---|---|---|---|---|
| | | | | sp:YF65_METJA | | Q58960 |

Description

HYPOTHETICAL PROTEIN MJ1565

| ORF Name | NTID | AAID | NT Length | AA Length | Score | Probability |
|---|---|---|---|---|---|---|
| 23985687_f2_231 | 2717 | 7939 | 285 | 858 | 736 | 8.9e−73 |

| Protein name | | | | Locus Name | | Acc# |
|---|---|---|---|---|---|---|
| purine nucleoside phosphorylase | | | | pir:H72217 | | H72217 |

Description

| ORF Name | NTID | AAID | NT Length | AA Length | Score | Probability |
|---|---|---|---|---|---|---|
| 24250953_f3_254 | 2718 | 7940 | 640 | 1923 | 941 | 1.9e−98 |

| Protein name | | | | Locus Name | | Acc# |
|---|---|---|---|---|---|---|
| hypothetical protein F10M10.30 | | | | pir:T04772 | | T04772 |

Description

| ORF Name | NTID | AAID | NT Length | AA Length | Score | Probability |
|---|---|---|---|---|---|---|
| 24257177_f3_297 | 2719 | 7941 | 688 | 2067 | 1426 | 4.9e−173 |

| Protein name | | | | Locus Name | | Acc# |
|---|---|---|---|---|---|---|
| methionyl-tRNA synthetase (metS) PAB2364 | | | | pir:B75074 | | B75074 |

Description

-continued

| ORF Name | NTID | AAID | NT Length | AA Length | Score | Probability |
|---|---|---|---|---|---|---|
| 2428417_c3_594 | 2720 | 7942 | 67 | 204 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 24335131_f2_222 | 2721 | 7943 | 64 | 195 | 106 | 5.1e−06 |

| Protein name | | | Locus Name | | | Acc# |
|---|---|---|---|---|---|---|
| hypothetical protein PH0219 | | | pir:A71245 | | | A71245 |

Description

| ORF Name | NTID | AAID | NT Length | AA Length | Score | Probability |
|---|---|---|---|---|---|---|
| 24343756_f3_255 | 2722 | 7944 | 62 | 189 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 24401002_c2_500 | 2723 | 7945 | 114 | 345 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 24412626_f2_140 | 2724 | 7946 | 682 | 2049 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 244636_c3_591 | 2725 | 7947 | 321 | 966 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 24487752_f2_249 | 2726 | 7948 | 349 | 1050 | 109 | 0.012 |

| Protein name | | | Locus Name | | | Acc# |
|---|---|---|---|---|---|---|
| DNA-directed RNA polymerase, beta'-2 chain:RNA polymerase rpoC2 | | | pir:S72284 | | | S72284 |

Description

-continued

| ORF Name | NTID | AAID | NT Length | AA Length | Score | Probability |
|---|---|---|---|---|---|---|
| 24494067_f2_169 | 2727 | 7949 | 357 | 1074 | 138 | 1.1e−08 |

| Protein name | Locus Name | Acc# |
|---|---|---|
| thiol:disulfide interchange protein homolog yneN | pir:E69891 | E69891 |

Description

| ORF Name | NTID | AAID | NT Length | AA Length | Score | Probability |
|---|---|---|---|---|---|---|
| 24503502_f2_143 | 2728 | 7950 | 98 | 297 | 124 | 7.3e−08 |

| Protein name | Locus Name | Acc# |
|---|---|---|
| hypothetical protein | gp:SSU18930 | Y18930 |

Description

*Sulfolobus solfataricus* 281 kb genomic DNA fragment, strain P2.

| ORF Name | NTID | AAID | NT Length | AA Length | Score | Probability |
|---|---|---|---|---|---|---|
| 24642312_c2_464 | 2729 | 7951 | 105 | 318 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24646916_f1_52 | 2730 | 7952 | 185 | 558 | 203 | 2.7e−16 |

| Protein name | Locus Name | Acc# |
|---|---|---|
| RNA polymerase sigma factor SigZ-like protein | gp:AF137263 | AF137263 |

Description

*Bacteroides thetaiotaomicron* 30S ribosomal protein S16-likeprotein, fucose gene cluster, and RNA polymerase sigma factorSigZ-like protein (sigZ) genes, complete cds.

| ORF Name | NTID | AAID | NT Length | AA Length | Score | Probability |
|---|---|---|---|---|---|---|
| 24647188_c2_502 | 2731 | 7953 | 209 | 630 | 77 | 0.019 |

| Protein name | Locus Name | Acc# |
|---|---|---|
| | gp:HIVY16028 | Y16028 |

Description

HIV-1 vif, vpr, tat, vpu genes, strain 95CAMP448.

| ORF Name | NTID | AAID | NT Length | AA Length | Score | Probability |
|---|---|---|---|---|---|---|
| 24648417_f3_309 | 2732 | 7954 | 291 | 876 | 375 | 1.4e−41 |

| Protein name | Locus Name | Acc# |
|---|---|---|
| macrophage infectivity potentiator | gp:LAU91606 | U91606 |

Description

*Legionella adelaidensis* macrophage infectivity potentiator (mip) gene, complete cds.

-continued

| ORF Name | NTID | AAID | NT Length | AA Length | Score | Probability |
|---|---|---|---|---|---|---|
| 24648442_c3_553 | 2733 | 7955 | 504 | 1515 | 131 | 0.00012 |

| Protein name | | | Locus Name | | Acc# | |
|---|---|---|---|---|---|---|
| | | | gp:SCYDL057W | | | |

Description

*S. cerevisiae* chromosome IV reading frame ORF YDL057w.

| ORF Name | NTID | AAID | NT Length | AA Length | Score | Probability |
|---|---|---|---|---|---|---|
| 24650150_c1_396 | 2734 | 7956 | 466 | 1401 | | |

| Protein name | | | Locus Name | | Acc# | |

Description

NO-HIT

| ORF Name | NTID | AAID | NT Length | AA Length | Score | Probability |
|---|---|---|---|---|---|---|
| 24798157_c2_460 | 2735 | 7957 | 119 | 360 | | |

| Protein name | | | Locus Name | | Acc# | |

Description

NO-HIT

| ORF Name | NTID | AAID | NT Length | AA Length | Score | Probability |
|---|---|---|---|---|---|---|
| 2531537_f2_197 | 2736 | 7958 | 370 | 1113 | | |

| Protein name | | | Locus Name | | Acc# | |

Description

NO-HIT

| ORF Name | NTID | AAID | NT Length | AA Length | Score | Probability |
|---|---|---|---|---|---|---|
| 25547302_c1_379 | 2737 | 7959 | 355 | 1068 | 205 | 3.1e−14 |

| Protein name | | | Locus Name | | Acc# | |
|---|---|---|---|---|---|---|
| AlgZ | | | gp:PAU52431 | | U52431 | |

Description

*Pseudomonas aeruginosa* AlgR-cognate sensor AlgZ (algZ) gene, complete cds.

| ORF Name | NTID | AAID | NT Length | AA Length | Score | Probability |
|---|---|---|---|---|---|---|
| 25578342_f1_120 | 2738 | 7960 | 380 | 1143 | | |

| Protein name | | | Locus Name | | Acc# | |

Description

NO-HIT

-continued

| ORF Name | NTID | AAID | NT Length | AA Length | Score | Probability |
|---|---|---|---|---|---|---|
| 25632882_f1_108 | 2739 | 7961 | 384 | 1155 | 321 | 8.5e−29 |

| Protein name | Locus Name | Acc# |
|---|---|---|
| conserved hypothetical protein aq_1656 | pir:C70443 | C70443 |

Description

| ORF Name | NTID | AAID | NT Length | AA Length | Score | Probability |
|---|---|---|---|---|---|---|
| 26290890_f3_256 | 2740 | 7962 | 1087 | 3264 | 422 | 1.1e−73 |

| Protein name | Locus Name | Acc# |
|---|---|---|
| 115K outer membrane protein precursor:SusC protein | pir:JC6027 | JC6027 |

Description

| ORF Name | NTID | AAID | NT Length | AA Length | Score | Probability |
|---|---|---|---|---|---|---|
| 26364458_c1_433 | 2741 | 7963 | 638 | 1917 | 1704 | 2.4e−175 |

| Protein name | Locus Name | Acc# |
|---|---|---|
| GTP-binding elongation factor family protein TypA/BipA | pir:E75426 | E75426 |

Description

| ORF Name | NTID | AAID | NT Length | AA Length | Score | Probability |
|---|---|---|---|---|---|---|
| 26445263_c1_378 | 2742 | 7964 | 435 | 1308 | 252 | 5.8e−19 |

| Protein name | Locus Name | Acc# |
|---|---|---|
| immunoreactive 52 kD antigen PG41 | gp:AF175716 | AF175716 |

Description

*Porphyromonas gingivalis* strain W50 immunoreactive 52 kD antigenPG41 gene, complete cds.

| ORF Name | NTID | AAID | NT Length | AA Length | Score | Probability |
|---|---|---|---|---|---|---|
| 26595663_c3_550 | 2743 | 7965 | 358 | 1077 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 26619587_c2_504 | 2744 | 7966 | 392 | 1179 | 271 | 3.6e−27 |

| Protein name | Locus Name | Acc# |
|---|---|---|
| coenzyme PQQ synthesis protein (pqqE) homolog | pir:F69551 | F69551 |

Description

-continued

| ORF Name | NTID | AAID | NT Length | AA Length | Score | Probability |
|---|---|---|---|---|---|---|
| 26640807_f3_252 | 2745 | 7967 | 496 | 1491 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 282708_f3_320 | 2746 | 7968 | 60 | 183 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 29479502_f2_246 | 2747 | 7969 | 243 | 732 | 126 | 2.3e−06 |

| Protein name | | | | Locus Name | | Acc# |
|---|---|---|---|---|---|---|
| probable transcription regulator | | | | pir:T34578 | | T34578 |

Description

| ORF Name | NTID | AAID | NT Length | AA Length | Score | Probability |
|---|---|---|---|---|---|---|
| 29479676_c2_461 | 2748 | 7970 | 106 | 321 | 202 | 3.5e−16 |

| Protein name | | | | Locus Name | | Acc# |
|---|---|---|---|---|---|---|
| | | | | sp:DBH_BACST | | |

Description

DNA-BINDING PROTEIN II (HB) (HU)

| ORF Name | NTID | AAID | NT Length | AA Length | Score | Probability |
|---|---|---|---|---|---|---|
| 29775466_c1_427 | 2749 | 7971 | 126 | 381 | 103 | 1.1e−05 |

| Protein name | | | | Locus Name | | Acc# |
|---|---|---|---|---|---|---|
| hypothetical protein APE0626 | | | | pir:D72649 | | D72649 |

Description

| ORF Name | NTID | AAID | NT Length | AA Length | Score | Probability |
|---|---|---|---|---|---|---|
| 30345437_c1_420 | 2750 | 7972 | 419 | 1260 | 589 | 3.4e−57 |

| Protein name | | | | Locus Name | | Acc# |
|---|---|---|---|---|---|---|
| hypothetical protein | | | | gp:PGI237898 | | AJ237898 |

Description

*Porphyromonas gingivalis* olpA and rbfA genes and ORF3 (partial), strain ATCC33277.

-continued

| ORF Name | NTID | AAID | NT Length | AA Length | Score | Probability |
|---|---|---|---|---|---|---|
| 30563152_c3_574 | 2751 | 7973 | 64 | 195 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 30681581_f3_311 | 2752 | 7974 | 104 | 315 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 3134627_c1_419 | 2753 | 7975 | 486 | 1461 | 1062 | 2.5e−107 |

| Protein name | | | | Locus Name | | Acc# |
|---|---|---|---|---|---|---|
| | | | | sp:KPYK_BORBU | | O51323 |

Description

PYRUVATE KINASE, (PK)

| ORF Name | NTID | AAID | NT Length | AA Length | Score | Probability |
|---|---|---|---|---|---|---|
| 3156300_f2_172 | 2754 | 7976 | 403 | 1212 | 100 | 0.016 |

| Protein name | | | | Locus Name | | Acc# |
|---|---|---|---|---|---|---|
| hypothetical protein DKFZp566D1824.1 | | | | pir:T14767 | | T14767 |

Description

| ORF Name | NTID | AAID | NT Length | AA Length | Score | Probability |
|---|---|---|---|---|---|---|
| 31676317_f1_122 | 2755 | 7977 | 194 | 585 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 31750058_f2_128 | 2756 | 7978 | 76 | 231 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 3176437_f2_170 | 2757 | 7979 | 514 | 1545 | 1367 | 1.2e−139 |

| Protein name | | | | Locus Name | | Acc# |
|---|---|---|---|---|---|---|
| hypothetical protein slr0904 | | | | pir:S75721 | | S75721 |

Description

-continued

| ORF Name | NTID | AAID | NT Length | AA Length | Score | Probability |
|---|---|---|---|---|---|---|
| 32064193_c1_387 | 2758 | 7980 | 404 | 1215 | 1403 | 1.9e-143 |

| Protein name | Locus Name | Acc# |
|---|---|---|
| UDP-ManNAc dehydrogenase | gp:AF125164 | AF125164 |

Description

*Bacteroides fragilis* 638R polysaccharide B (PS B2) biosynthesis locus, complete sequence; and unknown genes.

| ORF Name | NTID | AAID | NT Length | AA Length | Score | Probability |
|---|---|---|---|---|---|---|
| 3234530_f2_127 | 2759 | 7981 | 379 | 1140 | 150 | 1.1e-07 |

| Protein name | Locus Name | Acc# |
|---|---|---|
| hypothetical protein | pir:G75375 | G75375 |

Description

| ORF Name | NTID | AAID | NT Length | AA Length | Score | Probability |
|---|---|---|---|---|---|---|
| 33390680_f1_84 | 2760 | 7982 | 222 | 669 | 101 | 0.047 |

| Protein name | Locus Name | Acc# |
|---|---|---|
| otoferlin | gp:AF107403 | AF107403 |

Description

*Homo sapiens* otoferlin (OTOF) mRNA, complete cds.

| ORF Name | NTID | AAID | NT Length | AA Length | Score | Probability |
|---|---|---|---|---|---|---|
| 33792160_f2_138 | 2761 | 7983 | 87 | 264 | 82 | 0.020 |

| Protein name | Locus Name | Acc# |
|---|---|---|
|  | gp:PFMAL3P7 |  |

Description

*Plasmodium falciparum* MAL3P7, complete sequence.

| ORF Name | NTID | AAID | NT Length | AA Length | Score | Probability |
|---|---|---|---|---|---|---|
| 34081405_c1_376 | 2762 | 7984 | 88 | 267 | 110 | 1.9e-06 |

| Protein name | Locus Name | Acc# |
|---|---|---|
| hypothetical protein PHS004 | pir:F71245 | F71245 |

Description

| ORF Name | NTID | AAID | NT Length | AA Length | Score | Probability |
|---|---|---|---|---|---|---|
| 34094141_f2_248 | 2763 | 7985 | 229 | 690 | 156 | 2.6e-11 |

| Protein name | Locus Name | Acc# |
|---|---|---|
| clindamycin resistance transfer factor btgA | pir:A41656 | A41656 |

Description

-continued

| ORF Name | NTID | AAID | NT Length | AA Length | Score | Probability |
|---|---|---|---|---|---|---|
| 34172157_c3_543 | 2764 | 7986 | 110 | 333 | 80 | 0.022 |

| Protein name | Locus Name | Acc# |
|---|---|---|
| transposase | gp:EFENTIJO | Y16413 |

Description

*Enterococcus faecium* entI and entJ genes and two open reading frames.

| ORF Name | NTID | AAID | NT Length | AA Length | Score | Probability |
|---|---|---|---|---|---|---|
| 34176550_c3_549 | 2765 | 7987 | 346 | 1041 | 201 | 1.7e−13 |

| Protein name | Locus Name | Acc# |
|---|---|---|
| integrase IntN1 | gp:BUU51917 | U51917 |

Description

*Bacteroides uniformis* insertion element NBU1 fragment, integrase IntN1 gene, complete cds.

| ORF Name | NTID | AAID | NT Length | AA Length | Score | Probability |
|---|---|---|---|---|---|---|
| 34198800_f1_107 | 2766 | 7988 | 60 | 183 | 58 | 0.024 |

| Protein name | Locus Name | Acc# |
|---|---|---|
| immunoglobulin heavy chain variable region | gp:BTU49783 | U49783 |

Description

*Bos taurus* immunoglobulin rearranged heavy chain variable region mRNA, partial cds.

| ORF Name | NTID | AAID | NT Length | AA Length | Score | Probability |
|---|---|---|---|---|---|---|
| 34259628_c1_398 | 2767 | 7989 | 104 | 315 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 35172150_f2_152 | 2768 | 7990 | 71 | 216 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 35839375_c1_351 | 2769 | 7991 | 370 | 1113 | 1470 | 1.5e−150 |

| Protein name | Locus Name | Acc# |
|---|---|---|
| hypothetical protein | pir:JQ1020 | JQ1020 |

Description

-continued

| ORF Name | NTID | AAID | NT Length | AA Length | Score | Probability |
|---|---|---|---|---|---|---|
| 36072640_c3_588 | 2770 | 7992 | 111 | 336 | 99 | 2.8e−05 |

| Protein name | Locus Name | Acc# |
|---|---|---|
| hypothetical protein PH0994 | pir:E71091 | E71091 |

Description

| ORF Name | NTID | AAID | NT Length | AA Length | Score | Probability |
|---|---|---|---|---|---|---|
| 3912762_f2_245 | 2771 | 7993 | 74225 | | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 3914093_f2_228 | 2772 | 7994 | 68 | 207 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4032890_c1_429 | 2773 | 7995 | 537 | 1614 | 441 | 3.2e−40 |

| Protein name | Locus Name | Acc# |
|---|---|---|
| sensory transduction histidine kinase slr2098:protein slr2098:protein slr2098 | pir:S75130 | S75130 |

Description

| ORF Name | NTID | AAID | NT Length | AA Length | Score | Probability |
|---|---|---|---|---|---|---|
| 4067837_f1_123 | 2774 | 7996 | 146 | 441 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4095080_c1_401 | 2775 | 7997 | 692 | 2079 | 620 | 5.1e−92 |

| Protein name | Locus Name | Acc# |
|---|---|---|
| | sp:Y590_METJA | Q58010 |

Description

HYPOTHETICAL PROTEIN MJ0590

-continued

| ORF Name | NTID | AAID | NT Length | AA Length | Score | Probability |
|---|---|---|---|---|---|---|
| 4117188_c2_463 | 2776 | 7998 | 282 | 849 | 455 | 3.3e−58− |

| Protein name | Locus Name | Acc# |
|---|---|---|
| helicase | gp:RNDNAB | Y13813 |

Description

*Rhodothermus marinus* dnaB gene.

| ORF Name | NTID | AAID | NT Length | AA Length | Score | Probability |
|---|---|---|---|---|---|---|
| 4117336_f1_90 | 2777 | 7999 | 260 | 783 | 368 | 8.9e−34 |

| Protein name | Locus Name | Acc# |
|---|---|---|
| hypothetical protein jhp0094 | pir:E71975 | E71975 |

Description

| ORF Name | NTID | AAID | NT Length | AA Length | Score | Probability |
|---|---|---|---|---|---|---|
| 4157880_c1_388 | 2778 | 8000 | 380 | 1143 | 1207 | 1.1e−122 |

| Protein name | Locus Name | Acc# |
|---|---|---|
| putative UDP-N-acetylglucosamine 2-epimerase | gp:ALW243431 | AJ243431 |

Description

*Acinetobacter lwoffii* wzc, wzb, wza, weeA, weeB, wceC, wzx, wzy, weeD, weeE, weeF, weeG, weeH, weeI, weeJ, weeK, galU, ugd, pgi, galE, pgm (partial) and mip (partial) genes (emulsan biosynthetic gene cluster), strain RAG-1.

| ORF Name | NTID | AAID | NT Length | AA Length | Score | Probability |
|---|---|---|---|---|---|---|
| 4320288_c2_473 | 2779 | 8001 | 1014 | 3045 | 712 | 3.0e−68 |

| Protein name | Locus Name | Acc# |
|---|---|---|
|  | sp:Y895_HAEIN |  |

Description

HYPOTHETICAL PROTEIN HI0895

| ORF Name | NTID | AAID | NT Length | AA Length | Score | Probability |
|---|---|---|---|---|---|---|
| 4411636_c1_361 | 2780 | 8002 | 122 | 369 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 4491411_f2_133 | 2781 | 8003 | 213 | 642 | 121 | 5.4e−05 |

| Protein name | Locus Name | Acc# |
|---|---|---|
| putative large secreted protein | gp:SCF12 | AL117669 |

Description

*Streptomyces coelicolor* cosmid F12.

-continued

| ORF Name | NTID | AAID | NT Length | AA Length | Score | Probability |
|---|---|---|---|---|---|---|
| 4494028_f3_299 | 2782 | 8004 | 396 | 1191 | 222 | 1.1e−16 |
| Protein name | | | | Locus Name | | Acc# |
| capsular polysaccharide biosynthsis protein | | | | pir:F70441 | | F70441 |
| Description | | | | | | |

| ORF Name | NTID | AAID | NT Length | AA Length | Score | Probability |
|---|---|---|---|---|---|---|
| 4569683_f1_76 | 2783 | 8005 | 165 | 498 | | |
| Protein name | | | | Locus Name | | Acc# |
| Description | | | | | | |
| NO-HIT | | | | | | |

| ORF Name | NTID | AAID | NT Length | AA Length | Score | Probability |
|---|---|---|---|---|---|---|
| 4580050_c1_399 | 2784 | 8006 | 401 | 1206 | | |
| Protein name | | | | Locus Name | | Acc# |
| Description | | | | | | |
| NO-HIT | | | | | | |

| ORF Name | NTID | AAID | NT Length | AA Length | Score | Probability |
|---|---|---|---|---|---|---|
| 4694410_f3_343 | 2785 | 8007 | 85 | 258 | | |
| Protein name | | | | Locus Name | | Acc# |
| Description | | | | | | |
| NO-HIT | | | | | | |

| ORF Name | NTID | AAID | NT Length | AA Length | Score | Probability |
|---|---|---|---|---|---|---|
| 4801588_f3_300 | 2786 | 8008 | 339 | 1020 | 96 | 0.0092 |
| Protein name | | | | Locus Name | | Acc# |
| hypothetical protein F13H8.1 | | | | pir:T16066 | | T16066 |
| Description | | | | | | |

| ORF Name | NTID | AAID | NT Length | AA Length | Score | Probability |
|---|---|---|---|---|---|---|
| 4860650_f1_14 | 2787 | 8009 | 95 | 288 | 75 | 0.0099 |
| Protein name | | | | Locus Name | | Acc# |
| ct602 hypothetical protein | | | | pir:F72036 | | F72036 |
| Description | | | | | | |

| ORF Name | NTID | AAID | NT Length | AA Length | Score | Probability |
|---|---|---|---|---|---|---|
| 4881301_c1_363 | 2788 | 8010 | 306 | 921 | | |
| Protein name | | | | Locus Name | | Acc# |
| Description | | | | | | |
| NO-HIT | | | | | | |

-continued

| ORF Name | NTID | AAID | NT Length | AA Length | Score | Probability |
|---|---|---|---|---|---|---|
| 4884681_c1_365 | 2789 | 8011 | 99 | 300 | 113 | 9.3e−07 |
| Protein name | | | | Locus Name | | Acc# |
| protein gp57 | | | | pir:T13144 | | T13144 |
| Description | | | | | | |

| ORF Name | NTID | AAID | NT Length | AA Length | Score | Probability |
|---|---|---|---|---|---|---|
| 4886652_f3_280 | 2790 | 8012 | 574 | 1725 | 84 | 0.045 |
| Protein name | | | | Locus Name | | Acc# |
| hypothetical protein PFB0765w | | | | pir:E71606 | | E71606 |
| Description | | | | | | |

| ORF Name | NTID | AAID | NT Length | AA Length | Score | Probability |
|---|---|---|---|---|---|---|
| 4898437_f2_167 | 2791 | 8013 | 320 | 963 | 580 | 3.0e−56 |
| Protein name | | | | Locus Name | | Acc# |
| tyrosine recombinase XerD | | | | gp:AF093548 | | AF093548 |
| Description | | | | | | |

*Staphylococcus aureus* tyrosine recombinase XerD (xerD) gene, complete cds.

| ORF Name | NTID | AAID | NT Length | AA Length | Score | Probability |
|---|---|---|---|---|---|---|
| 4945451_f2_205 | 2792 | 8014 | 417 | 1254 | 214 | 7.8e−15 |
| Protein name | | | | Locus Name | | Acc# |
| probable mannosyltransferase | | | | pir:C75423 | | C75423 |
| Description | | | | | | |

| ORF Name | NTID | AAID | NT Length | AA Length | Score | Probability |
|---|---|---|---|---|---|---|
| 4960907_f2_229 | 2793 | 8015 | 174 | 525 | 206 | 1.3e−16 |
| Protein name | | | | Locus Name | | Acc# |
| hypothetical protein APE1457 | | | | pir:A72625 | | A72625 |
| Description | | | | | | |

| ORF Name | NTID | AAID | NT Length | AA Length | Score | Probability |
|---|---|---|---|---|---|---|
| 506502_f2_145 | 2794 | 8016 | 203 | 612 | 522 | 4.3e−50 |
| Protein name | | | | Locus Name | | Acc# |
| epoxidase | | | | pir:F69187 | | F69187 |
| Description | | | | | | |

| ORF Name | NTID | AAID | NT Length | AA Length | Score | Probability |
|---|---|---|---|---|---|---|
| 5093790_c3_571 | 2795 | 8017 | 89 | 270 | | |
| Protein name | | | | Locus Name | | Acc# |
| Description | | | | | | |

NO-HIT

-continued

| ORF Name | NTID | AAID | NT Length | AA Length | Score | Probability |
|---|---|---|---|---|---|---|
| 5110212_c1_364 | 2796 | 8018 | 338 | 1017 | | |

| Protein name | | | Locus Name | | Acc# | |
|---|---|---|---|---|---|---|
| | | | | | | |

Description

NO-HIT

| ORF Name | NTID | AAID | NT Length | AA Length | Score | Probability |
|---|---|---|---|---|---|---|
| 5116680_f2_146 | 2797 | 8019 | 560 | 1683 | 1827 | 2.2e−188 |

| Protein name | | | Locus Name | | Acc# | |
|---|---|---|---|---|---|---|
| probable acid--CoA ligase, MTH657 | | | pir:D69187 | | D69187 | |

Description

| ORF Name | NTID | AAID | NT Length | AA Length | Score | Probability |
|---|---|---|---|---|---|---|
| 5273337_f1_24 | 2798 | 8020 | 83 | 252 | | |

| Protein name | | | Locus Name | | Acc# | |
|---|---|---|---|---|---|---|
| | | | | | | |

Description

NO-HIT

| ORF Name | NTID | AAID | NT Length | AA Length | Score | Probability |
|---|---|---|---|---|---|---|
| 5275263_c3_567 | 2799 | 8021 | 348 | 1047 | 226 | 5.0e−17 |

| Protein name | | | Locus Name | | Acc# | |
|---|---|---|---|---|---|---|
| cation efflux system (czcB-like) | | | pir:C70415 | | C70415 | |

Description

| ORF Name | NTID | AAID | NT Length | AA Length | Score | Probability |
|---|---|---|---|---|---|---|
| 5332506_f2_221 | 2800 | 8022 | 95 | 288 | 73 | 0.034 |

| Protein name | | | Locus Name | | Acc# | |
|---|---|---|---|---|---|---|
| hypothetical protein PH0220 | | | pir:B71245 | | B71245 | |

Description

| ORF Name | NTID | AAID | NT Length | AA Length | Score | Probability |
|---|---|---|---|---|---|---|
| 589038_f3_325 | 2801 | 8023 | 96 | 291 | | |

| Protein name | | | Locus Name | | Acc# | |
|---|---|---|---|---|---|---|
| | | | | | | |

Description

NO-HIT

| ORF Name | NTID | AAID | NT Length | AA Length | Score | Probability |
|---|---|---|---|---|---|---|
| 6095461_c1_418 | 2802 | 8024 | 143 | 432 | 379 | 6.1e−35 |

| Protein name | | | Locus Name | | Acc# | |
|---|---|---|---|---|---|---|
| 3-dehydroquinate dehydratase,:carbonic 3-dehydroquinase:protein sll1112:carbonic 3-dehydroquinase:protein sll1112 | | | pir:S77551 | | S77551 | |

Description

| ORF Name | NTID | AAID | NT Length | AA Length | Score | Probability |
|---|---|---|---|---|---|---|
| 6407762_c2_510 | 2803 | 8025 | 117 | 354 | 358 | 1.0e−32 |

| Protein name | Locus Name | Acc# |
|---|---|---|
| RBFA, putative | gp:PGI237898 | AJ237898 |

Description

*Porphyromonas gingivalis* olpA and rbfA genes and ORF3 (partial), strain ATCC33277.

| ORF Name | NTID | AAID | NT Length | AA Length | Score | Probability |
|---|---|---|---|---|---|---|
| 6586_f2_129 | 2804 | 8026 | 587 | 1764 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 6829052_f3_298 | 2805 | 8027 | 458 | 1377 | 542 | 3.2e−52 |

| Protein name | Locus Name | Acc# |
|---|---|---|
| O-antigen repeat unit transporter Wzx | gp:AF172324 | AF172324 |

Description

*Escherichia coli* GalF (galF) gene, partial cds; O-antigen repeat unit transporter Wzx (wzx), WbnA (wbnA), O-antigen polymerase Wzy (wzy), WbnB (wbnB), WbnC (wbnC), WbnD (wbnD), WbnE (wbnE), UDP-Glc-4-epimerase GalE (galE), 6-phosphogluconate dehydrogenase Gnd (gnd), UDP-Glc-6-dehydrogenase Ugd (ugd), and WbnF (wbnF) genes, complete cds; and chain length determinant

| ORF Name | NTID | AAID | NT Length | AA Length | Score | Probability |
|---|---|---|---|---|---|---|
| 7142501_f3_304 | 2806 | 8028 | 439 | 1320 | 344 | 3.1e−31 |

| Protein name | Locus Name | Acc# |
|---|---|---|
| hypothetical protein RP336 | pir:B71690 | B71690 |

Description

| ORF Name | NTID | AAID | NT Length | AA Length | Score | Probability |
|---|---|---|---|---|---|---|
| 791436_c3_612 | 2807 | 8029 | 220 | 663 | 363 | 3.0e−33 |

| Protein name | Locus Name | Acc# |
|---|---|---|
| O-methyltransferase | pir:B70431 | B70431 |

Description

| ORF Name | NTID | AAID | NT Length | AA Length | Score | Probability |
|---|---|---|---|---|---|---|
| 797311_f2_234 | 2808 | 8030 | 83 | 252 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 838915_f2_188 | 2809 | 8031 | 101 | 306 | 112 | 1.2e−06 |

| Protein name | Locus Name | Acc# |
|---|---|---|
| hypothetical protein PH1791 | pir:G71189 | G71189 |

Description

| ORF Name | NTID | AAID | NT Length | AA Length | Score | Probability |
|---|---|---|---|---|---|---|
| 8501_c1_422 | 2810 | 8032 | 329 | 990 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 9765652_f3_310 | 2811 | 8033 | 90 | 273 | 77 | 0.014 |

| Protein name | Locus Name | Acc# |
|---|---|---|
| yhcV homolog 2:inosine-monophosphate dehydrogenase (guaB-2) homolog (misnomer) | pir:F69514 | F69514 |

Description

| ORF Name | NTID | AAID | NT Length | AA Length | Score | Probability |
|---|---|---|---|---|---|---|
| 976577_f2_150 | 2812 | 8034 | 832 | 2499 | 104 | 6.1e−05 |

| Protein name | Locus Name | Acc# |
|---|---|---|
| hypothetical protein | gp:SSU18930 | Y18930 |

Description

*Sulfolobus solfataricus* 281 kb genomic DNA fragment, strain P2.

| ORF Name | NTID | AAID | NT Length | AA Length | Score | Probability |
|---|---|---|---|---|---|---|
| 993811_f3_310 | 2813 | 8035 | 162 | 489 | 282 | 1.2e−24 |

| Protein name | Locus Name | Acc# |
|---|---|---|
| | sp:ASNC_ECOLI | P03809 |

Description

REGULATORY PROTEIN ASNC

| ORF Name | NTID | AAID | NT Length | AA Length | Score | Probability |
|---|---|---|---|---|---|---|
| 9959637_c3_595 | 2814 | 8036 | 417 | 1254 | 101 | 0.0013 |

| Protein name | Locus Name | Acc# |
|---|---|---|
| thiol:disulfide interchange protein | pir:C70314 | C70314 |

Description

-continued

| ORF Name | NTID | AAID | NT Length | AA Length | Score | Probability |
|---|---|---|---|---|---|---|
| 10191317_f1_20 | 2815 | 8037 | 128 | 387 | 93 | 2.1e−06 |

| Protein name | Locus Name | Acc# |
|---|---|---|
| hypothetical protein Jv0534 | gp:AF121009 | AF121009 |

Description

*Mycobacterium tuberculosis* H37Rv hypothetical protein Jv0534 (Jv0534) mRNA, complete cds.

| ORF Name | NTID | AAID | NT Length | AA Length | Score | Probability |
|---|---|---|---|---|---|---|
| 14566582_c1_74 | 2816 | 8038 | 635 | 1908 | 473 | 1.2e−43 |

| Protein name | Locus Name | Acc# |
|---|---|---|
| sensory transduction histidine kinase slr2098:protein slr2098:protein slr2098 | pir:S75130 | S75130 |

Description

| ORF Name | NTID | AAID | NT Length | AA Length | Score | Probability |
|---|---|---|---|---|---|---|
| 14574068_c1_99 | 2817 | 8039 | 78 | 234 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 14629712_f2_34 | 2818 | 8040 | 1066 | 3201 | 469 | 7.1e−80 |

| Protein name | Locus Name | Acc# |
|---|---|---|
| 115K outer membrane protein precursor:SusC protein | pir:JC6027 | JC6027 |

Description

| ORF Name | NTID | AAID | NT Length | AA Length | Score | Probability |
|---|---|---|---|---|---|---|
| 14944534_c3_164 | 2819 | 8041 | 68 | 207 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 16132962_c3_126 | 2820 | 8042 | 206 | 621 | 239 | 2.4e−19 |

| Protein name | Locus Name | Acc# |
|---|---|---|
| hypothetical protein RP329 | pir:C71689 | C71689 |

Description

-continued

| ORF Name | NTID | AAID | NT Length | AA Length | Score | Probability |
|---|---|---|---|---|---|---|
| 1953877__f1__26 | 2821 | 8043 | 66 | 201 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 19578827__f2__33 | 2822 | 8044 | 282 | 849 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 20437662__f3__54 | 2823 | 8045 | 309 | 930 | 151 | 2.2e−08 |

| Protein name | | | | Locus Name | | Acc# |
|---|---|---|---|---|---|---|
| regulatory protein hpaA | | | | pir:A55349 | | |

Description

| ORF Name | NTID | AAID | NT Length | AA Length | Score | Probability |
|---|---|---|---|---|---|---|
| 22348262__c2__124 | 2824 | 8046 | 743 | 2265 | 510 | 4.6e−46 |

| Protein name | | | | Locus Name | | Acc# |
|---|---|---|---|---|---|---|
| cation efflux (AcrB/AcrD/AcrF family) | | | | pir:F70368 | | F70368 |

Description

| ORF Name | NTID | AAID | NT Length | AA Length | Score | Probability |
|---|---|---|---|---|---|---|
| 22365790__f1__8 | 2825 | 8047 | 76 | 231 | 83 | 0.012 |

| Protein name | | | | Locus Name | | Acc# |
|---|---|---|---|---|---|---|
| unknown | | | | gp:AF007157 | | AF007157 |

Description

*Homo sapiens* clone 23856 unknown mRNA, partial cds.

| ORF Name | NTID | AAID | NT Length | AA Length | Score | Probability |
|---|---|---|---|---|---|---|
| 23546890__c2__120 | 2826 | 8048 | 253 | 762 | 275 | 6.3e−24 |

| Protein name | | | | Locus Name | | Acc# |
|---|---|---|---|---|---|---|
| | | | | sp:YEHT__ECOLI | | |

Description

HYPOTHETICAL 27.9 KD PROTEIN IN MOLR-BGLX INTERGENIC REGION

-continued

| ORF Name | NTID | AAID | NT Length | AA Length | Score | Probability |
|---|---|---|---|---|---|---|
| 23572188_f2_39 | 2827 | 8049 | 568 | 1707 | 392 | 4.1e−50 |

| Protein name | Locus Name | Acc# |
|---|---|---|
| | sp:ACDB_BACSU | P45857 |

Description

ACYL-COA DEHYDROGENASE,

| ORF Name | NTID | AAID | NT Length | AA Length | Score | Probability |
|---|---|---|---|---|---|---|
| 24250285_c3_151 | 2828 | 8050 | 81 | 246 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24407552_c2_102 | 2829 | 8051 | 317 | 954 | 357 | 1.2e−55 |

| Protein name | Locus Name | Acc# |
|---|---|---|
| | sp:DNAJ_THETH | |

Description

DNAJ PROTEIN

| ORF Name | NTID | AAID | NT Length | AA Length | Score | Probability |
|---|---|---|---|---|---|---|
| 24495463_f2_38 | 2830 | 8052 | 344 | 1035 | 710 | 5.1e−70 |

| Protein name | Locus Name | Acc# |
|---|---|---|
| | sp:FIXB_CLOAB | P53578 |

Description

FIXB PROTEIN

| ORF Name | NTID | AAID | NT Length | AA Length | Score | Probability |
|---|---|---|---|---|---|---|
| 24644011_f2_36 | 2831 | 8053 | 628 | 1887 | 441 | 1.6e−41 |

| Protein name | Locus Name | Acc# |
|---|---|---|
| | gp:ATAC005851 | AC005851 |

Description

*Arabidopsis thaliana* chromosome II BAC F24D13 genomic sequence, complete sequence.

| ORF Name | NTID | AAID | NT Length | AA Length | Score | Probability |
|---|---|---|---|---|---|---|
| 2845068_f3_56 | 2832 | 8054 | 70 | 213 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 29476553_f1_6 | 2833 | 8055 | 62 | 189 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 29851437_f2_29 | 2834 | 8056 | 435 | 1308 | 101 | 1.1e−07 |

| Protein name | | | | Locus Name | | Acc# |
|---|---|---|---|---|---|---|
| cysteine proteinase CP1 | | | | pir:S67481 | | S67481 |

Description

| ORF Name | NTID | AAID | NT Length | AA Length | Score | Probability |
|---|---|---|---|---|---|---|
| 3324133_c1_92 | 2835 | 8057 | 62 | 189 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 33619587_c1_96 | 2836 | 8058 | 250 | 753 | 132 | 1.6e−09 |

| Protein name | | | | Locus Name | | Acc# |
|---|---|---|---|---|---|---|
| conserved hypothetical protein | | | | pir:B75483 | | B75483 |

Description

| ORF Name | NTID | AAID | NT Length | AA Length | Score | Probability |
|---|---|---|---|---|---|---|
| 3395627_f2_37 | 2837 | 8059 | 323 | 972 | 446 | 3.9e−47 |

| Protein name | | | | Locus Name | | Acc# |
|---|---|---|---|---|---|---|
| | | | | sp:ETFB_CLOAB | | P52040 |

Description

TRANSFER FLAVOPROTEIN SMALL SUBUNIT) (ETFSS)

| ORF Name | NTID | AAID | NT Length | AA Length | Score | Probability |
|---|---|---|---|---|---|---|
| 34172130_f3_65 | 2838 | 8060 | 1348 | 4047 | 1255 | 1.3e−170 |

| Protein name | | | | Locus Name | | Acc# |
|---|---|---|---|---|---|---|
| | | | | sp:BGAL_BACME | | O52847 |

Description

BETA-GALACTOSIDASE, (LACTASE)

-continued

| ORF Name | NTID | AAID | NT Length | AA Length | Score | Probability |
|---|---|---|---|---|---|---|
| 35556713_c2_100 | 2839 | 8061 | 77 | 234 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 36226538_c3_155 | 2840 | 8062 | 406 | 1221 | 247 | 2.8e−18 |

| Protein name | | | Locus Name | | | Acc# |
|---|---|---|---|---|---|---|
| | | | sp:YEHU_ECOLI | | | |

Description

HYPOTHETICAL 62.1 KD PROTEIN IN MOLR-BGLX INTERGENIC REGION PRECURSOR

| ORF Name | NTID | AAID | NT Length | AA Length | Score | Probability |
|---|---|---|---|---|---|---|
| 4020962_c2_103 | 2841 | 8063 | 106 | 321 | 90 | 0.00026 |

| Protein name | | | Locus Name | | | Acc# |
|---|---|---|---|---|---|---|
| transcription regulator MerR family | | | pir:D70361 | | | D70361 |

Description

| ORF Name | NTID | AAID | NT Length | AA Length | Score | Probability |
|---|---|---|---|---|---|---|
| 4475281_f1_14 | 2842 | 8064 | 587 | 1764 | 187 | 3.4e−11 |

| Protein name | | | Locus Name | | | Acc# |
|---|---|---|---|---|---|---|
| unknown | | | gp:U96771 | | | U96771 |

Description

*Prevotella bryantii* putative polygalacturonase,B-1,4-endoglucanase, and mannanase genes, complete cds; and unknown genes.

| ORF Name | NTID | AAID | NT Length | AA Length | Score | Probability |
|---|---|---|---|---|---|---|
| 6694586_c3_139 | 2843 | 8065 | 62 | 189 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 15633577_f2_1 | 2844 | 8066 | 66 | 201 | 103 | 0.00016 |

| Protein name | | | Locus Name | | | Acc# |
|---|---|---|---|---|---|---|
| penicillin-binding protein 2 | | | gp:AF147448 | | | AF147448 |

Description

*Pseudomonas aeruginosa* strain PAO1 penicillin-binding protein 2 (pbpA), rod-shape-determining protein (rodA), membrane-bound lytictransglycosylase (mltB), rare lipoprotein A (rlpA), penicillin-binding protein 5 (dacA), and lipoate biosynthesis protein B (lipB) genes, complete cds; and unknown gene.

-continued

| ORF Name | NTID | AAID | NT Length | AA Length | Score | Probability |
|---|---|---|---|---|---|---|
| 26595675_f3_5 | 2845 | 8067 | 437 | 1314 | 187 | 2.3e−26 |

| Protein name | Locus Name | Acc# |
|---|---|---|
| | sp:RODA_HAEIN | P44468 |

Description

ROD SHAPE-DETERMINING PROTEIN RODA

| ORF Name | NTID | AAID | NT Length | AA Length | Score | Probability |
|---|---|---|---|---|---|---|
| 14865875_f3_5 | 2846 | 8068 | 346 | 1041 | 784 | 7.3e−78 |

| Protein name | Locus Name | Acc# |
|---|---|---|
| | sp:FEOB_METJA | Q57986 |

Description

FERROUS IRON TRANSPORT PROTEIN B HOMOLOG

| ORF Name | NTID | AAID | NT Length | AA Length | Score | Probability |
|---|---|---|---|---|---|---|
| 36382950_f2_3 | 2847 | 8069 | 94 | 285 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 10734635_f2_10 | 2848 | 8070 | 830 | 2493 | 135 | 1.0e−05 |

| Protein name | Locus Name | Acc# |
|---|---|---|
| unknown | gp:AF124349 | AF124349 |

Description

*Zymomonas mobilis* ZM4 fosmid clone 41A4, complete sequence.

| ORF Name | NTID | AAID | NT Length | AA Length | Score | Probability |
|---|---|---|---|---|---|---|
| 10740952_f1_3 | 2849 | 8071 | 247 | 744 | 121 | 2.1e−05 |

| Protein name | Locus Name | Acc# |
|---|---|---|
| | sp:PA1B_RAT | O35264 |

Description

ACTIVATING FACTOR ACETYLHYDROLASE ALPHA 2 SUBUNIT) (PAF-AH ALPHA 2)

| ORF Name | NTID | AAID | NT Length | AA Length | Score | Probability |
|---|---|---|---|---|---|---|
| 24694837_f1_2 | 2850 | 8072 | 189 | 570 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 34252176_c3_33 | 2851 | 8073 | 559 | 1680 | 567 | 9.4e−54 |

| Protein name | Locus Name | Acc# |
|---|---|---|
| adenylate cyclase homolog | pir:T17197 | T17197 |

Description

| ORF Name | NTID | AAID | NT Length | AA Length | Score | Probability |
|---|---|---|---|---|---|---|
| 34406517_f3_16 | 2852 | 8074 | 1008 | 3027 | 822 | 6.9e−82 |

| Protein name | Locus Name | Acc# |
|---|---|---|
| receptor antigen (RagA) | gp:PGI130872 | AJ130872 |

Description

*Porphyromonas gingivalis* W50 receptor antigen (rag) locus encoding a major immunodominant 55 kDa antigen.

| ORF Name | NTID | AAID | NT Length | AA Length | Score | Probability |
|---|---|---|---|---|---|---|
| 6257826_f3_12 | 2853 | 8075 | 311 | 936 | 113 | 0.012 |

| Protein name | Locus Name | Acc# |
|---|---|---|
| cyclic beta 1-2 glucan synthetase | pir:T31419 | T31419 |

Description

| ORF Name | NTID | AAID | NT Length | AA Length | Score | Probability |
|---|---|---|---|---|---|---|
| 11925285_f2_7 | 2854 | 8076 | 90 | 273 | 187 | 1.3e−14 |

| Protein name | Locus Name | Acc# |
|---|---|---|
|  | sp:Y328_SYNY3 | Q55535 |

Description (EC 3.1.3.48)

| ORF Name | NTID | AAID | NT Length | AA Length | Score | Probability |
|---|---|---|---|---|---|---|
| 11930451_f1_2 | 2855 | 8077 | 112 | 339 | 118 | 2.8e−07 |

| Protein name | Locus Name | Acc# |
|---|---|---|
|  | sp:Y328_SYNY3 | Q55535 |

Description (EC 3.1.3.48)

| ORF Name | NTID | AAID | NT Length | AA Length | Score | Probability |
|---|---|---|---|---|---|---|
| 21875776_c1_27 | 2856 | 8078 | 67 | 204 |  |  |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 237905_f2_10 | 2857 | 8079 | 63 | 192 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24629781_f1_1 | 2858 | 8080 | 494 | 1485 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 25958125_f1_5 | 2859 | 8081 | 392 | 1179 | 643 | 4.2e−84 |

| Protein name | | | | Locus Name | | Acc# |
|---|---|---|---|---|---|---|
| | | | | sp:SYE_BACST | | P22249 |

Description (GLURS)

| ORF Name | NTID | AAID | NT Length | AA Length | Score | Probability |
|---|---|---|---|---|---|---|
| 9765657_c2_36 | 2860 | 8082 | 704 | 2115 | 692 | 4.1e−68 |

| Protein name | | | | Locus Name | | Acc# |
|---|---|---|---|---|---|---|
| | | | | sp:YQFF_BACSU | | |

Description

HYPOTHETICAL 79.2 KD PROTEIN IN PHOH-DGKA INTERGENIC REGION

| ORF Name | NTID | AAID | NT Length | AA Length | Score | Probability |
|---|---|---|---|---|---|---|
| 11756330_f1_2 | 2861 | 8083 | 107 | 324 | 142 | 7.9e−10 |

| Protein name | | | | Locus Name | | Acc# |
|---|---|---|---|---|---|---|
| | | | | sp:YEAQ_ECOLI | | P76246 |

Description

HYPOTHETICAL 8.7 KD PROTEIN IN GAPA-RND INTERGENIC REGION

| ORF Name | NTID | AAID | NT Length | AA Length | Score | Probability |
|---|---|---|---|---|---|---|
| 12189053_f2_10 | 2862 | 8084 | 183 | 552 | 418 | 4.5e−39 |

| Protein name | | | | Locus Name | | Acc# |
|---|---|---|---|---|---|---|
| 30S ribosomal protein S7 | | | | gp:AF087414 | | AF087414 |

Description

*Haemophilus ducreyi* OapA (oapA), OapB (oapB), RfaF (rfaF), 30S ribosomal protein S12, and 30S ribosomal protein S7 genes, complete cds; and elongation factor G gene, partial cds.

-continued

| ORF Name | NTID | AAID | NT Length | AA Length | Score | Probability |
|---|---|---|---|---|---|---|
| 192812_c1_28 | 2863 | 8085 | 161 | 486 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 2238400_c3_63 | 2864 | 8086 | 147 | 444 | 147 | 1.9e−09 |

| Protein name | | | | Locus Name | | Acc# |
|---|---|---|---|---|---|---|
| hypothetical protein Jv0166c | | | | gp:AF121004 | | AF121004 |

Description

*Mycobacterium tuberculosis* H37Rv hypothetical protein Jv0166c (Jv0166c) mRNA, complete cds.

| ORF Name | NTID | AAID | NT Length | AA Length | Score | Probability |
|---|---|---|---|---|---|---|
| 22394692_c1_23 | 2865 | 8087 | 167 | 504 | 245 | 7.0e−20 |

| Protein name | | | | Locus Name | | Acc# |
|---|---|---|---|---|---|---|
| | | | | sp:YHA2_EIKCO | | P35649 |

Description

HYPOTHETICAL 66.3 KD PROTEIN IN HAG2 5' REGION

| ORF Name | NTID | AAID | NT Length | AA Length | Score | Probability |
|---|---|---|---|---|---|---|
| 22460877_f2_9 | 2866 | 8088 | 139 | 420 | 517 | 1.4e−49 |

| Protein name | | | | Locus Name | | Acc# |
|---|---|---|---|---|---|---|
| | | | | sp:RS12_ANANI | | P18662 |

Description

30S RIBOSOMAL PROTEIN S12

| ORF Name | NTID | AAID | NT Length | AA Length | Score | Probability |
|---|---|---|---|---|---|---|
| 24275036_c3_56 | 2867 | 8089 | 90 | 273 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24804717_f1_4 | 2868 | 8090 | 709 | 2130 | 2946 | 0.0 |

| Protein name | | | | Locus Name | | Acc# |
|---|---|---|---|---|---|---|
| EF-G | | | | gp:AB035469 | | AB035469 |

Description

*Porphyromonas gingivalis* gene for EF-G, complete cds, strain:SUNY1021.

-continued

| ORF Name | NTID | AAID | NT Length | AA Length | Score | Probability |
|---|---|---|---|---|---|---|
| 2945300_f1_5 | 2869 | 8091 | 105 | 318 | 326 | 2.5e−29 |

| Protein name | Locus Name | Acc# |
|---|---|---|
| ribosomal protein S10 | gp:AF115283 | AF115283 |

Description

*Leptospira interrogans* S10-spc-alpha locus, complete sequence.

| ORF Name | NTID | AAID | NT Length | AA Length | Score | Probability |
|---|---|---|---|---|---|---|
| 34275250_f3_16 | 2870 | 8092 | 87 | 264 | 73 | 0.022 |

| Protein name | Locus Name | Acc# |
|---|---|---|
| D-29 protein | gp:GHLEA29 | X13203 |

Description

Cotton set 5A Lea gene for seed protein D-29

| ORF Name | NTID | AAID | NT Length | AA Length | Score | Probability |
|---|---|---|---|---|---|---|
| 4064027_c1_29 | 2871 | 8093 | 382 | 1149 | 128 | 1.0e−10 |

| Protein name | Locus Name | Acc# |
|---|---|---|
| hypothetical protein RP338 | pir:D71690 | D71690 |

Description

| ORF Name | NTID | AAID | NT Length | AA Length | Score | Probability |
|---|---|---|---|---|---|---|
| 4562800_f2_7 | 2872 | 8094 | 1437 | 4314 | 4541 | 0.0 |

| Protein name | Locus Name | Acc# |
|---|---|---|
|  | sp:RPOC_PORCN | O33431 |

Description

BETA' CHAIN) (RNA POLYMERASE BETA' SUBUNIT) (FRAGMENT)

| ORF Name | NTID | AAID | NT Length | AA Length | Score | Probability |
|---|---|---|---|---|---|---|
| 4773262_f1_3 | 2873 | 8095 | 110 | 333 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 4881260_f1_6 | 2874 | 8096 | 125 | 378 | 293 | 7.9e−26 |

| Protein name | Locus Name | Acc# |
|---|---|---|
|  | sp:RL3_THETH | P52860 |

Description

50S RIBOSOMAL PROTEIN L3

-continued

| ORF Name | NTID | AAID | NT Length | AA Length | Score | Probability |
|---|---|---|---|---|---|---|
| 501401_c1_21 | 2875 | 8097 | 64 | 195 | 109 | 3.2e−05 |
| Protein name | | | Locus Name | | | Acc# |
| | | | sp:YHA2_EIKCO | | | P35649 |

Description

HYPOTHETICAL 66.3 KD PROTEIN IN HAG2 5' REGION

| ORF Name | NTID | AAID | NT Length | AA Length | Score | Probability |
|---|---|---|---|---|---|---|
| 666025_f3_12 | 2876 | 8098 | 276 | 831 | 892 | 2.6e−89 |
| Protein name | | | Locus Name | | | Acc# |
| DNA-dependent RNA polymerase subunit beta | | | gp:LMY16468 | | | Y16468 |

Description

*Listeria monocytogenes* unidentified gene and partial rpoB gene.

| ORF Name | NTID | AAID | NT Length | AA Length | Score | Probability |
|---|---|---|---|---|---|---|
| 985967_c1_22 | 2877 | 8099 | 142 | 429 | 245 | 7.0e−20 |
| Protein name | | | Locus Name | | | Acc# |
| | | | sp:YHA2_EIKCO | | | P35649 |

Description

HYPOTHETICAL 66.3 KD PROTEIN IN HAG2 5' REGION

| ORF Name | NTID | AAID | NT Length | AA Length | Score | Probability |
|---|---|---|---|---|---|---|
| 11027152_c1_174 | 2878 | 8100 | 95 | 288 | 102 | 1.4e−05 |
| Protein name | | | Locus Name | | | Acc# |
| hypothetical protein PH0133 | | | pir:C71234 | | | C71234 |

Description

| ORF Name | NTID | AAID | NT Length | AA Length | Score | Probability |
|---|---|---|---|---|---|---|
| 1180311_f2_79 | 2879 | 8101 | 132 | 399 | 95 | 7.5e−05 |
| Protein name | | | Locus Name | | | Acc# |
| | | | sp:YGHM_ECOLI | | | P42594 |

Description

HYPOTHETICAL 15.0 KD PROTEIN IN EBGC-UXAA INTERGENIC REGION

| ORF Name | NTID | AAID | NT Length | AA Length | Score | Probability |
|---|---|---|---|---|---|---|
| 12376457_c3_246 | 2880 | 8102 | 495 | 1488 | 1521 | 5.8e−156 |
| Protein name | | | Locus Name | | | Acc# |
| | | | sp:IMDH_AQUAE | | | O67820 |

Description

DEHYDROGENASE) (IMPDH) (IMPD)

-continued

| ORF Name | NTID | AAID | NT Length | AA Length | Score | Probability |
|---|---|---|---|---|---|---|
| 136412_C3_263 | 2881 | 8103 | 788 | 2367 | | |

| Protein name | | | | Locus Name | | Acc# |
|---|---|---|---|---|---|---|
| Description | | | | | | |
| NO-HIT | | | | | | |

| ORF Name | NTID | AAID | NT Length | AA Length | Score | Probability |
|---|---|---|---|---|---|---|
| 13757180_f3_171 | 2882 | 8104 | 60 | 183 | 70 | 0.033 |

| Protein name | | | | Locus Name | | Acc# |
|---|---|---|---|---|---|---|
| hypothetical protein APE1598 | | | | pir:A72539 | | A72539 |
| Description | | | | | | |

| ORF Name | NTID | AAID | NT Length | AA Length | Score | Probability |
|---|---|---|---|---|---|---|
| 13798132_f2_69 | 2883 | 8105 | 68 | 207 | | |

| Protein name | | | | Locus Name | | Acc# |
|---|---|---|---|---|---|---|
| Description | | | | | | |
| NO-HIT | | | | | | |

| ORF Name | NTID | AAID | NT Length | AA Length | Score | Probability |
|---|---|---|---|---|---|---|
| 14890637_c1_200 | 2884 | 8106 | 87 | 264 | | |

| Protein name | | | | Locus Name | | Acc# |
|---|---|---|---|---|---|---|
| Description | | | | | | |
| NO-HIT | | | | | | |

| ORF Name | NTID | AAID | NT Length | AA Length | Score | Probability |
|---|---|---|---|---|---|---|
| 14890637_c1_202 | 2885 | 8107 | 89 | 270 | | |

| Protein name | | | | Locus Name | | Acc# |
|---|---|---|---|---|---|---|
| Description | | | | | | |
| NO-HIT | | | | | | |

| ORF Name | NTID | AAID | NT Length | AA Length | Score | Probability |
|---|---|---|---|---|---|---|
| 15117081_c1_182 | 2886 | 8108 | 259 | 780 | | |

| Protein name | | | | Locus Name | | Acc# |
|---|---|---|---|---|---|---|
| Description | | | | | | |
| NO-HIT | | | | | | |

| ORF Name | NTID | AAID | NT Length | AA Length | Score | Probability |
|---|---|---|---|---|---|---|
| 16445385_c3_248 | 2887 | 8109 | 102 | 309 | | |

| Protein name | | | | Locus Name | | Acc# |
|---|---|---|---|---|---|---|
| Description | | | | | | |
| NO-HIT | | | | | | |

| ORF Name | NTID | AAID | NT Length | AA Length | Score | Probability |
|---|---|---|---|---|---|---|
| 16617812_c1_172 | 2888 | 8110 | 195 | 588 | 127 | 3.1e−08 |

| Protein name | Locus Name | Acc# |
|---|---|---|
| hypothetical protein aq_1103 | pir:A70395 | A70395 |

Description

| ORF Name | NTID | AAID | NT Length | AA Length | Score | Probability |
|---|---|---|---|---|---|---|
| 16832885_c1_194 | 2889 | 8111 | 431 | 1296 | 1723 | 2.3e−177 |

| Protein name | Locus Name | Acc# |
|---|---|---|
| hypothetical protein | pir:JQ1020 | JQ1020 |

Description

| ORF Name | NTID | AAID | NT Length | AA Length | Score | Probability |
|---|---|---|---|---|---|---|
| 16835962_c2_206 | 2890 | 8112 | 63 | 192 | 162 | 6.0e−12 |

| Protein name | Locus Name | Acc# |
|---|---|---|
| | sp:RL32_BACST | P07840 |

Description

50S RIBOSOMAL PROTEIN L32 (RIBOSOMAL PROTEIN I) (BL37)

| ORF Name | NTID | AAID | NT Length | AA Length | Score | Probability |
|---|---|---|---|---|---|---|
| 16839002_C1_181 | 2891 | 8113 | 728 | 2187 | 1183 | 3.8E-120 |

| Protein name | Locus Name | Acc# |
|---|---|---|
| DNA helicase RecQ | pir:G75413 | G75413 |

Description

| ORF Name | NTID | AAID | NT Length | AA Length | Score | Probability |
|---|---|---|---|---|---|---|
| 19537662_c3_251 | 2892 | 8114 | 398 | 1197 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 19725256_c1_192 | 2893 | 8115 | 424 | 1275 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 20007287_c3_234 | 2894 | 8116 | 312 | 939 | 677 | 1.6e−66 |

| Protein name | Locus Name | Acc# |
|---|---|---|
|  | sp:ERA_BACSU | P42182 |

Description

GTP-BINDING PROTEIN ERA HOMOLOG (BEX PROTEIN)

| ORF Name | NTID | AAID | NT Length | AA Length | Score | Probability |
|---|---|---|---|---|---|---|
| 20527135_c1_199 | 2895 | 8117 | 423 | 1272 | 273 | 3.1e−22 |

| Protein name | Locus Name | Acc# |
|---|---|---|
| probable lipopolysaccharide N-acetylglucosaminyltransferase, rfbU | pir:F64500 | F64500 |

Description

| ORF Name | NTID | AAID | NT Length | AA Length | Score | Probability |
|---|---|---|---|---|---|---|
| 20579552_c3_261 | 2896 | 8118 | 495 | 1488 | 172 | 2.1e−10 |

| Protein name | Locus Name | Acc# |
|---|---|---|
|  | sp:Y907_METJA | Q58317 |

Description

HYPOTHETICAL PROTEIN MJ0907

| ORF Name | NTID | AAID | NT Length | AA Length | Score | Probability |
|---|---|---|---|---|---|---|
| 21490762_c1_191 | 2897 | 8119 | 413 | 1242 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 22475317_f1_16 | 2898 | 8120 | 78 | 237 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 22697055_c2_218 | 2899 | 8121 | 88 | 267 |  |  |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 22833311_c3_258 | 2900 | 8122 | 214 | 645 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 22860128_c2_225 | 2901 | 8123 | 83 | 252 | 64 | 0.031 |
| Protein name | | | Locus Name | | | Acc# |
| | | | sp:SPRC_XENLA | | | P36378 |
| Description | | | | | | |
| (OSTEONECTIN) (ON) (BASEMENT MEMBRANE PROTEIN BM-40) | | | | | | |

| ORF Name | NTID | AAID | NT Length | AA Length | Score | Probability |
|---|---|---|---|---|---|---|
| 23448251_f1_37 | 2902 | 8124 | 571 | 1716 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 23626500_c2_211 | 2903 | 8125 | 75 | 228 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 24252127_c3_255 | 2904 | 8126 | 458 | 1377 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 24407802_c1_198 | 2905 | 8127 | 264 | 795 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 24500762_c2_228 | 2906 | 8128 | 203 | 612 | | |
| Protein name | | | Locus Name | | | Acc# |
| Description | | | | | | |
| NO-HIT | | | | | | |

-continued

| ORF Name | NTID | AAID | NT Length | AA Length | Score | Probability |
|---|---|---|---|---|---|---|
| 24509632_c1_173 | 2907 | 8129 | 438 | 1317 | 978 | 2.0e−98 |

| Protein name | | | Locus Name | | | Acc# |
|---|---|---|---|---|---|---|
| | | | sp:YPHC_BACSU | | | P50743 |

Description

REGION

| ORF Name | NTID | AAID | NT Length | AA Length | Score | Probability |
|---|---|---|---|---|---|---|
| 24642262_c3_247 | 2908 | 8130 | 519 | 1560 | 133 | 8.0e−06 |

| Protein name | | | Locus Name | | | Acc# |
|---|---|---|---|---|---|---|
| | | | sp:PRSA_BACSU | | | P24327 |

Description

PROTEIN EXPORT PROTEIN PRSA PRECURSOR

| ORF Name | NTID | AAID | NT Length | AA Length | Score | Probability |
|---|---|---|---|---|---|---|
| 24651442_c1_197 | 2909 | 8131 | 627 | 1884 | 121 | 0.00098 |

| Protein name | | | Locus Name | | | Acc# |
|---|---|---|---|---|---|---|
| MAR binding filament-like protein 1:MFP1 protein | | | pir:T07111 | | | T07111 |

Description

| ORF Name | NTID | AAID | NT Length | AA Length | Score | Probability |
|---|---|---|---|---|---|---|
| 25391905_c1_184 | 2910 | 8132 | 571 | 1716 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 25781265_c3_256 | 2911 | 8133 | 107 | 324 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 25907687_f1_26 | 2912 | 8134 | 69 | 210 | | |

| Protein name | | | Locus Name | | | Acc# |
|---|---|---|---|---|---|---|

Description

NO-HIT

-continued

| ORF Name | NTID | AAID | NT Length | AA Length | Score | Probability |
|---|---|---|---|---|---|---|
| 26289002_c3_233 | 2913 | 8135 | 339 | 1020 | 698 | 9.5e−69 |

| Protein name | Locus Name | Acc# |
|---|---|---|
| synthase III | pir:F70394 | F70394 |

Description

| ORF Name | NTID | AAID | NT Length | AA Length | Score | Probability |
|---|---|---|---|---|---|---|
| 265955_f1_52 | 2914 | 8136 | 130 | 393 | 221 | 3.3e−18 |

| Protein name | Locus Name | Acc# |
|---|---|---|
| RNA-binding protein | gp:SYORBPA | L48548 |

Description

*Synechococcus* sp. PCC 7942 RNA-binding protein (rbpA) gene, complete cds.

| ORF Name | NTID | AAID | NT Length | AA Length | Score | Probability |
|---|---|---|---|---|---|---|
| 27137_c2_226 | 2915 | 8137 | 62 | 189 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 30120936_c3_240 | 2916 | 8138 | 257 | 774 | 933 | 1.2e−93 |

| Protein name | Locus Name | Acc# |
|---|---|---|
| | gp:PGPUT | X97228 |

Description

*P. gingivalis* gpdxJ, put, and yhbG-pg genes.

| ORF Name | NTID | AAID | NT Length | AA Length | Score | Probability |
|---|---|---|---|---|---|---|
| 31447126_c1_203 | 2917 | 8139 | 224 | 675 | 290 | 1.9e−35 |

| Protein name | Locus Name | Acc# |
|---|---|---|
| CMP-N-acetylneuraminic acid synthetase | gp:MMU6215 | AJ006215 |

Description

*Mus musculus* mRNA for CMP-N-acetylneuraminic acid synthetase.

| ORF Name | NTID | AAID | NT Length | AA Length | Score | Probability |
|---|---|---|---|---|---|---|
| 33640927_c1_177 | 2918 | 8140 | 455 | 1368 | 205 | 1.8e−13 |

| Protein name | Locus Name | Acc# |
|---|---|---|
| trigger factor | pir:C70416 | C70416 |

Description

-continued

| ORF Name | NTID | AAID | NT Length | AA Length | Score | Probability |
|---|---|---|---|---|---|---|
| 34081405_c3_231 | 2919 | 8141 | 88 | 267 | 110 | 1.9e−06 |

| Protein name | Locus Name | Acc# |
|---|---|---|
| hypothetical protein PHS004 | pir:F71245 | F71245 |

Description

| ORF Name | NTID | AAID | NT Length | AA Length | Score | Probability |
|---|---|---|---|---|---|---|
| 34165705_f2_114 | 2920 | 8142 | 80 | 243 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 34406640_f3_134 | 2921 | 8143 | 96 | 291 | 127 | 3.1e−08 |

| Protein name | Locus Name | Acc# |
|---|---|---|
| | sp:YGJN_ECOLI | P42595 |

Description

HYPOTHETICAL 12.1 KD PROTEIN IN EBGC-UXAA INTERGENIC REGION

| ORF Name | NTID | AAID | NT Length | AA Length | Score | Probability |
|---|---|---|---|---|---|---|
| 35343757_f2_104 | 2922 | 8144 | 260 | 783 | 453 | 8.7e−43 |

| Protein name | Locus Name | Acc# |
|---|---|---|
| probable ribonucleotide transport ATP-binding protein mk1 (mk1) RP097 | pir:H71718 | H71718 |

Description

| ORF Name | NTID | AAID | NT Length | AA Length | Score | Probability |
|---|---|---|---|---|---|---|
| 35661528_f1_47 | 2923 | 8145 | 84 | 255 | 119 | 2.7e−07 |

| Protein name | Locus Name | Acc# |
|---|---|---|
| hypothetical protein | gp:BSZ75208 | Z75208 |

Description

*B. subtilis* genomic sequence 89009bp.

| ORF Name | NTID | AAID | NT Length | AA Length | Score | Probability |
|---|---|---|---|---|---|---|
| 3929055_c3_260 | 2924 | 8146 | 410 | 1233 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 4073567_c2_229 | 2925 | 8147 | 403 | 1212 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4100002_c1_201 | 2926 | 8148 | 83 | 252 | 72 | 0.020 |

| Protein name | Locus Name | Acc# |
|---|---|---|
| | sp:MT13_MYTED | P80248 |

Description

METALLOTHIONEIN 10-III (MT-10-III)

| ORF Name | NTID | AAID | NT Length | AA Length | Score | Probability |
|---|---|---|---|---|---|---|
| 4178555_c1_193 | 2927 | 8149 | 167 | 504 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 42700_c1_195 | 2928 | 8150 | 268 | 807 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4490938_c2_215 | 2929 | 8151 | 418 | 1257 | 1153 | 5.8e−117 |

| Protein name | Locus Name | Acc# |
|---|---|---|
| ClpX protein | gp:BSCLPXGEN | X95306 |

Description

*B. subtilis* clpX gene.

| ORF Name | NTID | AAID | NT Length | AA Length | Score | Probability |
|---|---|---|---|---|---|---|
| 48776_c3_242 | 2930 | 8152 | 246 | 741 | 585 | 9.0e−57 |

| Protein name | Locus Name | Acc# |
|---|---|---|
| ATP-dependent protease proteolytic subunit ClpP | gp:AF127082 | AF127082 |

Description

*Myxococcus xanthus* ATP-dependent protease proteolytic subunit ClpP (clpP), ATP-dependent protease ATPase subunit ClpX (clpX), prolylendopeptidase precursor Pep (pep), ATP-dependent protease LonV (lonV), oligopeptide permease homolog OppA (oppA), oligopeptidepermease homolog OppB (oppB), and oligopeptide permease homolog OppC (oppC) genes, complete cds.

-continued

| ORF Name | NTID | AAID | NT Length | AA Length | Score | Probability |
|---|---|---|---|---|---|---|
| 4882801_c2_227 | 2931 | 8153 | 139 | 420 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 4957677_c1_183 | 2932 | 8154 | 459 | 1380 | 252 | 5.2e−19 |

| Protein name | | | | Locus Name | | Acc# |
|---|---|---|---|---|---|---|
| | | | | sp:SURA_ECOLI | | |

Description

SURA), (PPIASE) (ROTAMASE C)

| ORF Name | NTID | AAID | NT Length | AA Length | Score | Probability |
|---|---|---|---|---|---|---|
| 6695412_f3_159 | 2933 | 8155 | 323 | 972 | 333 | 4.5e−30 |

| Protein name | | | | Locus Name | | Acc# |
|---|---|---|---|---|---|---|
| conserved hypothetical protein aq_355 | | | | pir:E70331 | | E70331 |

Description

| ORF Name | NTID | AAID | NT Length | AA Length | Score | Probability |
|---|---|---|---|---|---|---|
| 6757757_c3_249 | 2934 | 8156 | 634 | 1905 | 838 | 1.4e−83 |

| Protein name | | | | Locus Name | | Acc# |
|---|---|---|---|---|---|---|
| | | | | sp:MUTL_BACSU | | P49850 |

Description

DNA MISMATCH REPAIR PROTEIN MUTL

| ORF Name | NTID | AAID | NT Length | AA Length | Score | Probability |
|---|---|---|---|---|---|---|
| 781290_c3_236 | 2935 | 8157 | 236 | 711 | 268 | 3.5e−23 |

| Protein name | | | | Locus Name | | Acc# |
|---|---|---|---|---|---|---|
| vsrD protein | | | | pir:I40540 | | I40540 |

Description

| ORF Name | NTID | AAID | NT Length | AA Length | Score | Probability |
|---|---|---|---|---|---|---|
| 818785_c3_262 | 2936 | 8158 | 410 | 1233 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 130278_c3_244 | 2937 | 8159 | 539 | 1620 | 1138 | 2.3e−115 |

| Protein name | Locus Name | Acc# |
|---|---|---|
| phosphoribosylaminoimidazolecarboxamide formyltransferase | pir:C70468 | C70468 |

Description

| ORF Name | NTID | AAID | NT Length | AA Length | Score | Probability |
|---|---|---|---|---|---|---|
| 13688436_c1_177 | 2938 | 8160 | 127 | 384 | 171 | 6.7e−13 |

| Protein name | Locus Name | Acc# |
|---|---|---|
| YHCF | gp:AB024564 | AB024564 |

Description

*Bacillus halodurans* gene for TNPA, ERMK, YCBJ, YHCG, YHCF and YHCE, complete cds.

| ORF Name | NTID | AAID | NT Length | AA Length | Score | Probability |
|---|---|---|---|---|---|---|
| 14570812_c1_175 | 2939 | 8161 | 220 | 663 | 94 | 0.0032 |

| Protein name | Locus Name | Acc# |
|---|---|---|
|  | sp:EXB1_XANCP | O34259 |

Description

BIOPOLYMER TRANSPORT EXBD1 PROTEIN

| ORF Name | NTID | AAID | NT Length | AA Length | Score | Probability |
|---|---|---|---|---|---|---|
| 15714000_f2_81 | 2940 | 8162 | 473 | 1422 | 895 | 1.3e−89 |

| Protein name | Locus Name | Acc# |
|---|---|---|
|  | gn:BNRRTEAB |  |

Description

*Bacteroides thetaiotaomicron* rteA and rtaB genes involved in production of plasmid-like forms, complete cds, and tetQ gene, 3' end.

| ORF Name | NTID | AAID | NT Length | AA Length | Score | Probability |
|---|---|---|---|---|---|---|
| 16832885_f1_22 | 2941 | 8163 | 431 | 1296 | 1723 | 2.3e−177 |

| Protein name | Locus Name | Acc# |
|---|---|---|
| hypothetical protein | pir:JQ1020 | JQ1020 |

Description

| ORF Name | NTID | AAID | NT Length | AA Length | Score | Probability |
|---|---|---|---|---|---|---|
| 17079008_c1_179 | 2942 | 8164 | 288 | 867 | 162 | 3.5e−10 |

| Protein name | Locus Name | Acc# |
|---|---|---|
| unknown | gp:AF062647 | AF062647 |

Description

*Butyrivibrio fibrisolvens* bytyrivibriocin OR79 (bvi79) gene, complete cds; and unknown genes.

-continued

| ORF Name | NTID | AAID | NT Length | AA Length | Score | Probability |
|---|---|---|---|---|---|---|
| 19570256_c1_180 | 2943 | 8165 | 513 | 1542 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 195812_c1_178 | 2944 | 8166 | 269 | 810 | 75 | 0.048 |

| Protein name | | | | Locus Name | | Acc# |
|---|---|---|---|---|---|---|
| | | | | gp:YSCMTRF21 | | |

Description

Yeast (*S. uvarum*) mitochondria RF2 gene, segment 1.

| ORF Name | NTID | AAID | NT Length | AA Length | Score | Probability |
|---|---|---|---|---|---|---|
| 22860128_f2_77 | 2945 | 8167 | 83 | 252 | 64 | 0.031 |

| Protein name | | | | Locus Name | | Acc# |
|---|---|---|---|---|---|---|
| | | | | sp:SPRC_XENLA | | P36378 |

Description (OSTEONECTIN) (ON) (BASEMENT MEMBRANE PROTEIN BM-40)

| ORF Name | NTID | AAID | NT Length | AA Length | Score | Probability |
|---|---|---|---|---|---|---|
| 2350306_f3_169 | 2946 | 8168 | 100 | 303 | 105 | 6.6e−06 |

| Protein name | | | | Locus Name | | Acc# |
|---|---|---|---|---|---|---|
| hypothetical protein PH0217 | | | | pir:G71244 | | G71244 |

Description

| ORF Name | NTID | AAID | NT Length | AA Length | Score | Probability |
|---|---|---|---|---|---|---|
| 23625127_c1_173 | 2947 | 8169 | 283 | 852 | 197 | 1.2e−15 |

| Protein name | | | | Locus Name | | Acc# |
|---|---|---|---|---|---|---|
| TolQ protein | | | | gp:PPPAL1 | | X74218 |

Description

*Pseudomonas putida* ruvB, tolQ, tolR, tolA, tolB and oprL genes.

| ORF Name | NTID | AAID | NT Length | AA Length | Score | Probability |
|---|---|---|---|---|---|---|
| 23870287_f3_126 | 2948 | 8170 | 65 | 198 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 23944506_f1_45 | 2949 | 8171 | 64 | 195 | 106 | 5.1e−06 |

| Protein name | Locus Name | Acc# |
|---|---|---|
| hypothetical protein PH0219 | pir:A71245 | A71245 |

Description

| ORF Name | NTID | AAID | NT Length | AA Length | Score | Probability |
|---|---|---|---|---|---|---|
| 24015950_c2_208 | 2950 | 8172 | 792 | 2379 | 107 | 0.00022 |

| Protein name | Locus Name | Acc# |
|---|---|---|
| outer membrane protein Omp85 | gp:AF021245 | AF021245 |

Description

*Neisseria meningitidis* outer membrane protein Omp85 (omp85) gene, complete cds.

| ORF Name | NTID | AAID | NT Length | AA Length | Score | Probability |
|---|---|---|---|---|---|---|
| 24229677_c3_238 | 2951 | 8173 | 283 | 852 | 388 | 6.7e−36 |

| Protein name | Locus Name | Acc# |
|---|---|---|
| NorM | gp:AB010463 | AB010463 |

Description

*Vibrio parahaemolyticus* gene for NorM, complete cds.

| ORF Name | NTID | AAID | NT Length | AA Length | Score | Probability |
|---|---|---|---|---|---|---|
| 24484666_c2_215 | 2952 | 8174 | 347 | 1044 | 761 | 2.0e−75 |

| Protein name | Locus Name | Acc# |
|---|---|---|
| rod shape determining protein MreB | pir:B70373 | B70373 |

Description

| ORF Name | NTID | AAID | NT Length | AA Length | Score | Probability |
|---|---|---|---|---|---|---|
| 24487803_f2_93 | 2953 | 8175 | 70 | 213 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24641925_c3_243 | 2954 | 8176 | 798 | 2397 | 110 | 0.033 |

| Protein name | Locus Name | Acc# |
|---|---|---|
| 115K outer membrane protein precursor:SusC protein | pir:JC6027 | JC6027 |

Description

-continued

| ORF Name | NTID | AAID | NT Length | AA Length | Score | Probability |
|---|---|---|---|---|---|---|
| 24647752_c3_225 | 2955 | 8177 | 479 | 1440 | 178 | 1.2e-10 |

| Protein name | Locus Name | Acc# |
|---|---|---|
| conserved hypothetical protein MTH83 | pir:F69210 | F69210 |

Description

| ORF Name | NTID | AAID | NT Length | AA Length | Score | Probability |
|---|---|---|---|---|---|---|
| 25635393_c3_245 | 2956 | 8178 | 187 | 564 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 266067_f1_27 | 2957 | 8179 | 102 | 309 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 26673162_f3_152 | 2958 | 8180 | 65 | 198 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 26767842_c2_216 | 2959 | 8181 | 364 | 1092 | 442 | 1.8e-41 |

| Protein name | Locus Name | Acc# |
|---|---|---|
| penicillin-binding protein 2 | gp:AF147448 | AF147448 |

Description

*Pseudomonas aeruginosa* strain PAO1 penicillin-binding protein 2 (pbpA), rod-shape-determining protein (rodA), membrane-bound lytictransglycosylase (mltB), rare lipoprotein A (rlpA), penicillin-binding protein 5 (dacA), and lipoate biosynthesisprotein B (lipB) genes, complete cds; and unknown gene.

| ORF Name | NTID | AAID | NT Length | AA Length | Score | Probability |
|---|---|---|---|---|---|---|
| 282708_f2_107 | 2960 | 8182 | 60 | 183 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 29350402_c1_196 | 2961 | 8183 | 290 | 873 | 193 | 5.0e−14 |

| Protein name | Locus Name | Acc# |
|---|---|---|
| rod shape-determining protein (mreC) homolog | pir:C70189 | C70189 |

Description

| ORF Name | NTID | AAID | NT Length | AA Length | Score | Probability |
|---|---|---|---|---|---|---|
| 30656500_c2_214 | 2962 | 8184 | 681 | 2046 | 1802 | 9.8e−186 |

| Protein name | Locus Name | Acc# |
|---|---|---|
| PepO | gp:AB010440 | AB010440 |

Description

*Porphyromonas gingivalis* gene for PepO, complete cds.

| ORF Name | NTID | AAID | NT Length | AA Length | Score | Probability |
|---|---|---|---|---|---|---|
| 3157802_c2_204 | 2963 | 8185 | 422 | 1269 | 514 | 3.0e−49 |

| Protein name | Locus Name | Acc# |
|---|---|---|
|  | sp:Y4WA_RHISN | P55679 |

Description

HYPOTHETICAL ZINC PROTEASE Y4WA,

| ORF Name | NTID | AAID | NT Length | AA Length | Score | Probability |
|---|---|---|---|---|---|---|
| 31813761_f1_37 | 2964 | 8186 | 85 | 258 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 33210875_c1_182 | 2965 | 8187 | 252 | 759 | 647 | 2.4e−63 |

| Protein name | Locus Name | Acc# |
|---|---|---|
|  | sp:FABG_BACSU |  |

Description

ACYL CARRIER PROTEIN REDUCTASE)

| ORF Name | NTID | AAID | NT Length | AA Length | Score | Probability |
|---|---|---|---|---|---|---|
| 34081405_c3_220 | 2966 | 8188 | 88 | 267 | 110 | 1.9e−06 |

| Protein name | Locus Name | Acc# |
|---|---|---|
| hypothetical protein PHS004 | pir:F71245 | F71245 |

Description

-continued

| ORF Name | NTID | AAID | NT Length | AA Length | Score | Probability |
|---|---|---|---|---|---|---|
| 36151575_c3_228 | 2967 | 8189 | 462 | 1389 | 212 | 2.5e-14 |

| Protein name | Locus Name | Acc# |
|---|---|---|
| erythromycin esterase homolog ybfO | pir:A69750 | A69750 |

Description

| ORF Name | NTID | AAID | NT Length | AA Length | Score | Probability |
|---|---|---|---|---|---|---|
| 3937535_c3_236 | 2968 | 8190 | 200 | 603 | 166 | 1.6e-11 |

| Protein name | Locus Name | Acc# |
|---|---|---|
| NorM | gp:AB010463 | AB010463 |

Description

*Vibrio parahaemolyticus* gene for NorM, complete cds.

| ORF Name | NTID | AAID | NT Length | AA Length | Score | Probability |
|---|---|---|---|---|---|---|
| 394135_c3_231 | 2969 | 8191 | 243 | 732 | 276 | 5.0e-24 |

| Protein name | Locus Name | Acc# |
|---|---|---|
|  | sp:YG29_SYNY3 | P74346 |

Description

HYPOTHETICAL 36.0 KD PROTEIN SLR1629

| ORF Name | NTID | AAID | NT Length | AA Length | Score | Probability |
|---|---|---|---|---|---|---|
| 4040878_c3_239 | 2970 | 8192 | 767 | 2304 | 725 | 1.9e-75 |

| Protein name | Locus Name | Acc# |
|---|---|---|
| tetracycline resistance element regulator | pir:A41860 | A41860 |

Description

| ORF Name | NTID | AAID | NT Length | AA Length | Score | Probability |
|---|---|---|---|---|---|---|
| 4741507_c2_198 | 2971 | 8193 | 319 | 960 | 154 | 4.6e-14 |

| Protein name | Locus Name | Acc# |
|---|---|---|
| phosphate ABC transporter, periplasmic phosphate-binding protein | pir:C72276 | C72276 |

Description

| ORF Name | NTID | AAID | NT Length | AA Length | Score | Probability |
|---|---|---|---|---|---|---|
| 4806377_c1_174 | 2972 | 8194 | 205 | 618 | 109 | 4.2e-06 |

| Protein name | Locus Name | Acc# |
|---|---|---|
| ExbD2 | gp:AF047974 | AF047974 |

Description

*Vibrio cholerae* TolR (tolR), ExbB2 (exbB2), ExbD2 (exbD2), and TonB2 (tonB2) genes, complete cds; and unknown genes.

-continued

| ORF Name | NTID | AAID | NT Length | AA Length | Score | Probability |
|---|---|---|---|---|---|---|
| 4877187_c3_224 | 2973 | 8195 | 274 | 825 | 153 | 8.2e−09 |

| Protein name | Locus Name | Acc# |
|---|---|---|
| | sp:TONB_HELPY | O25899 |

Description

TONB PROTEIN

| ORF Name | NTID | AAID | NT Length | AA Length | Score | Probability |
|---|---|---|---|---|---|---|
| 4880452_c2_200 | 2974 | 8196 | 300 | 903 | 512 | 4.9e−49 |

| Protein name | Locus Name | Acc# |
|---|---|---|
| ABC transporter MutF | gp:AF082183 | AF082183 |

Description

*Streptococcus mutans* ABC transporter MutF (mutF), membrane spanning protein MutE (mutE), and membrane protein MutG (mutG) genes, complete cds; and fructose bi-phosphate aldolase (fba) gene, partial cds.

| ORF Name | NTID | AAID | NT Length | AA Length | Score | Probability |
|---|---|---|---|---|---|---|
| 4954682_c1_176 | 2975 | 8197 | 275 | 828 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 5120327_c2_199 | 2976 | 8198 | 286 | 861 | 457 | 3.3e−43 |

| Protein name | Locus Name | Acc# |
|---|---|---|
| ABC transporter, ATP-binding protein homolog | pir:D70171 | D70171 |

Description

| ORF Name | NTID | AAID | NT Length | AA Length | Score | Probability |
|---|---|---|---|---|---|---|
| 5132937_c2_213 | 2977 | 8199 | 653 | 1962 | 1066 | 9.6e−108 |

| Protein name | Locus Name | Acc# |
|---|---|---|
| ABC-type transport protein slr0864:protein slr0864:protein slr0864 | pir:S74849 | S74849 |

Description

| ORF Name | NTID | AAID | NT Length | AA Length | Score | Probability |
|---|---|---|---|---|---|---|
| 6369006_c1_181 | 2978 | 8200 | 199 | 600 | 143 | 6.2e−10 |

| Protein name | Locus Name | Acc# |
|---|---|---|
| | sp:YP23_STAAU | P23217 |

Description

HYPOTHETICAL TRANSCRIPTIONAL REGULATOR IN QACA 5' REGION (ORF 188)

-continued

| ORF Name | NTID | AAID | NT Length | AA Length | Score | Probability |
|---|---|---|---|---|---|---|
| 6425_c3_222 | 2979 | 8201 | 165 | 498 | | |
| Protein name | | | | Locus Name | | Acc# |
| Description | | | | | | |

NO-HIT

| ORF Name | NTID | AAID | NT Length | AA Length | Score | Probability |
|---|---|---|---|---|---|---|
| 663463_c2_207 | 2980 | 8202 | 1518 | 4557 | | |
| Protein name | | | | Locus Name | | Acc# |
| Description | | | | | | |

NO-HIT

| ORF Name | NTID | AAID | NT Length | AA Length | Score | Probability |
|---|---|---|---|---|---|---|
| 6966_f2_109 | 2981 | 8203 | 76 | 228 | 54 | 0.034 |
| Protein name | | | | Locus Name | | Acc# |
| unknown | | | | gp:MHU75508 | | U75508 |
| Description | | | | | | |

*Marinococcus halophilus* plasmid pPL1, complete sequence.

| ORF Name | NTID | AAID | NT Length | AA Length | Score | Probability |
|---|---|---|---|---|---|---|
| 7225883_c3_235 | 2982 | 8204 | 301 | 906 | 165 | 1.3e−22 |
| Protein name | | | | Locus Name | | Acc# |
| CGI-124 protein | | | | gp:AF151882 | | AF151882 |
| Description | | | | | | |

*Homo sapiens* CGI-124 protein mRNA, complete cds.

| ORF Name | NTID | AAID | NT Length | AA Length | Score | Probability |
|---|---|---|---|---|---|---|
| 865757_f2_103 | 2983 | 8205 | 128 | 387 | | |
| Protein name | | | | Locus Name | | Acc# |
| Description | | | | | | |

NO-HIT

| ORF Name | NTID | AAID | NT Length | AA Length | Score | Probability |
|---|---|---|---|---|---|---|
| 9845313_c2_209 | 2984 | 8206 | 333 | 1002 | | |
| Protein name | | | | Locus Name | | Acc# |
| Description | | | | | | |

NO-HIT

-continued

| ORF Name | NTID | AAID | NT Length | AA Length | Score | Probability |
|---|---|---|---|---|---|---|
| 24644061_c2_20 | 2985 | 8207 | 256 | 771 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 30272067_f2_6 | 2986 | 8208 | 726 | 2181 | 567 | 4.7e−56 |

| Protein name | | | | Locus Name | | Acc# |
|---|---|---|---|---|---|---|
| hybrid histidine kinase homolog | | | | gp:AF024619 | | AF024619 |

Description

*Pseudomonas fluorescens* hybrid histidine kinase homolog (styS) and response regulatory protein (styR) genes, complete cds.

| ORF Name | NTID | AAID | NT Length | AA Length | Score | Probability |
|---|---|---|---|---|---|---|
| 33400260_c1_15 | 2987 | 8209 | 536 | 1611 | 124 | 0.00030 |

| Protein name | | | | Locus Name | | Acc# |
|---|---|---|---|---|---|---|
| STARP antigen | | | | gp:PFSTARP | | Z26314 |

Description

*P. falciparum* gene for STARP antigen.

| ORF Name | NTID | AAID | NT Length | AA Length | Score | Probability |
|---|---|---|---|---|---|---|
| 830003_f2_10 | 2988 | 8210 | 73 | 222 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 9862501_f2_9 | 2989 | 8211 | 109 | 330 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 10547781_f1_4 | 2990 | 8212 | 124 | 375 | 145 | 3.8e−10 |

| Protein name | | | | Locus Name | | Acc# |
|---|---|---|---|---|---|---|
| hypothetical protein sll0939 | | | | pir:S74723 | | S74723 |

Description

-continued

| ORF Name | NTID | AAID | NT Length | AA Length | Score | Probability |
|---|---|---|---|---|---|---|
| 16832885_c3_86 | 2991 | 8213 | 431 | 1296 | 1723 | 2.3e-177 |

| Protein name | Locus Name | Acc# |
|---|---|---|
| hypothetical protein | pir:JQ1020 | JQ1020 |

Description

| ORF Name | NTID | AAID | NT Length | AA Length | Score | Probability |
|---|---|---|---|---|---|---|
| 22475387_c2_82 | 2992 | 8214 | 76 | 231 | 74 | 0.013 |

| Protein name | Locus Name | Acc# |
|---|---|---|
| envelope glycoprotein | gp:AF113578 | AF113578 |

Description

HIV-1 isolate 302_04 group O from Spain envelope glycoprotein (env) gene, partial cds.

| ORF Name | NTID | AAID | NT Length | AA Length | Score | Probability |
|---|---|---|---|---|---|---|
| 22848261_f3_53 | 2993 | 8215 | 687 | 2064 | 110 | 1.0e-05 |

| Protein name | Locus Name | Acc# |
|---|---|---|
| conserved hypothetical protein MTH695 | pir:F69192 | F69192 |

Description

| ORF Name | NTID | AAID | NT Length | AA Length | Score | Probability |
|---|---|---|---|---|---|---|
| 22860128_c1_54 | 2994 | 8216 | 83 | 252 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 23453775_f1_11 | 2995 | 8217 | 837 | 2514 | 170 | 2.7e-09 |

| Protein name | Locus Name | Acc# |
|---|---|---|
| conserved hypothetical protein | pir:G72385 | G72385 |

Description

| ORF Name | NTID | AAID | NT Length | AA Length | Score | Probability |
|---|---|---|---|---|---|---|
| 23525938_c3_103 | 2996 | 8218 | 85 | 258 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 25816887_f2_17 | 2997 | 8219 | 148 | 447 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 26598385_c3_96 | 2998 | 8220 | 456 | 1371 | 772 | 1.4e−76 |

| Protein name | Locus Name | Acc# |
|---|---|---|
| transcription regulator NtrC family | pir:C70396 | C70396 |

Description

| ORF Name | NTID | AAID | NT Length | AA Length | Score | Probability |
|---|---|---|---|---|---|---|
| 30276562_f3_47 | 2999 | 8221 | 495 | 1488 | 148 | 4.2e−07 |

| Protein name | Locus Name | Acc# |
|---|---|---|
| immunoreactive 52kD antigen PG41 | gp:AF175716 | AF175716 |

Description

*Porphyromonas gingivalis* strain W50 immunoreactive 52kD antigen PG41 gene, complete cds.

| ORF Name | NTID | AAID | NT Length | AA Length | Score | Probability |
|---|---|---|---|---|---|---|
| 31486011_c3_102 | 3000 | 8222 | 153 | 462 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 31486011_f2_15 | 3001 | 8223 | 74 | 225 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 33244627_f3_34 | 3002 | 8224 | 212 | 639 | 122 | 0.00016 |

| Protein name | Locus Name | Acc# |
|---|---|---|
| hypothetical protein H02F09.3 | pir:T33369 | T33369 |

Description

| ORF Name | NTID | AAID | NT Length | AA Length | Score | Probability |
|---|---|---|---|---|---|---|
| 33382801_f3_39 | 3003 | 8225 | 81 | 246 | 65 | 0.0051 |

| Protein name | Locus Name | Acc# |
|---|---|---|
| | sp:YF03_MYCPN | P75445 |

Description

HYPOTHETICAL 85.3 KD PROTEIN F10_ORF750

-continued

| ORF Name | NTID | AAID | NT Length | AA Length | Score | Probability |
|---|---|---|---|---|---|---|
| 33407256_f2_26 | 3004 | 8226 | 434 | 1305 | 172 | 4.3e−10 |

| Protein name | Locus Name | Acc# |
|---|---|---|
| hypothetical protein aq_294 | pir:H70326 | H70326 |

Description

| ORF Name | NTID | AAID | NT Length | AA Length | Score | Probability |
|---|---|---|---|---|---|---|
| 3407187_c2_81 | 3005 | 8227 | 429 | 1290 | 260 | 2.8e−20 |

| Protein name | Locus Name | Acc# |
|---|---|---|
| sensor | gp:PSEFLESR | L41213 |

Description

*Pseudomonas aeruginosa* (strain PAK) putative fleR kinase (fleS) and transcriptional activator (fleR) genes, complete cds.

| ORF Name | NTID | AAID | NT Length | AA Length | Score | Probability |
|---|---|---|---|---|---|---|
| 3937553_c1_66 | 3006 | 8228 | 417 | 1254 | 115 | 2.5e−06 |

| Protein name | Locus Name | Acc# |
|---|---|---|
| integrase | gp:BFU75371 | U75371 |

Description

*Bacteroides fragilis* transposon Tn4555 TnpA (tnpA), integrase (int), TnpC (tnpC), excisionase (xis), mobilization protein (mobA), and beta-lactamase (cfxA) genes, complete cds; and unknown genes.

| ORF Name | NTID | AAID | NT Length | AA Length | Score | Probability |
|---|---|---|---|---|---|---|
| 4179002_c1_67 | 3007 | 8229 | 210 | 633 | 106 | 0.014 |

| Protein name | Locus Name | Acc# |
|---|---|---|
| high-molecular-weight surface-exposed protein HMW1 | pir:A43855 | A43855 |

Description

| ORF Name | NTID | AAID | NT Length | AA Length | Score | Probability |
|---|---|---|---|---|---|---|
| 6651552_f3_35 | 3008 | 8230 | 125 | 378 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 10640787_f2_57 | 3009 | 8231 | 229 | 690 | 541 | 4.1e−52 |

| Protein name | Locus Name | Acc# |
|---|---|---|
| yhgF protein | pir:B65136 | B65136 |

Description

-continued

| ORF Name | NTID | AAID | NT Length | AA Length | Score | Probability |
|---|---|---|---|---|---|---|
| 10664125_c2_136 | 3010 | 8232 | 982 | 2949 | 578 | 1.2e−93 |

| Protein name | Locus Name | Acc# |
|---|---|---|
| putative secreted protein | gp:SCM11 | AL133278 |

Description

*Streptomyces coelicolor* cosmid M11.

| ORF Name | NTID | AAID | NT Length | AA Length | Score | Probability |
|---|---|---|---|---|---|---|
| 10822142_c2_148 | 3011 | 8233 | 60 | 183 | 94 | 0.00081 |

| Protein name | Locus Name | Acc# |
|---|---|---|
| transposase | gp:AF038866 | AF038866 |

Description

*Bacteroides fragilis* transposon Tn5520 transposase (bipH) and mobilization protein BmpH (bmpH) genes, complete cds.

| ORF Name | NTID | AAID | NT Length | AA Length | Score | Probability |
|---|---|---|---|---|---|---|
| 10945937_c3_159 | 3012 | 8234 | 104 | 315 | 137 | 2.6e−08 |

| Protein name | Locus Name | Acc# |
|---|---|---|
|  | sp:YDEG_SCHPO | Q10449 |

Description

HYPOTHETICAL 57.2 KD PROTEIN C12B10.16C IN CHROMOSOME I

| ORF Name | NTID | AAID | NT Length | AA Length | Score | Probability |
|---|---|---|---|---|---|---|
| 193757_c2_135 | 3013 | 8235 | 1054 | 3165 | 874 | 2.1e−87 |

| Protein name | Locus Name | Acc# |
|---|---|---|
| 115K outer membrane protein precursor:SusC protein | pirJC6027 | JC6027 |

Description

| ORF Name | NTID | AAID | NT Length | AA Length | Score | Probability |
|---|---|---|---|---|---|---|
| 19688750_f2_41 | 3014 | 8236 | 61 | 186 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 21484385_f3_81 | 3015 | 8237 | 78 | 237 |  |  |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 23469015_c2_152 | 3016 | 8238 | 250 | 753 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 24039688_c1_115 | 3017 | 8239 | 391 | 1176 | 457 | 6.4e−53 |
| Protein name | | | Locus Name | | | Acc# |
| alkaline phosphatase | | | pir:B72410 | | | B72410 |
| Description | | | | | | |

| ORF Name | NTID | AAID | NT Length | AA Length | Score | Probability |
|---|---|---|---|---|---|---|
| 24219562_c1_111 | 3018 | 8240 | 98 | 297 | 102 | 7.3e−05 |
| Protein name | | | Locus Name | | | Acc# |
| glucokinase | | | pir:F72246 | | | F72246 |
| Description | | | | | | |

| ORF Name | NTID | AAID | NT Length | AA Length | Score | Probability |
|---|---|---|---|---|---|---|
| 24226532_f3_92 | 3019 | 8241 | 407 | 1224 | 423 | 1.3e−39 |
| Protein name | | | Locus Name | | | Acc# |
| | | | sp:XYLR_HAEIN | | | P45043 |
| Description | | | | | | |

XYLOSE OPERON REGULATORY PROTEIN

| ORF Name | NTID | AAID | NT Length | AA Length | Score | Probability |
|---|---|---|---|---|---|---|
| 24308311_f2_49 | 3020 | 8242 | 135 | 408 | 141 | 2.0e−09 |
| Protein name | | | Locus Name | | | Acc# |
| transposase slr0511:protein slr0511:protein slr0511 | | | pir:S76643 | | | S76643 |
| Description | | | | | | |

| ORF Name | NTID | AAID | NT Length | AA Length | Score | Probability |
|---|---|---|---|---|---|---|
| 24645312_f3_87 | 3021 | 8243 | 291 | 876 | 104 | 0.0026 |
| Protein name | | | Locus Name | | | Acc# |
| homolog yvqC | | | pir:E70045 | | | E70045 |
| Description | | | | | | |

-continued

| ORF Name | NTID | AAID | NT Length | AA Length | Score | Probability |
|---|---|---|---|---|---|---|
| 25662812_f3_86 | 3022 | 8244 | 85 | 258 | | |
| Protein name | | | | Locus Name | | Acc# |
| | | | | | | |

Description

NO-HIT

| ORF Name | NTID | AAID | NT Length | AA Length | Score | Probability |
|---|---|---|---|---|---|---|
| 25976567_f2_55 | 3023 | 8245 | 397 | 1194 | 113 | 0.0015 |
| Protein name | | | | Locus Name | | Acc# |
| immunoreactive 42kD antigen PG33 | | | | gp:AF175715 | | AF175715 |

Description

*Porphyromonas gingivalis* strain W50 immunoreactive 42kD antigen PG33 gene, complete cds.

| ORF Name | NTID | AAID | NT Length | AA Length | Score | Probability |
|---|---|---|---|---|---|---|
| 262_c2_134 | 3024 | 8246 | 143 | 432 | | |
| Protein name | | | | Locus Name | | Acc# |
| | | | | | | |

Description

NO-HIT

| ORF Name | NTID | AAID | NT Length | AA Length | Score | Probability |
|---|---|---|---|---|---|---|
| 26699155_c3_181 | 3025 | 8247 | 184 | 555 | | |
| Protein name | | | | Locus Name | | Acc# |
| | | | | | | |

Description

NO-HIT

| ORF Name | NTID | AAID | NT Length | AA Length | Score | Probability |
|---|---|---|---|---|---|---|
| 2923212_c2_154 | 3026 | 8248 | 565 | 1698 | | |
| Protein name | | | | Locus Name | | Acc# |
| | | | | | | |

Description

NO-HIT

| ORF Name | NTID | AAID | NT Length | AA Length | Score | Probability |
|---|---|---|---|---|---|---|
| 31929762_c2_138 | 3027 | 8249 | 391 | 1176 | 779 | 2.5e−77 |
| Protein name | | | | Locus Name | | Acc# |
| | | | | sp:YDEG_SCHPO | | Q10449 |

Description

HYPOTHETICAL 57.2 KD PROTEIN C12B10.16C IN CHROMOSOME I

-continued

| ORF Name | NTID | AAID | NT Length | AA Length | Score | Probability |
|---|---|---|---|---|---|---|
| 33709813_f3_84 | 3028 | 8250 | 62 | 189 | | |
| Protein name | | | | Locus Name | | Acc# |
| Description | | | | | | |

NO-HIT

| ORF Name | NTID | AAID | NT Length | AA Length | Score | Probability |
|---|---|---|---|---|---|---|
| 34429807_f2_52 | 3029 | 8251 | 207 | 624 | | |
| Protein name | | | | Locus Name | | Acc# |
| Description | | | | | | |

NO-HIT

| ORF Name | NTID | AAID | NT Length | AA Length | Score | Probability |
|---|---|---|---|---|---|---|
| 36230267_c3_180 | 3030 | 8252 | 376 | 1131 | 237 | 5.0e−24 |
| Protein name | | | | Locus Name | | Acc# |
| immunoreactive 53 kD antigen PG123 | | | | gp:AF144641 | | AF144641 |
| Description | | | | | | |

*Porphyromonas gingivalis* strain W50 immunoreactive 53 kD antigen PG123 gene, complete cds.

| ORF Name | NTID | AAID | NT Length | AA Length | Score | Probability |
|---|---|---|---|---|---|---|
| 3914587_c1_112 | 3031 | 8253 | 193 | 582 | 236 | 8.6e−20 |
| Protein name | | | | Locus Name | | Acc# |
| hypothetical protein | | | | pir:S76053 | | S76053 |
| Description | | | | | | |

| ORF Name | NTID | AAID | NT Length | AA Length | Score | Probability |
|---|---|---|---|---|---|---|
| 4104637_c1_133 | 3032 | 8254 | 381 | 1146 | 115 | 0.00058 |
| Protein name | | | | Locus Name | | Acc# |
| clostripain-related protein | | | | pir:B72365 | | B72365 |
| Description | | | | | | |

| ORF Name | NTID | AAID | NT Length | AA Length | Score | Probability |
|---|---|---|---|---|---|---|
| 4149180_c2_150 | 3033 | 8255 | 61 | 186 | 54 | 0.0081 |
| Protein name | | | | Locus Name | | Acc# |
| hypothetical protein T03F7.4 | | | | pir:T24404 | | T24404 |
| Description | | | | | | |

-continued

| ORF Name | NTID | AAID | NT Length | AA Length | Score | Probability |
|---|---|---|---|---|---|---|
| 4192187_c1_129 | 3034 | 8256 | 481 | 1446 | 210 | 3.6e-14 |
| Protein name | | | | Locus Name | | Acc# |
| transposase | | | | gp:AF038866 | | AF038866 |
| Description | | | | | | |

*Bacteroides fragilis* transposon Tn5520 transposase (bipH) and mobilization protein BmpH (bmpH) genes, complete cds.

| ORF Name | NTID | AAID | NT Length | AA Length | Score | Probability |
|---|---|---|---|---|---|---|
| 4423386_c3_157 | 3035 | 8257 | 290 | 873 | 152 | 2.6e-08 |
| Protein name | | | | Locus Name | | Acc# |
| Hyp1 protein | | | | gp:HVHYP1PRO | | Y09797 |
| Description | | | | | | |

*H. vulgaris* mRNA for Hyp1 protein.

| ORF Name | NTID | AAID | NT Length | AA Length | Score | Probability |
|---|---|---|---|---|---|---|
| 4804632_c1_116 | 3036 | 8258 | 389 | 1170 | 197 | 8.8e-13 |
| Protein name | | | | Locus Name | | Acc# |
| conserved hypothetical protein TP0931 | | | | pir:D71264 | | D71264 |
| Description | | | | | | |

| ORF Name | NTID | AAID | NT Length | AA Length | Score | Probability |
|---|---|---|---|---|---|---|
| 4876556_f3_89 | 3037 | 8259 | 715 | 2148 | 181 | 1.9e-10 |
| Protein name | | | | Locus Name | | Acc# |
| immunoreactive 53 kD antigen PG123 | | | | gp:AF144641 | | AF144641 |
| Description | | | | | | |

*Porphyromonas gingivalis* strain W50 immunoreactive 53 kD antigenPG123 gene, complete cds.

| ORF Name | NTID | AAID | NT Length | AA Length | Score | Probability |
|---|---|---|---|---|---|---|
| 4960760_c1_117 | 3038 | 8260 | 487 | 1464 | 230 | 2.4e-21 |
| Protein name | | | | Locus Name | | Acc# |
| | | | | gp:ATAC004411 | | AC004411 |
| Description | | | | | | |

*Arabidopsis thaliana* chromosome II BAC F14M4 genomic sequence, complete sequence.

| ORF Name | NTID | AAID | NT Length | AA Length | Score | Probability |
|---|---|---|---|---|---|---|
| 6442905_c3_158 | 3039 | 8261 | 189 | 570 | 171 | 4.9e-12 |
| Protein name | | | | Locus Name | | Acc# |
| conserved hypothetical protein TP0931 | | | | pir:D71264 | | D71264 |
| Description | | | | | | |

-continued

| ORF Name | NTID | AAID | NT Length | AA Length | Score | Probability |
|---|---|---|---|---|---|---|
| 6694705_c1_128 | 3040 | 8262 | 180 | 543 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 7126086_f1_32 | 3041 | 8263 | 63 | 192 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 785882_c1_113 | 3042 | 8264 | 551 | 1656 | 110 | 2.2e−07 |

| Protein name | | | | Locus Name | | Acc# |
|---|---|---|---|---|---|---|
| unknown | | | | gp:U96771 | | U96771 |

Description

*Prevotella bryantii* putative polygalacturonase, B-1,4-endoglucanse, and mannanase genes, complete cds; and unknown genes.

| ORF Name | NTID | AAID | NT Length | AA Length | Score | Probability |
|---|---|---|---|---|---|---|
| 859452_c1_120 | 3043 | 8265 | 261 | 786 | 241 | 2.5e−20 |

| Protein name | | | | Locus Name | | Acc# |
|---|---|---|---|---|---|---|
| probable transmembrane protein | | | | pir:T34651 | | T34651 |

Description

| ORF Name | NTID | AAID | NT Length | AA Length | Score | Probability |
|---|---|---|---|---|---|---|
| 897187_c1_127 | 3044 | 8266 | 532 | 1599 | 276 | 1.2e−21 |

| Protein name | | | | Locus Name | | Acc# |
|---|---|---|---|---|---|---|
| hypothetical protein PAB1002 | | | | pir:G75064 | | G75064 |

Description

| ORF Name | NTID | AAID | NT Length | AA Length | Score | Probability |
|---|---|---|---|---|---|---|
| 10035453_c1_59 | 3045 | 8267 | 74 | 225 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 1052188_c3_87 | 3046 | 8268 | 68 | 207 | 71 | 0.028 |

| Protein name | | | | Locus Name | | Acc# |
|---|---|---|---|---|---|---|
| gp59 | | | | gp:BA1242593 | | AJ242593 |

Description
Bacteriophage A118 complete genome.

| ORF Name | NTID | AAID | NT Length | AA Length | Score | Probability |
|---|---|---|---|---|---|---|
| 13089760_f2_19 | 3047 | 8269 | 77 | 234 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 14650012_c3_92 | 3048 | 8270 | 536 | 1611 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 14664813_c1_64 | 3049 | 8271 | 62 | 189 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 15742327_c2_79 | 3050 | 8272 | 66 | 201 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 16210456_f1_8 | 3051 | 8273 | 107 | 324 | 213 | 9.1e−17 |

| Protein name | | | | Locus Name | | Acc# |
|---|---|---|---|---|---|---|
| conserved hypothetical protein BB0262 | | | | pir:F70132 | | F70132 |

Description

| ORF Name | NTID | AAID | NT Length | AA Length | Score | Probability |
|---|---|---|---|---|---|---|
| 16680455_f3_48 | 3052 | 8274 | 138 | 417 | | |

| Protein name | | | | Locus Name | | Acc# |
|---|---|---|---|---|---|---|

Description

NO-HIT

-continued

| ORF Name | NTID | AAID | NT Length | AA Length | Score | Probability |
|---|---|---|---|---|---|---|
| 22946087_f1_9 | 3053 | 8275 | 108 | 327 | 70 | 0.033 |

| Protein name | | | | Locus Name | | Acc# |
|---|---|---|---|---|---|---|
| hypothetical protein 62 | | | | pir:T31025 | | T31025 |

Description

| ORF Name | NTID | AAID | NT Length | AA Length | Score | Probability |
|---|---|---|---|---|---|---|
| 23554057_f3_35 | 3054 | 8276 | 412 | 1239 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24219067_f1_5 | 3055 | 8277 | 62 | 189 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24398917_f3_38 | 3056 | 8278 | 135 | 408 | 112 | 4.2e−06 |

| Protein name | | | | Locus Name | | Acc# |
|---|---|---|---|---|---|---|
| conserved hypothetical protein | | | | pir:G72380 | | G72380 |

Description

| ORF Name | NTID | AAID | NT Length | AA Length | Score | Probability |
|---|---|---|---|---|---|---|
| 25633312_f3_34 | 3057 | 8279 | 69 | 210 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 29921938_f1_16 | 3058 | 8280 | 297 | 894 | 435 | 7.0e−41 |

| Protein name | | | | Locus Name | | Acc# |
|---|---|---|---|---|---|---|
| | | | | sp:YF23_HAEIN | | P44243 |

Description

HYPOTHETICAL PROTEIN HI1523

-continued

| ORF Name | NTID | AAID | NT Length | AA Length | Score | Probability |
|---|---|---|---|---|---|---|
| 30355305_c3_90 | 3059 | 8281 | 271 | 816 | 411 | 2.5e−38 |
| Protein name | | | | Locus Name | | Acc# |
| | | | | sp:SOJ_BACSU | | P37522 |
| Description | | | | | | |
| SOJ PROTEIN | | | | | | |

| ORF Name | NTID | AAID | NT Length | AA Length | Score | Probability |
|---|---|---|---|---|---|---|
| 32069806_f3_33 | 3060 | 8282 | 332 | 999 | | |
| Protein name | | | | Locus Name | | Acc# |
| Description | | | | | | |
| NO-HIT | | | | | | |

| ORF Name | NTID | AAID | NT Length | AA Length | Score | Probability |
|---|---|---|---|---|---|---|
| 33882837_c3_91 | 3061 | 8283 | 97 | 294 | 80 | 0.024 |
| Protein name | | | | Locus Name | | Acc# |
| hypothetical protein F20D10.230 | | | | pir:T05638 | | T05638 |
| Description | | | | | | |

| ORF Name | NTID | AAID | NT Length | AA Length | Score | Probability |
|---|---|---|---|---|---|---|
| 34181512_2_31 | 3062 | 8284 | 207 | 624 | | |
| Protein name | | | | Locus Name | | Acc# |
| Description | | | | | | |
| NO-HIT | | | | | | |

| ORF Name | NTID | AAID | NT Length | AA Length | Score | Probability |
|---|---|---|---|---|---|---|
| 34182813_f1_7 | 3063 | 8285 | 260 | 783 | | |
| Protein name | | | | Locus Name | | Acc# |
| Description | | | | | | |
| NO-HIT | | | | | | |

| ORF Name | NTID | AAID | NT Length | AA Length | Score | Probability |
|---|---|---|---|---|---|---|
| 34407928_f2_20 | 3064 | 8286 | 134 | 405 | | |
| Protein name | | | | Locus Name | | Acc# |
| Description | | | | | | |
| NO-HIT | | | | | | |

| ORF Name | NTID | AAID | NT Length | AA Length | Score | Probability |
|---|---|---|---|---|---|---|
| 35267037_f2_23 | 3065 | 8287 | 117 | 354 | | |
| Protein name | | | | Locus Name | | Acc# |
| Description | | | | | | |
| NO-HIT | | | | | | |

-continued

| ORF Name | NTID | AAID | NT Length | AA Length | Score | Probability |
|---|---|---|---|---|---|---|
| 36562555_c3_86 | 3066 | 8288 | 64 | 195 | | |
| Protein name | | | Locus Name | | Acc# | |

Description

NO-HIT

| ORF Name | NTID | AAID | NT Length | AA Length | Score | Probability |
|---|---|---|---|---|---|---|
| 36613586_c1_56 | 3067 | 8289 | 65 | 198 | | |
| Protein name | | | Locus Name | | Acc# | |

Description

NO-HIT

| ORF Name | NTID | AAID | NT Length | AA Length | Score | Probability |
|---|---|---|---|---|---|---|
| 4182811_f3_40 | 3068 | 8290 | 393 | 1182 | | |
| Protein name | | | Locus Name | | Acc# | |

Description

NO-HIT

| ORF Name | NTID | AAID | NT Length | AA Length | Score | Probability |
|---|---|---|---|---|---|---|
| 831463_c1_67 | 3069 | 8291 | 141 | 426 | | |
| Protein name | | | Locus Name | | Acc# | |

Description

NO-HIT

| ORF Name | NTID | AAID | NT Length | AA Length | Score | Probability |
|---|---|---|---|---|---|---|
| 839217_c3_93 | 3070 | 8292 | 120 | 363 | | |
| Protein name | | | Locus Name | | Acc# | |

Description

NO-HIT

| ORF Name | NTID | AAID | NT Length | AA Length | Score | Probability |
|---|---|---|---|---|---|---|
| 10820311_c2_198 | 3071 | 8293 | 230 | 693 | | |
| Protein name | | | Locus Name | | Acc# | |

Description

NO-HIT

| ORF Name | NTID | AAID | NT Length | AA Length | Score | Probability |
|---|---|---|---|---|---|---|
| 11881375_f2_45 | 3072 | 8294 | 177 | 534 | 445 | 6.1e−42 |
| Protein name | | | Locus Name | | Acc# | |
| | | | sp:YACN_BACSU | | Q06756 | |

Description

HYPOTHETICAL 17.1 KD PROTEIN IN MECB-GLTX INTERGENIC REGION

-continued

| ORF Name | NTID | AAID | NT Length | AA Length | Score | Probability |
|---|---|---|---|---|---|---|
| 12929693_f3_78 | 3073 | 8295 | 261 | 786 | 372 | 3.3e−34 |

| Protein name | | | | Locus Name | | Acc# |
|---|---|---|---|---|---|---|
| | | | | sp:YAAA_ECOLI | | P11288 |

Description

HYPOTHETICAL 29.6 KD PROTEIN IN THRC-TALB INTERGENIC REGIN

| ORF Name | NTID | AAID | NT Length | AA Length | Score | Probability |
|---|---|---|---|---|---|---|
| 1367043_f3_81 | 3074 | 8296 | 477 | 1434 | 424 | 1.0e−39 |

| Protein name | | | | Locus Name | | Acc# |
|---|---|---|---|---|---|---|
| | | | | sp:RLUB_BACSU | | P35159 |

Description (PSEUDOURIDYLATE SYNTHASE) (URACIL HYDROLASE)

| ORF Name | NTID | AAID | NT Length | AA Length | Score | Probability |
|---|---|---|---|---|---|---|
| 1444087_f2_50 | 3075 | 8297 | 208 | 627 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 14647277_c3_235 | 3076 | 8298 | 337 | 1014 | 1216 | 1.2e−123 |

| Protein name | | | | Locus Name | | Acc# |
|---|---|---|---|---|---|---|
| immunoreactive 36 kDa antigen PG14 | | | | gp:AF145798 | | AF145798 |

Description

*Porphyromonas gingivalis* strain W50 immunoreactive 36 kDa antigen PG14 gene, complete cds.

| ORF Name | NTID | AAID | NT Length | AA Length | Score | Probability |
|---|---|---|---|---|---|---|
| 14886027_f3_79 | 3077 | 8299 | 185 | 558 | 416 | 7.3e−39 |

| Protein name | | | | Locus Name | | Acc# |
|---|---|---|---|---|---|---|
| | | | | sp:MAA_BACSU | | P37515 |

Description

TRANSACETYLASE)

| ORF Name | NTID | AAID | NT Length | AA Length | Score | Probability |
|---|---|---|---|---|---|---|
| 19799013_f2_32 | 3078 | 8300 | 138 | 417 | | |

| Protein name | | | | Locus Name | | Acc# |
|---|---|---|---|---|---|---|

Description

NO-HIT

-continued

| ORF Name | NTID | AAID | NT Length | AA Length | Score | Probability |
|---|---|---|---|---|---|---|
| 20312630_f3_80 | 3079 | 8301 | 478 | 1437 | 1372 | 3.6e−140 |

| Protein name | Locus Name | Acc# |
|---|---|---|
| adenylosuccinate lyase | gp:LMFP1421 | AL132764 |

Description

Leishmania major Friedlin chromosome 4 PAC P1421.

| ORF Name | NTID | AAID | NT Length | AA Length | Score | Probability |
|---|---|---|---|---|---|---|
| 21679756_c2_180 | 3080 | 8302 | 642 | 1929 | 112 | 2.3e−11 |

| Protein name | Locus Name | Acc# |
|---|---|---|
|  | sp:THIO_HELPY | P56430 |

Description

THIOREDOXIN (TRX)

| ORF Name | NTID | AAID | NT Length | AA Length | Score | Probability |
|---|---|---|---|---|---|---|
| 23553426_f2_57 | 3081 | 8303 | 344 | 1035 | 827 | 2.0e−82 |

| Protein name | Locus Name | Acc# |
|---|---|---|
|  | sp:ILVE_HAEIN | P54689 |

Description

B) (BCAT)

| ORF Name | NTID | AAID | NT Length | AA Length | Score | Probability |
|---|---|---|---|---|---|---|
| 23989077_f1_17 | 3082 | 8304 | 268 | 807 | 379 | 6.1e−35 |

| Protein name | Locus Name | Acc# |
|---|---|---|
| conserved hypothetical protein | pir:E72226 | E72226 |

Description

| ORF Name | NTID | AAID | NT Length | AA Length | Score | Probability |
|---|---|---|---|---|---|---|
| 24023442_f3_85 | 3083 | 8305 | 282 | 849 | 603 | 1.1e−58 |

| Protein name | Locus Name | Acc# |
|---|---|---|
| ribosomal protein S2 (rpsB):ribsomal protein BS1 | pir:A69699 |  |

Description

| ORF Name | NTID | AAID | NT Length | AA Length | Score | Probability |
|---|---|---|---|---|---|---|
| 24026561_c1_148 | 3084 | 8306 | 93 | 282 | 78 | 0.0093 |

| Protein name | Locus Name | Acc# |
|---|---|---|
| late expression factor 2 homolog lef-2 | gp:AF002732 | AF002732 |

Description

Cydia pomonella granulovirus late expression factor 2 homolog lef-2gene, complete cds.

-continued

| ORF Name | NTID | AAID | NT Length | AA Length | Score | Probability |
|---|---|---|---|---|---|---|
| 24328386_c2_177 | 3085 | 8307 | 239 | 720 | 111 | 0.00037 |

| Protein name | Locus Name | Acc# |
|---|---|---|
| | sp:YQEF_BACSU | P54451 |

Description

PRECURSOR

| ORF Name | NTID | AAID | NT Length | AA Length | Score | Probability |
|---|---|---|---|---|---|---|
| 24412511_f3_83 | 3086 | 8308 | 160 | 483 | 373 | 2.6e−34 |

| Protein name | Locus Name | Acc# |
|---|---|---|
| ribosomal protein L13 | pir:F71677 | F71677 |

Description

| ORF Name | NTID | AAID | NT Length | AA Length | Score | Probability |
|---|---|---|---|---|---|---|
| 24414827_f1_18 | 3087 | 8309 | 252 | 759 | 293 | 7.9e−26 |

| Protein name | Locus Name | Acc# |
|---|---|---|
| conserved hypothetical protein ytmQ | pir:B69997 | B69997 |

Description

| ORF Name | NTID | AAID | NT Length | AA Length | Score | Probability |
|---|---|---|---|---|---|---|
| 24651013_c1_122 | 3088 | 8310 | 486 | 1461 | 244 | 1.0e−17 |

| Protein name | Locus Name | Acc# |
|---|---|---|
| lipase-like protein | pir:A64706 | A64706 |

Description

| ORF Name | NTID | AAID | NT Length | AA Length | Score | Probability |
|---|---|---|---|---|---|---|
| 2470802_c1_127 | 3089 | 8311 | 420 | 1263 | 367 | 1.1e−33 |

| Protein name | Locus Name | Acc# |
|---|---|---|
| conserved hypothetical integral membrane protein HP1486 | pir:F64705 | F64705 |

Description

| ORF Name | NTID | AAID | NT Length | AA Length | Score | Probability |
|---|---|---|---|---|---|---|
| 25415626_c3_238 | 3090 | 8312 | 681 | 2046 | 371 | 2.4e−44 |

| Protein name | Locus Name | Acc# |
|---|---|---|
| alpha-glucosidase | gp:BTU66897 | U66897 |

Description

*Bacteroides thetaiotaomicron* neopullulanse (susA) and alpha-glucosidase (susB) genes, complete cds.

-continued

| ORF Name | NTID | AAID | NT Length | AA Length | Score | Probability |
|---|---|---|---|---|---|---|
| 25440900_c1_158 | 3091 | 8313 | 460 | 1383 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 25588962_f3_88 | 3092 | 8314 | 224 | 675 | 357 | 1.3e−32 |

| Protein name | Locus Name | Acc# |
|---|---|---|
| hypothetical protein ydiH | pir:A69787 | A69787 |

Description

| ORF Name | NTID | AAID | NT Length | AA Length | Score | Probability |
|---|---|---|---|---|---|---|
| 26254813_c3_253 | 3093 | 8315 | 290 | 873 | 89 | 0.0016 |

| Protein name | Locus Name | Acc# |
|---|---|---|
| splicing regulatory protein SWAP homolog (alternatively spliced, clone pFL2) | pir:A54037 | A54037 |

Description

| ORF Name | NTID | AAID | NT Length | AA Length | Score | Probability |
|---|---|---|---|---|---|---|
| 26283262_f2_43 | 3094 | 8316 | 166 | 501 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 26353388_f3_92 | 3095 | 8317 | 411 | 1236 | 425 | 8.1e−40 |

| Protein name | Locus Name | Acc# |
|---|---|---|
| probable exodeoxyribonuclease VII large subunit | pir:C75549 | C75549 |

Description

| ORF Name | NTID | AAID | NT Length | AA Length | Score | Probability |
|---|---|---|---|---|---|---|
| 26365887_f3_86 | 3096 | 8318 | 335 | 1008 | 354 | 1.1e−41 |

| Protein name | Locus Name | Acc# |
|---|---|---|
| | sp:EFTS_MYCTU | Q10788 |

Description

ELONGATION FACTOR TS (EF-TS)

-continued

| ORF Name | NTID | AAID | NT Length | AA Length | Score | Probability |
|---|---|---|---|---|---|---|
| 26454391_c1_128 | 3097 | 8319 | 272 | 819 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 26600263_f3_84 | 3098 | 8320 | 130 | 393 | 318 | 1.8e−28 |

| Protein name | | | | Locus Name | | Acc# |
|---|---|---|---|---|---|---|
| | | | | sp:RS9_MYCTU | | O06259 |

Description

30S RIBOSOMAL PROTEIN S9

| ORF Name | NTID | AAID | NT Length | AA Length | Score | Probability |
|---|---|---|---|---|---|---|
| 2756327_c2_209 | 3099 | 8321 | 98 | 297 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 29407552_f1_13 | 3100 | 8322 | 81 | 246 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 29745386_f1_15 | 3101 | 8323 | 400 | 1203 | 624 | 6.6e−61 |

| Protein name | | | | Locus Name | | Acc# |
|---|---|---|---|---|---|---|
| hypothetical protein RP306 | | | | pir:E71686 | | E71686 |

Description

| ORF Name | NTID | AAID | NT Length | AA Length | Score | Probability |
|---|---|---|---|---|---|---|
| 30160336_c2_195 | 3102 | 8324 | 68 | 207 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 31676510_f3_95 | 3103 | 8325 | 337 | 1014 | 680 | 7.7e−67 |

| Protein name | Locus Name | Acc# |
|---|---|---|
|  | sp:MRP_SYNY3 | P53383 |

Description

MRP PROTEIN HOMOLOG

| ORF Name | NTID | AAID | NT Length | AA Length | Score | Probability |
|---|---|---|---|---|---|---|
| 33398425_f2_72 | 3104 | 8326 | 861 | 2586 | 178 | 4.3e−11 |

| Protein name | Locus Name | Acc# |
|---|---|---|
| unknown | gp:AF007381 | AF007381 |

Description

*Flavobacterium johnsoniae* gliding motility protein (gldA) gene, complete cds; and unknown genes.

| ORF Name | NTID | AAID | NT Length | AA Length | Score | Probability |
|---|---|---|---|---|---|---|
| 3361250_f2_73 | 3105 | 8327 | 188 | 567 | 160 | 9.7e−12 |

| Protein name | Locus Name | Acc# |
|---|---|---|
| RNA polymerase sigma factor SigZ-like protein | gp:AF137263 | AF137263 |

Description

*Bacteroides thetaiotamicron* 30S ribosomal protein S16-like protein, fucose gene cluster, and RNa polymerase sigma factor SigZ-like protein (sigZ) genes, complete cds.

| ORF Name | NTID | AAID | NT Length | AA Length | Score | Probability |
|---|---|---|---|---|---|---|
| 33722640_f3_91 | 3106 | 8328 | 153 | 462 | 202 | 6.6e−15 |

| Protein name | Locus Name | Acc# |
|---|---|---|
| subtilisin sendai homolog | pir:C69456 | C69456 |

Description

| ORF Name | NTID | AAID | NT Length | AA Length | Score | Probability |
|---|---|---|---|---|---|---|
| 33847078_f2_51 | 3107 | 8329 | 80 | 243 | 72 | 0.021 |

| Protein name | Locus Name | Acc# |
|---|---|---|
| phase−1 flagellin | pir:S33191 | S33191 |

Description

| ORF Name | NTID | AAID | NT Length | AA Length | Score | Probability |
|---|---|---|---|---|---|---|
| 34105313_c2_179 | 3108 | 8330 | 590 | 1773 | 136 | 4.1e−06 |

| Protein name | Locus Name | Acc# |
|---|---|---|
|  | sp:TONB_HELPY | O25899 |

Description

TONB PROTEIN

-continued

| ORF Name | NTID | AAID | NT Length | AA Length | Score | Probability |
|---|---|---|---|---|---|---|
| 34648582_f3_118 | 3109 | 8331 | 319 | 960 | 134 | 3.2e−06 |

| Protein name | Locus Name | Acc# |
|---|---|---|
| transmembrane sensor | gp:AF051691 | AF051691 |

Description

*Pseudomonas aeruginosa* stress factor A (psfA), ECF sigma factor (fiuI), transmembrane sensor (fiuR), and hydroxamate-type ferrisiderophore receptor (fiuA) genes, complete cds.

| ORF Name | NTID | AAID | NT Length | AA Length | Score | Probability |
|---|---|---|---|---|---|---|
| 35312692_f3_74 | 3110 | 8332 | 526 | 1581 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 35625007_c3_245 | 3111 | 8333 | 431 | 1296 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 35944140_f3_90 | 3112 | 8334 | 301 | 906 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 36579090_c2_175 | 3113 | 8335 | 347 | 1044 | 197 | 2.7e−13 |

| Protein name | Locus Name | Acc# |
|---|---|---|
| hypothetical protein jhp1380 | pir:G71815 | G71815 |

Description

| ORF Name | NTID | AAID | NT Length | AA Length | Score | Probability |
|---|---|---|---|---|---|---|
| 4095887_f2_56 | 3114 | 8336 | 73 | 222 | 79 | 0.0037 |

| Protein name | Locus Name | Acc# |
|---|---|---|
| exodeoxyribonuclease VII, small chain | pir:JQ06664 | |

Description

-continued

| ORF Name | NTID | AAID | NT Length | AA Length | Score | Probability |
|---|---|---|---|---|---|---|
| 4142762_f1_5 | 3115 | 8337 | 470 | 1413 | 1396 | 1.0e−142 |

| Protein name | Locus Name | Acc# |
|---|---|---|
| | sp:SYN_SYNY3 | P52276 |

Description

LIGASE) (ASNRS)

| ORF Name | NTID | AAID | NT Length | AA Length | Score | Probability |
|---|---|---|---|---|---|---|
| 4379427_c3_240 | 3116 | 8338 | 124 | 375 | 131 | 1.2e−08 |

| Protein name | Locus Name | Acc# |
|---|---|---|
| | sp:BLAI_STAAU | P18415 |

Description

REPRESSOR PROTEIN)

| ORF Name | NTID | AAID | NT Length | AA Length | Score | Probability |
|---|---|---|---|---|---|---|
| 4485312_c3_271 | 3117 | 8339 | 746 | 2241 | 505 | 5.9e−47 |

| Protein name | Locus Name | Acc# |
|---|---|---|
| | sp:NAGH_CLOPE | P26831 |

Description (MU TOXIN)

| ORF Name | NTID | AAID | NT Length | AA Length | Score | Probability |
|---|---|---|---|---|---|---|
| 4883507_c1_152 | 3118 | 8340 | 119 | 360 | 181 | 5.8e−14 |

| Protein name | Locus Name | Acc# |
|---|---|---|
| | sp:Y546_SYNY3 | Q55397 |

Description

HYPOTHETICAL 11.9 KD PROTEIN SLL0546

| ORF Name | NTID | AAID | NT Length | AA Length | Score | Probability |
|---|---|---|---|---|---|---|
| 5275292_f3_89 | 3119 | 8341 | 205 | 618 | 387 | 8.6e−36 |

| Protein name | Locus Name | Acc# |
|---|---|---|
| isomerase like protein | gp:ATFCA5 | Z97340 |

Description

*Arabidopsis thaliana* DNA chromosome 4, ESSA I FCA contig fragment No. 5.

| ORF Name | NTID | AAID | NT Length | AA Length | Score | Probability |
|---|---|---|---|---|---|---|
| 5285687_f1_16 | 3120 | 8342 | 93 | 282 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 78375_f1_3 | 3121 | 8343 | 643 | 1932 | 957 | 3.4e−96 |
| Protein name | | | | Locus Name | | Acc# |
| | | | | sp:BGAL_XANMN | | P48982 |
| Description | | | | | | |
| BETA-GALACTOSIDASE PRECURSOR, (LACTASE) | | | | | | |

| ORF Name | NTID | AAID | NT Length | AA Length | Score | Probability |
|---|---|---|---|---|---|---|
| 876937_c2_216 | 3122 | 8344 | 64 | 195 | | |
| Protein name | | | | Locus Name | | Acc# |
| Description | | | | | | |
| NO-HIT | | | | | | |

| ORF Name | NTID | AAID | NT Length | AA Length | Score | Probability |
|---|---|---|---|---|---|---|
| 10023300_c2_107 | 3123 | 8345 | 105 | 318 | | |
| Protein name | | | | Locus Name | | Acc# |
| Description | | | | | | |
| NO-HIT | | | | | | |

| ORF Name | NTID | AAID | NT Length | AA Length | Score | Probability |
|---|---|---|---|---|---|---|
| 10603388_c3_138 | 3124 | 8346 | 331 | 996 | 341 | 6.4e−31 |
| Protein name | | | | Locus Name | | Acc# |
| | | | | sp:YEIH_ECOLI | | P33019 |
| Description | | | | | | |
| HYPOTHETICAL 36.9 KD PROTEIN IN LYSP-NFO INTERGENIC REGION | | | | | | |

| ORF Name | NTID | AAID | NT Length | AA Length | Score | Probability |
|---|---|---|---|---|---|---|
| 11882812_f3_64 | 3125 | 8347 | 143 | 432 | 130 | 1.5e−08 |
| Protein name | | | | Locus Name | | Acc# |
| conserved hypothetical protein TP0412 | | | | pir:B71327 | | B71327 |
| Description | | | | | | |

| ORF Name | NTID | AAID | NT Length | AA Length | Score | Probability |
|---|---|---|---|---|---|---|
| 1204010_c2_106 | 3126 | 8348 | 140 | 423 | | |
| Protein name | | | | Locus Name | | Acc# |
| Description | | | | | | |
| NO-HIT | | | | | | |

| ORF Name | NTID | AAID | NT Length | AA Length | Score | Probability |
|---|---|---|---|---|---|---|
| 13065655_c3_123 | 3127 | 8349 | 274 | 825 | 1083 | 1.5e−109 |

| Protein name | | | Locus Name | | Acc# | |
|---|---|---|---|---|---|---|
| hypothetical protein | | | pir:JQ1020 | | JQ1020 | |

Description

| ORF Name | NTID | AAID | NT Length | AA Length | Score | Probability |
|---|---|---|---|---|---|---|
| 14730313_f3_59 | 3128 | 8350 | 868 | 2607 | 2435 | 8.2e−253 |

| Protein name | | | Locus Name | | Acc# | |
|---|---|---|---|---|---|---|
| | | | sp:CLPB_SYNY3 | | P74361 | |

Description

CLPB PROTEIN

| ORF Name | NTID | AAID | NT Length | AA Length | Score | Probability |
|---|---|---|---|---|---|---|
| 15641008_c3_132 | 3129 | 8351 | 92 | 279 | | |

| Protein name | | | Locus Name | | Acc# | |
|---|---|---|---|---|---|---|

Description

NO-HIT

| ORF Name | NTID | AAID | NT Length | AA Length | Score | Probability |
|---|---|---|---|---|---|---|
| 16832885_c2_116 | 3130 | 8352 | 431 | 1296 | 1723 | 2.3e−177 |

| Protein name | | | Locus Name | | Acc# | |
|---|---|---|---|---|---|---|
| hypothetical protein | | | pir:JQ1020 | | JQ1020 | |

Description

| ORF Name | NTID | AAID | NT Length | AA Length | Score | Probability |
|---|---|---|---|---|---|---|
| 16989052_f2_27 | 3131 | 8353 | 189 | 570 | 378 | 7.7e−35 |

| Protein name | | | Locus Name | | Acc# | |
|---|---|---|---|---|---|---|
| conserved hypothetical protein aq_495 | | | pir:E70344 | | E70344 | |

Description

| ORF Name | NTID | AAID | NT Length | AA Length | Score | Probability |
|---|---|---|---|---|---|---|
| 187627_f1_4 | 3132 | 8354 | 407 | 1224 | 1479 | 1.6e−151 |

| Protein name | | | Locus Name | | Acc# | |
|---|---|---|---|---|---|---|
| hypothetical protein slr0049 | | | pir:S74347 | | S74347 | |

Description

-continued

| ORF Name | NTID | AAID | NT Length | AA Length | Score | Probability |
|---|---|---|---|---|---|---|
| 19703511__c2__108 | 3133 | 8355 | 105 | 318 | 127 | 3.8e−07 |

| Protein name | Locus Name | Acc# |
|---|---|---|
| 63 kDa protein | gp:MBU73653 | U73653 |

Description

*Mycobacterium bovis* 63 kDa protein, 47 kDa protein and clpB gene, complete cds.

| ORF Name | NTID | AAID | NT Length | AA Length | Score | Probability |
|---|---|---|---|---|---|---|
| 197188__c2__95 | 3134 | 8356 | 243 | 732 | 113 | 1.0e−11 |

| Protein name | Locus Name | Acc# |
|---|---|---|
| drgA protein:protein slr1719:protein Slr1719 | pir:S75047 | S75047 |

Description

| ORF Name | NTID | AAID | NT Length | AA Length | Score | Probability |
|---|---|---|---|---|---|---|
| 2035912__c3__131 | 3135 | 8357 | 210 | 633 | 241 | 2.5e−20 |

| Protein name | Locus Name | Acc# |
|---|---|---|
| conserved hypothetical protein | pir:D75341 | D75341 |

Description

| ORF Name | NTID | AAID | NT Length | AA Length | Score | Probability |
|---|---|---|---|---|---|---|
| 22860128__c3__140 | 3136 | 8358 | 83 | 252 | 64 | 0.031 |

| Protein name | Locus Name | Acc# |
|---|---|---|
| | sp:SPRC__XENLA | P36378 |

Description (OSTEONECTIN) (ON) (BASEMENT MEMBRANE PROTEIN BM-40)

| ORF Name | NTID | AAID | NT Length | AA Length | Score | Probability |
|---|---|---|---|---|---|---|
| 23625937__c3__130 | 3137 | 8359 | 116 | 351 | 163 | 4.7e−12 |

| Protein name | Locus Name | Acc# |
|---|---|---|
| conserved hypothetical protein yrbF | pir:E69972 | E69972 |

Description

| ORF Name | NTID | AAID | NT Length | AA Length | Score | Probability |
|---|---|---|---|---|---|---|
| 24500082__f3__67 | 3138 | 8360 | 178 | 537 | 200 | 5.6e−16 |

| Protein name | Locus Name | Acc# |
|---|---|---|
| hypothetical protein SC7H2.05 | pir:T35736 | T35736 |

Description

| ORF Name | NTID | AAID | NT Length | AA Length | Score | Probability |
|---|---|---|---|---|---|---|
| 24640755_f1_22 | 3139 | 8361 | 423 | 1272 | 463 | 7.6e−44 |

| Protein name | Locus Name | Acc# |
|---|---|---|
| glucose/galactose transporter | pir:A71850 | A71850 |

Description

| ORF Name | NTID | AAID | NT Length | AA Length | Score | Probability |
|---|---|---|---|---|---|---|
| 24640932_f2_30 | 3140 | 8362 | 229 | 690 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24642312_f1_17 | 3141 | 8363 | 189 | 570 | 357 | 1.3e−32 |

| Protein name | Locus Name | Acc# |
|---|---|---|
| peptidyl-tRNA hydrolase | pir:B72229 | B72229 |

Description

| ORF Name | NTID | AAID | NT Length | AA Length | Score | Probability |
|---|---|---|---|---|---|---|
| 24803942_f3_51 | 3142 | 8364 | 361 | 1086 | 1595 | 8.4e−164 |

| Protein name | Locus Name | Acc# |
|---|---|---|
| | sp:RECA_BACFR | P22841 |

Description

RECA PROTEIN

| ORF Name | NTID | AAID | NT Length | AA Length | Score | Probability |
|---|---|---|---|---|---|---|
| 24881300_c2_111 | 3143 | 8365 | 199 | 600 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 26594010_c2_94 | 3144 | 8366 | 234 | 705 | 330 | 9.4e−30 |

| Protein name | Locus Name | Acc# |
|---|---|---|
| | gp:AB024531 | AB024531 |

Description

*Enterococcus seriolicida* SA2F01-1, -2, -3 genes, partial and complete cds.

-continued

| ORF Name | NTID | AAID | NT Length | AA Length | Score | Probability |
|---|---|---|---|---|---|---|
| 30271025_c3_146 | 3145 | 8367 | 287 | 864 | 214 | 6.2e−17 |

| Protein name | Locus Name | Acc# |
|---|---|---|
| conserved hypothetical protein | pir:D75333 | D75333 |

Description

| ORF Name | NTID | AAID | NT Length | AA Length | Score | Probability |
|---|---|---|---|---|---|---|
| 30519457_f2_29 | 3146 | 8368 | 196 | 591 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 31417187_c1_81 | 3147 | 8369 | 261 | 786 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 33401011_c1_80 | 3148 | 8370 | 71 | 216 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4010927_c2_105 | 3149 | 8371 | 340 | 1023 | 103 | 0.022 |

| Protein name | Locus Name | Acc# |
|---|---|---|
| hypothetical protein ybbR | pir:A69745 | A69745 |

Description

| ORF Name | NTID | AAID | NT Length | AA Length | Score | Probability |
|---|---|---|---|---|---|---|
| 426337_f1_7 | 3150 | 8372 | 113 | 342 | 106 | 6.0e−06 |

| Protein name | Locus Name | Acc# |
|---|---|---|
| RNA polymerase sigma factor SigZ-like protein | gp:AF137263 | AF137263 |

Description

*Bacteroides thetaiotaomicron* 30S ribosomal protien S16-like protein, fucose gene cluster, and RNa polymerase sigma factor Sig-Z-like protein (sigZ) genes, complete cds.

-continued

| ORF Name | NTID | AAID | NT Length | AA Length | Score | Probability |
|---|---|---|---|---|---|---|
| 4720311_f3_48 | 3151 | 8373 | 198 | 597 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 4806587_c3_124 | 3152 | 8374 | 280 | 843 | 217 | 1.7e−17 |

| Protein name | | | | Locus Name | | Acc# |
|---|---|---|---|---|---|---|
| | | | | sp:YJJU_ECOLI | | P39407 |

Description

HYPOTHETICAL 39.8 KD PROTEIN IN OSMY-DEOC INTERGENIC REGION (O357)

| ORF Name | NTID | AAID | NT Length | AA Length | Score | Probability |
|---|---|---|---|---|---|---|
| 4878506_f3_49 | 3153 | 8375 | 221 | 666 | 101 | 0.017 |

| Protein name | | | | Locus Name | | Acc# |
|---|---|---|---|---|---|---|
| KIAA0636 protein | | | | gp:AB014536 | | AB014536 |

Description

*Homo sapiens* mRNA for KIAA0636 protein, complete cds.

| ORF Name | NTID | AAID | NT Length | AA Length | Score | Probability |
|---|---|---|---|---|---|---|
| 4973765_f1_8 | 3154 | 8376 | 114 | 345 | 124 | 9.4e−08 |

| Protein name | | | | Locus Name | | Acc# |
|---|---|---|---|---|---|---|
| SigG | | | | gp:AF121849 | | AF121849 |

Description

*Synechococcus* PCC7002 SigG (sigG) and hypothetical protein genes, complete cds.

| ORF Name | NTID | AAID | NT Length | AA Length | Score | Probability |
|---|---|---|---|---|---|---|
| 5281562_c3_126 | 3155 | 8377 | 542 | 1629 | 186 | 1.1e−09 |

| Protein name | | | | Locus Name | | Acc# |
|---|---|---|---|---|---|---|
| putative secreted protein | | | | gp:SC4A7 | | AL133423 |

Description

*Streptomyces* coelicolor cosmid 4A7.

| ORF Name | NTID | AAID | NT Length | AA Length | Score | Probability |
|---|---|---|---|---|---|---|
| 812533_c2_112 | 3156 | 8378 | 302 | 909 | 372 | 3.3e−34 |

| Protein name | | | | Locus Name | | Acc# |
|---|---|---|---|---|---|---|
| transcription regulator LysR family | | | | pir:F70356 | | F70356 |

Description

-continued

| ORF Name | NTID | AAID | NT Length | AA Length | Score | Probability |
|---|---|---|---|---|---|---|
| 907137_c2_104 | 3157 | 8379 | 338 | 1017 | 171 | 2.1e−12 |

| Protein name | Locus Name | Acc# |
|---|---|---|
| N utilization substance protein B | pir:D72212 | D72212 |

Description

| ORF Name | NTID | AAID | NT Length | AA Length | Score | Probability |
|---|---|---|---|---|---|---|
| 976536_f3_65 | 3158 | 8380 | 202 | 609 | 208 | 8.0e−17 |

| Protein name | Locus Name | Acc# |
|---|---|---|
| probable ribosomal protien L25 | pir:H71665 | H71665 |

Description

| ORF Name | NTID | AAID | NT Length | AA Length | Score | Probability |
|---|---|---|---|---|---|---|
| 995461_c1_90 | 3159 | 8381 | 108 | 327 | 80 | 0.036 |

| Protein name | Locus Name | Acc# |
|---|---|---|
| dehydrofolate reductase,/thymidylate synthase, | pir:T01684 | T01684 |

Description

| ORF Name | NTID | AAID | NT Length | AA Length | Score | Probability |
|---|---|---|---|---|---|---|
| 10735002_c2_18 | 3160 | 8382 | 195 | 588 | 177 | 1.5e−13 |

| Protein name | Locus Name | Acc# |
|---|---|---|
| RNa polymerase sigma factor SigZ-like protein | gp:AF137263 | AF137263 |

Description

*Bacteriodes thetaiotaomicron* 30S ribosomal protein S16-like protein, fucose gene cluster, and RNA polymerase sigma factor SigZ-like protien (sigZ) genes, complete cds.

| ORF Name | NTID | AAID | NT Length | AA Length | Score | Probability |
|---|---|---|---|---|---|---|
| 12395950_f2_2 | 3161 | 8383 | 132 | 399 | 107 | 2.2e−05 |

| Protein name | Locus Name | Acc# |
|---|---|---|
| hypothetical protein F14F9.5 | pir:T33774 | T33774 |

Description

| ORF Name | NTID | AAID | NT Length | AA Length | Score | Probability |
|---|---|---|---|---|---|---|
| 12689712_f3_9 | 3162 | 8384 | 612 | 1836 | 588 | 1.2e−57 |

| Protein name | Locus Name | Acc# |
|---|---|---|
| 115K outer membrane protein precursor:SusC protein | pir:JC6027 | JC6027 |

Description

-continued

| ORF Name | NTID | AAID | NT Length | AA Length | Score | Probability |
|---|---|---|---|---|---|---|
| 20524150_f2_3 | 3163 | 8385 | 385 | 1158 | 144 | 3.0e−06 |

| Protein name | Locus Name | Acc# |
|---|---|---|
| probable phosphoesterase, yvnB | pir:C70044 | C70044 |

Description

| ORF Name | NTID | AAID | NT Length | AA Length | Score | Probability |
|---|---|---|---|---|---|---|
| 4100877_f3_8 | 3164 | 8386 | 338 | 1017 | 117 | 0.00031 |

| Protein name | Locus Name | Acc# |
|---|---|---|
| transmembrane sensor | gp:AF051691 | AF051691 |

Description

*Pseudomonas aeruginosa* stress factor A (psfA), ECF sigma factor (fiuI), transmembrane sensor (fiuR), and hydroxamate-typeferrisiderophore receptor (fiuA) genes, complete cds.

| ORF Name | NTID | AAID | NT Length | AA Length | Score | Probability |
|---|---|---|---|---|---|---|
| 31726567_c1_11 | 3165 | 8387 | 96 | 291 | 450 | 1.8e−42 |

| Protein name | Locus Name | Acc# |
|---|---|---|
| mobilization protein C | gp:AF118243 | AF118243 |

Description

*Bacteroides fragilis* mobilization protein C (mobC) gene, complete cds.

| ORF Name | NTID | AAID | NT Length | AA Length | Score | Probability |
|---|---|---|---|---|---|---|
| 5135158_c1_10 | 3166 | 8388 | 101 | 306 | 464 | 6.0e−44 |

| Protein name | Locus Name | Acc# |
|---|---|---|
| mobilization protein C | gp:AF118243 | AF118243 |

Description

*Bacteroides fragilis* mobilization protein C (mobC) gene, complete cds.

| ORF Name | NTID | AAID | NT Length | AA Length | Score | Probability |
|---|---|---|---|---|---|---|
| 7112683_f3_6 | 3167 | 8389 | 216 | 651 | 1024 | 2.7e−103 |

| Protein name | Locus Name | Acc# |
|---|---|---|
| mobilization protein B | gp:AF118242 | AF118242 |

Description

*Bacteroides fragilis* mobilization protein B (mobB) gene, complete cds.

| ORF Name | NTID | AAID | NT Length | AA Length | Score | Probability |
|---|---|---|---|---|---|---|
| 10972160_f3_194 | 3168 | 8390 | 439 | 1320 | 241 | 1.3e−17 |

| Protein name | Locus Name | Acc# |
|---|---|---|
|  | sp:HLYD_PASHA | P16534 |

Description

LEUKOTOXIN SECRETION PROTEIN D

-continued

| ORF Name | NTID | AAID | NT Length | AA Length | Score | Probability |
|---|---|---|---|---|---|---|
| 10973751_f3_179 | 3169 | 8391 | 441 | 1326 | 670 | 8.8e−66 |

| Protein name | Locus Name | Acc# |
|---|---|---|
| | sp:DINF_ECOLI | P28303 |

Description

DNA-DAMAGE-INDUCIBLE PROTEIN F

| ORF Name | NTID | AAID | NT Length | AA Length | Score | Probability |
|---|---|---|---|---|---|---|
| 1173187_c3_347 | 3170 | 8392 | 115 | 348 | 90 | 0.011 |

| Protein name | Locus Name | Acc# |
|---|---|---|
| hypothetical protein, MAL1P3.07 | gp:PFMAL1P3 | AL031746 |

Description

*Plasmodium falciparum* MAL1P3, complete sequence.

| ORF Name | NTID | AAID | NT Length | AA Length | Score | Probability |
|---|---|---|---|---|---|---|
| 1178325_c2_265 | 3171 | 8393 | 418 | 1257 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 11926083_c3_337 | 3172 | 8394 | 103 | 312 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 12501567_f1_55 | 3173 | 8395 | 261 | 786 | 276 | 5.0e−24 |

| Protein name | Locus Name | Acc# |
|---|---|---|
| ligase | pir:A70351 | A70351 |

Description

| ORF Name | NTID | AAID | NT Length | AA Length | Score | Probability |
|---|---|---|---|---|---|---|
| 134687_c1_221 | 3174 | 8396 | 105 | 318 | 304 | 5.4e−27 |

| Protein name | Locus Name | Acc# |
|---|---|---|
| | sp:THIM_PEA | |

Description

THIOREDOXIN M-TYPE, CHLOROPLAST PRECURSOR (TRX-M)

-continued

| ORF Name | NTID | AAID | NT Length | AA Length | Score | Probability |
|---|---|---|---|---|---|---|
| 13946017_c3_360 | 3175 | 8397 | 443 | 1332 | 481 | 9.4e−46 |

| Protein name | Locus Name | Acc# |
|---|---|---|
| hypothetical protein slr2013 | pir:S75346 | S75346 |

Description

| ORF Name | NTID | AAID | NT Length | AA Length | Score | Probability |
|---|---|---|---|---|---|---|
| 14256505_f2_120 | 3176 | 8398 | 288 | 867 | 148 | 5.5e−07 |

| Protein name | Locus Name | Acc# |
|---|---|---|
| | gp:U93872 | U93872 |

Description

Kaposi's sarcoma-associated herpesvirus glycoprotein M, DNAreplication protein, glycoprotein, DNA replication protein, FLICEinhibitory protein and v-cyclin genes, complete cds, and tegumentprotein gene, partial cds.

| ORF Name | NTID | AAID | NT Length | AA Length | Score | Probability |
|---|---|---|---|---|---|---|
| 14460760_f3_196 | 3177 | 8399 | 240 | 723 | 369 | 1.2e−32 |

| Protein name | Locus Name | Acc# |
|---|---|---|
| hypothetical protein mexF | pir:T30830 | T30830 |

Description

| ORF Name | NTID | AAID | NT Length | AA Length | Score | Probability |
|---|---|---|---|---|---|---|
| 14657131_f1_33 | 3178 | 8400 | 662 | 1989 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 15032952_f2_122 | 3179 | 8401 | 931 | 2796 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 15760268_f2_101 | 3180 | 8402 | 441 | 1326 | 343 | 4.0e−31 |

| Protein name | Locus Name | Acc# |
|---|---|---|
| YvrN protein | gp:BS43KBDNA | AJ223978 |

Description

*Bacillus subtilis* 42.7 kB DNA fragment from yvsA to yvqA.

-continued

| ORF Name | NTID | AAID | NT Length | AA Length | Score | Probability |
|---|---|---|---|---|---|---|
| 16836055_f2_102 | 3181 | 8403 | 245 | 738 | 170 | 2.8e−11 |

| Protein name | Locus Name | Acc# |
|---|---|---|
| hypothetical protein Rv3695 | pir:H70792 | H70792 |

Description

| ORF Name | NTID | AAID | NT Length | AA Length | Score | Probability |
|---|---|---|---|---|---|---|
| 16898412_f2_98 | 3182 | 8404 | 602 | 1809 | 114 | 0.00099 |

| Protein name | Locus Name | Acc# |
|---|---|---|
| | sp:YREC_SYNP2 | P19737 |

Description

HYPOTHETICAL 28.7 KD PROTEIN IN RECA 3'REGION

| ORF Name | NTID | AAID | NT Length | AA Length | Score | Probability |
|---|---|---|---|---|---|---|
| 17009642_c3_357 | 3183 | 8405 | 236 | 711 | 239 | 4.1e−20 |

| Protein name | Locus Name | Acc# |
|---|---|---|
| rprY protein | pir:S33662 | S33662 |

Description

| ORF Name | NTID | AAID | NT Length | AA Length | Score | Probability |
|---|---|---|---|---|---|---|
| 19589387_f3_190 | 3184 | 8406 | 251 | 756 | 113 | 0.00018 |

| Protein name | Locus Name | Acc# |
|---|---|---|
| pXO2-46 | gp:AF188935 | AF188935 |

Description

*Bacillus anthracis* plasmid pXO2, complete sequence.

| ORF Name | NTID | AAID | NT Length | AA Length | Score | Probability |
|---|---|---|---|---|---|---|
| 20508312_f1_39 | 3185 | 8407 | 365 | 1098 | 206 | 3.1e−14 |

| Protein name | Locus Name | Acc# |
|---|---|---|
| acriflavin resistance protein AcrE | pir:A70361 | A70361 |

Description

| ORF Name | NTID | AAID | NT Length | AA Length | Score | Probability |
|---|---|---|---|---|---|---|
| 213340_c3_358 | 3186 | 8408 | 353 | 1062 | 114 | 0.00085 |

| Protein name | Locus Name | Acc# |
|---|---|---|
| | sp:Y876_METJA | Q58286 |

Description

PUTATIVE ABC TRANSPORTER PERMEASE PROTEIN MJ0876

-continued

| ORF Name | NTID | AAID | NT Length | AA Length | Score | Probability |
|---|---|---|---|---|---|---|
| 21494031_f2_111 | 3187 | 8409 | 96 | 291 | | |
| Protein name | | | | Locus Name | | Acc# |
| Description | | | | | | |
| NO-HIT | | | | | | |

| ORF Name | NTID | AAID | NT Length | AA Length | Score | Probability |
|---|---|---|---|---|---|---|
| 21676532_f3_180 | 3188 | 8410 | 242 | 729 | 653 | 5.6e−64 |
| Protein name | | | | Locus Name | | Acc# |
| | | | | sp:PYRH_ECOLI | | P29464 |
| Description | | | | | | |
| (UMP KINASE) (SMBA PROTEIN) | | | | | | |

| ORF Name | NTID | AAID | NT Length | AA Length | Score | Probability |
|---|---|---|---|---|---|---|
| 21769782_f3_135 | 3189 | 8411 | 469 | 1410 | | |
| Protein name | | | | Locus Name | | Acc# |
| Description | | | | | | |
| NO-HIT | | | | | | |

| ORF Name | NTID | AAID | NT Length | AA Length | Score | Probability |
|---|---|---|---|---|---|---|
| 22666577_c1_234 | 3190 | 8412 | 207 | 624 | 76 | 0.024 |
| Protein name | | | | Locus Name | | Acc# |
| | | | | sp:E311_ADE03 | | P11317 |
| Description | | | | | | |
| EARLY E3 9.0 KD GLYCOPROTEIN | | | | | | |

| ORF Name | NTID | AAID | NT Length | AA Length | Score | Probability |
|---|---|---|---|---|---|---|
| 2343876_f1_32 | 3191 | 8413 | 85 | 258 | | |
| Protein name | | | | Locus Name | | Acc# |
| Description | | | | | | |
| NO-HIT | | | | | | |

| ORF Name | NTID | AAID | NT Length | AA Length | Score | Probability |
|---|---|---|---|---|---|---|
| 23551325_f3_183 | 3192 | 8414 | 165 | 498 | | |
| Protein name | | | | Locus Name | | Acc# |
| Description | | | | | | |
| NO-HIT | | | | | | |

-continued

| ORF Name | NTID | AAID | NT Length | AA Length | Score | Probability |
|---|---|---|---|---|---|---|
| 23625177_f1_61 | 3193 | 8415 | 190 | 573 | 433 | 1.1e−40 |

| Protein name | | | Locus Name | | | Acc# |
|---|---|---|---|---|---|---|
| ribosome recycling factor | | | pir:C75386 | | | C75386 |

Description

| ORF Name | NTID | AAID | NT Length | AA Length | Score | Probability |
|---|---|---|---|---|---|---|
| 23626561_f3_188 | 3194 | 8416 | 433 | 1302 | 118 | 0.00066 |

| Protein name | | | Locus Name | | | Acc# |
|---|---|---|---|---|---|---|
| | | | gp:VCU47542 | | | U47542 |

Description

*Vibrio cholerae* ADP-L-glycero-D-mannoheptose–6-epimerase (rfaD) gene, complete cds.

| ORF Name | NTID | AAID | NT Length | AA Length | Score | Probability |
|---|---|---|---|---|---|---|
| 23650288_f1_68 | 3195 | 8417 | 361 | 1086 | 327 | 2.0e−29 |

| Protein name | | | Locus Name | | | Acc# |
|---|---|---|---|---|---|---|
| cation efflux system (czcB-like) | | | pir:C70415 | | | C70415 |

Description

| ORF Name | NTID | AAID | NT Length | AA Length | Score | Probability |
|---|---|---|---|---|---|---|
| 23937750_c2_282 | 3196 | 8418 | 67 | 204 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 239665_f1_57 | 3197 | 8419 | 66 | 201 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 24015635_f2_126 | 3198 | 8420 | 116 | 351 | | |

| Protein name | | | Locus Name | | | Acc# |
|---|---|---|---|---|---|---|

Description

NO-HIT

-continued

| ORF Name | NTID | AAID | NT Length | AA Length | Score | Probability |
|---|---|---|---|---|---|---|
| 24016077_f1_38 | 3199 | 8421 | 186 | 561 | 129 | 1.9e−08 |

| Protein name | Locus Name | Acc# |
|---|---|---|
| | sp:Y793_METJA | Q58203 |

Description

HYPOTHETICAL PROTEIN MJ0793

| ORF Name | NTID | AAID | NT Length | AA Length | Score | Probability |
|---|---|---|---|---|---|---|
| 24097562_c3_345 | 3200 | 8422 | 270 | 813 | 283 | 2.6e−40 |

| Protein name | Locus Name | Acc# |
|---|---|---|
| DNA polymerase | gp:AF083949 | AF083949 |

Description

*Treponema denticola* DNA gyrase subunit B (gyrB) and chromosomalreplication initiator protein (dnaA) genes, complete cds; and DNApolymerase (dnaE) gene, partial cds.

| ORF Name | NTID | AAID | NT Length | AA Length | Score | Probability |
|---|---|---|---|---|---|---|
| 24261627_c1_239 | 3201 | 8423 | 418 | 1257 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24396877_f3_161 | 3202 | 8424 | 220 | 663 | 95 | 0.0025 |

| Protein name | Locus Name | Acc# |
|---|---|---|
| | sp:Y794_METJA | Q58204 |

Description

HYPOTHETICAL PROTEIN MJ0794

| ORF Name | NTID | AAID | NT Length | AA Length | Score | Probability |
|---|---|---|---|---|---|---|
| 24406886_c3_320 | 3203 | 8425 | 105 | 318 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24413127_f2_100 | 3204 | 8426 | 101 | 306 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 24417812_f1_67 | 3205 | 8427 | 740 | 2223 | 931 | 1.9e−93 |

| Protein name | Locus Name | Acc# |
|---|---|---|
| heterocyst differentiation protein HetC | pir:T31072 | T31072 |

Description

| ORF Name | NTID | AAID | NT Length | AA Length | Score | Probability |
|---|---|---|---|---|---|---|
| 24423426_c3_338 | 3206 | 8428 | 445 | 1338 | 149 | 7.7e−08 |

| Protein name | Locus Name | Acc# |
|---|---|---|
| laminarinase | gp:AF047003 | AF047003 |

Description

*Rhodothermus marinus* strain ITI278 laminarinase (lamR) gene, complete cds.

| ORF Name | NTID | AAID | NT Length | AA Length | Score | Probability |
|---|---|---|---|---|---|---|
| 24489377_f3_175 | 3207 | 8429 | 149 | 450 | 134 | 5.5e−09 |

| Protein name | Locus Name | Acc# |
|---|---|---|
| hypothetical protein SC2E1.19 SC2E1.19 | pir:T34787 | T34787 |

Description

| ORF Name | NTID | AAID | NT Length | AA Length | Score | Probability |
|---|---|---|---|---|---|---|
| 24640642_f3_176 | 3208 | 8430 | 120 | 363 | 168 | 1.4e−12 |

| Protein name | Locus Name | Acc# |
|---|---|---|
| MmcQ | gp:AF127374 | AF127374 |

Description

*Streptomyces lavendulae* LinA homolog, cytochrome P450 hydroxylaseORF4, cytochrome P450 hydroxylase ORF3, MitT (mitT), MitS (mitS), MitR (mitR), MitQ (mitQ), MitP (mitP), MitO (mitO), MitN (mitN), MitM (mitM), MitL (mitL), MitK (mitK), MitJ (mitJ), MitI (mitI), MitH (mitH), MitG (mitG), MitF (mitF), MitE (mitE), MitD (mitD), MitC (mitC), MitB (mitB), MitA (mitA), MmcA (mmcA), MmcB

| ORF Name | NTID | AAID | NT Length | AA Length | Score | Probability |
|---|---|---|---|---|---|---|
| 24648427_c3_339 | 3209 | 8431 | 232 | 699 | 118 | 0.00012 |

| Protein name | Locus Name | Acc# |
|---|---|---|
| conserved hypothetical protein | pir:A72220 | A72220 |

Description

| ORF Name | NTID | AAID | NT Length | AA Length | Score | Probability |
|---|---|---|---|---|---|---|
| 24883260_f2_130 | 3210 | 8432 | 690 | 2070 | 897 | 7.8e−90 |

| Protein name | Locus Name | Acc# |
|---|---|---|
| acriflavin resistance protein D (acrD) RP170 | pir:F71727 | F71727 |

Description

-continued

| ORF Name | NTID | AAID | NT Length | AA Length | Score | Probability |
|---|---|---|---|---|---|---|
| 24884633_c1_240 | 3211 | 8433 | 186 | 561 | 359 | 7.0e−32 |

| Protein name | Locus Name | Acc# |
|---|---|---|
| immunoreactive 89 kD antigen PG87 | gp:AF175722 | AF175722 |

Description

*Porphyromonas gingivalis* strain W50 immunoreactive 89 kD antigenPG87 gene, complete cds.

| ORF Name | NTID | AAID | NT Length | AA Length | Score | Probability |
|---|---|---|---|---|---|---|
| 25501562_f2_125 | 3212 | 8434 | 525 | 1578 | 117 | 0.00071 |

| Protein name | Locus Name | Acc# |
|---|---|---|
| beta-1,4-galactosyltransferase IV | gp:AB024436 | AB024436 |

Description

*Homo sapiens* mRNA for beta-1,4-galactosyltransferase IV, complete cds.

| ORF Name | NTID | AAID | NT Length | AA Length | Score | Probability |
|---|---|---|---|---|---|---|
| 25548463_f1_30 | 3213 | 8435 | 74 | 225 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 26370888_f3_148 | 3214 | 8436 | 155 | 468 | 239 | 4.1e−20 |

| Protein name | Locus Name | Acc# |
|---|---|---|
| conserved hypothetical protein ydiB | pir:C69786 | C69786 |

Description

| ORF Name | NTID | AAID | NT Length | AA Length | Score | Probability |
|---|---|---|---|---|---|---|
| 26594677_f2_121 | 3215 | 8437 | 531 | 1596 | 644 | 3.9e−73 |

| Protein name | Locus Name | Acc# |
|---|---|---|
| | sp:DNAK_HALMA | Q01100 |

Description

DNAK PROTEIN (HEAT SHOCK PROTEIN 70) (HSP70)

| ORF Name | NTID | AAID | NT Length | AA Length | Score | Probability |
|---|---|---|---|---|---|---|
| 26660812_f1_60 | 3216 | 8438 | 417 | 1254 | 115 | 0.0012 |

| Protein name | Locus Name | Acc# |
|---|---|---|
| enterotoxin | gp:AF192766 | AF192766 |

Description

*Bacillus cereus* strain Ae10 enterotoxin mRNA, complete cds.

-continued

| ORF Name | NTID | AAID | NT Length | AA Length | Score | Probability |
|---|---|---|---|---|---|---|
| 29511526_c1_220 | 3217 | 8439 | 1072 | 3219 | 1446 | 1.3e-170 |

| Protein name | Locus Name | Acc# |
|---|---|---|
| | sp:DP3A_BORBU | O51526 |

Description

DNA POLYMERASE III, ALPHA CHAIN,

| ORF Name | NTID | AAID | NT Length | AA Length | Score | Probability |
|---|---|---|---|---|---|---|
| 31837701_f1_18 | 3218 | 8440 | 273 | 822 | 563 | 1.9e-54 |

| Protein name | Locus Name | Acc# |
|---|---|---|
| conserved hypothetical protein MTH606 | pir:E69180 | E69180 |

Description

| ORF Name | NTID | AAID | NT Length | AA Length | Score | Probability |
|---|---|---|---|---|---|---|
| 32141338_c2_260 | 3219 | 8441 | 86 | 261 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 32297293_c2_274 | 3220 | 8442 | 149 | 450 | 444 | 7.8e-42 |

| Protein name | Locus Name | Acc# |
|---|---|---|
| | gp:PGPGAAGEN | X95938 |

Description

*P. gingivalis* rnhB & pgaA genes & orfs 150, 197, 202 & 199.

| ORF Name | NTID | AAID | NT Length | AA Length | Score | Probability |
|---|---|---|---|---|---|---|
| 33876067_c3_359 | 3221 | 8443 | 430 | 1293 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 34254387_c1_219 | 3222 | 8444 | 88 | 267 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 34492925_c3_340 | 3223 | 8445 | 84 | 255 | | |

| Protein name | | Locus Name | | Acc# |
|---|---|---|---|---|
| | | | | |

Description

NO-HIT

| ORF Name | NTID | AAID | NT Length | AA Length | Score | Probability |
|---|---|---|---|---|---|---|
| 36120842_c3_369 | 3224 | 8446 | 65 | 198 | 107 | 7.7e−05 |

| Protein name | | Locus Name | | Acc# |
|---|---|---|---|---|
| immunoreactive 89 kD antigen PG87 | | gp:AF175722 | | AF175722 |

Description

*Porphyromonas gingivalis* strain W50 immunoreactive 89 kD antigenPG87 gene, complete cds.

| ORF Name | NTID | AAID | NT Length | AA Length | Score | Probability |
|---|---|---|---|---|---|---|
| 36219693_f2_83 | 3225 | 8447 | 92 | 279 | | |

| Protein name | | Locus Name | | Acc# |
|---|---|---|---|---|
| | | | | |

Description

NO-HIT

| ORF Name | NTID | AAID | NT Length | AA Length | Score | Probability |
|---|---|---|---|---|---|---|
| 36525287_f3_186 | 3226 | 8448 | 311 | 936 | 546 | 1.2e−52 |

| Protein name | | Locus Name | | Acc# |
|---|---|---|---|---|
| conserved hypothetical protein | | pir:A72219 | | A72219 |

Description

| ORF Name | NTID | AAID | NT Length | AA Length | Score | Probability |
|---|---|---|---|---|---|---|
| 3937775_c2_311 | 3227 | 8449 | 1065 | 3198 | 468 | 4.9e−83 |

| Protein name | | Locus Name | | Acc# |
|---|---|---|---|---|
| 115K outer membrane protein precursor:SusC protein | | pir:JC6027 | | JC6027 |

Description

| ORF Name | NTID | AAID | NT Length | AA Length | Score | Probability |
|---|---|---|---|---|---|---|
| 3944150_f2_82 | 3228 | 8450 | 143 | 432 | | |

| Protein name | | Locus Name | | Acc# |
|---|---|---|---|---|
| | | | | |

Description

NO-HIT

-continued

| ORF Name | NTID | AAID | NT Length | AA Length | Score | Probability |
|---|---|---|---|---|---|---|
| 39663590_c1_241 | 3229 | 8451 | 73 | 222 | 133 | 1.3e−07 |
| Protein name | | | Locus Name | | | Acc# |
| immunoreactive 89 kD antigen PG87 | | | gp:AF175722 | | | AF175722 |
| Description | | | | | | |

*Porphyromonas gingivalis* strain W50 immunoreactive 89 kD antigenPG87 gene, complete cds.

| ORF Name | NTID | AAID | NT Length | AA Length | Score | Probability |
|---|---|---|---|---|---|---|
| 4031501_c2_281 | 3230 | 8452 | 66 | 201 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 4116566_f3_158 | 3231 | 8453 | 240 | 723 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 422157_f3_177 | 3232 | 8454 | 451 | 1356 | 100 | 0.00074 |
| Protein name | | | Locus Name | | | Acc# |
| microbial collagenase, precursor:Cog protein | | | pir:JC4393 | | | JC4393 |
| Description | | | | | | |

| ORF Name | NTID | AAID | NT Length | AA Length | Score | Probability |
|---|---|---|---|---|---|---|
| 4492787_c3_362 | 3233 | 8455 | 339 | 1020 | 212 | 4.6e−17 |
| Protein name | | | Locus Name | | | Acc# |
| | | | sp:APX_STRGR | | | P80561 |
| Description | | | | | | |

AMINOPEPTIDASE, (SGAP)

| ORF Name | NTID | AAID | NT Length | AA Length | Score | Probability |
|---|---|---|---|---|---|---|
| 4725938_f3_171 | 3234 | 8456 | 239 | 720 | 229 | 4.8e−19 |
| Protein name | | | Locus Name | | | Acc# |
| | | | sp:PSS_HELPY | | | |
| Description | | | | | | |

(PHOSPHATIDYLSERINE SYNTHASE)

-continued

| ORF Name | NTID | AAID | NT Length | AA Length | Score | Probability |
|---|---|---|---|---|---|---|
| 4869802_f3_170 | 3235 | 8457 | 231 | 696 | 372 | 3.3e−34 |

| Protein name | Locus Name | Acc# |
|---|---|---|
| unknown | gp:NGU34760 | U34760 |

Description

Neisseria gonorrhoeae UvrA (uvrA) and ORF259 genes, complete cds.

| ORF Name | NTID | AAID | NT Length | AA Length | Score | Probability |
|---|---|---|---|---|---|---|
| 4964782_c2_303 | 3236 | 8458 | 503 | 1512 | 1227 | 8.3e−125 |

| Protein name | Locus Name | Acc# |
|---|---|---|
| immunoreactive 89 kD antigen PG87 | gp:AF175722 | AF175722 |

Description

Porphyromonas gingivalis strain W50 immunoreactive 89 kD antigenPG87 gene, complete cds.

| ORF Name | NTID | AAID | NT Length | AA Length | Score | Probability |
|---|---|---|---|---|---|---|
| 5332187_c1_236 | 3237 | 8459 | 303 | 912 | 759 | 3.3e−75 |

| Protein name | Locus Name | Acc# |
|---|---|---|
| hypothetical protein PH0776 | pir:B71126 | B71126 |

Description

| ORF Name | NTID | AAID | NT Length | AA Length | Score | Probability |
|---|---|---|---|---|---|---|
| 547525_c2_291 | 3238 | 8460 | 339 | 1020 | 311 | 9.7e−28 |

| Protein name | Locus Name | Acc# |
|---|---|---|
| hypothetical protein slr1478 | pir:S75694 | S75694 |

Description

| ORF Name | NTID | AAID | NT Length | AA Length | Score | Probability |
|---|---|---|---|---|---|---|
| 831250_c1_242 | 3239 | 8461 | 892 | 2679 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 988762_c3_356 | 3240 | 8462 | 474 | 1425 | 282 | 2.2e−23 |

| Protein name | Locus Name | Acc# |
|---|---|---|
| RprX | gp:S59000 | S59000 |

Description

-continued

| ORF Name | NTID | AAID | NT Length | AA Length | Score | Probability |
|---|---|---|---|---|---|---|
| 11020692_c2_101 | 3241 | 8463 | 213 | 642 | 233 | 7.0e-18 |
| Protein name | | | Locus Name | | | Acc# |
| hypothetical protein | | | pir:A75613 | | | A75613 |
| Description | | | | | | |

| ORF Name | NTID | AAID | NT Length | AA Length | Score | Probability |
|---|---|---|---|---|---|---|
| 11754512_f3_67 | 3242 | 8464 | 98 | 297 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 11907801_c2_106 | 3243 | 8465 | 524 | 1575 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 19531885_f3_63 | 3244 | 8466 | 118 | 357 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 20422162_f1_9 | 3245 | 8467 | 597 | 1794 | 428 | 5.6e-39 |
| Protein name | | | Locus Name | | | Acc# |
| VicK protein | | | gp:EFA012050 | | | AJ012050 |
| Description | | | | | | |

*Enterococcus faecalis* vic operon and flanking genes.

| ORF Name | NTID | AAID | NT Length | AA Length | Score | Probability |
|---|---|---|---|---|---|---|
| 2113812_f2_36 | 3246 | 8468 | 323 | 972 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 22063410_c2_108 | 3247 | 8469 | 632 | 1899 | 1362 | 4.1e-139 |
| Protein name | | | Locus Name | | | Acc# |
| hypothetical protein | | | pir:S76152 | | | S76152 |
| Description | | | | | | |

-continued

| ORF Name | NTID | AAID | NT Length | AA Length | Score | Probability |
|---|---|---|---|---|---|---|
| 22438768_c1_89 | 3248 | 8470 | 284 | 855 | | |
| Protein name | | | | Locus Name | | Acc# |
| | | | | | | |

Description

NO-HIT

| ORF Name | NTID | AAID | NT Length | AA Length | Score | Probability |
|---|---|---|---|---|---|---|
| 24648563_c1_88 | 3249 | 8471 | 129 | 390 | | |
| Protein name | | | | Locus Name | | Acc# |
| | | | | | | |

Description

NO-HIT

| ORF Name | NTID | AAID | NT Length | AA Length | Score | Probability |
|---|---|---|---|---|---|---|
| 26360263_f3_66 | 3250 | 8472 | 582 | 1749 | 171 | 1.8e−09 |
| Protein name | | | | Locus Name | | Acc# |
| | | | | gp:MMSAG | | X84710 |

Description

*M. mazei* surface antigen genes orf492, orf375 and orf783.

| ORF Name | NTID | AAID | NT Length | AA Length | Score | Probability |
|---|---|---|---|---|---|---|
| 29804754_c2_93 | 3251 | 8473 | 413 | 1242 | | |
| Protein name | | | | Locus Name | | Acc# |
| | | | | | | |

Description

NO-HIT

| ORF Name | NTID | AAID | NT Length | AA Length | Score | Probability |
|---|---|---|---|---|---|---|
| 34087632_f2_38 | 3252 | 8474 | 702 | 2109 | 155 | 4.5e−12 |
| Protein name | | | | Locus Name | | Acc# |
| | | | | sp:BTUB_ECOLI | | P06129 |

Description

VITAMIN B12 RECEPTOR PRECURSOR

| ORF Name | NTID | AAID | NT Length | AA Length | Score | Probability |
|---|---|---|---|---|---|---|
| 35706417_f2_43 | 3253 | 8475 | 483 | 1452 | | |
| Protein name | | | | Locus Name | | Acc# |
| | | | | | | |

Description

NO-HIT

-continued

| ORF Name | NTID | AAID | NT Length | AA Length | Score | Probability |
|---|---|---|---|---|---|---|
| 4173751_f3_55 | 3254 | 8476 | 239 | 720 | 473 | 6.6e−45 |
| Protein name | | | Locus Name | | | Acc# |
| response regulator DrrA | | | pir:D72228 | | | D72228 |
| Description | | | | | | |

| ORF Name | NTID | AAID | NT Length | AA Length | Score | Probability |
|---|---|---|---|---|---|---|
| 4878387_c3_122 | 3255 | 8477 | 400 | 1203 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 4954691_c1_92 | 3256 | 8478 | 270 | 810 | 213 | 2.4e−17 |
| Protein name | | | Locus Name | | | Acc# |
| | | | sp:HIS9_SCHPO | | | O14059 |
| Description | | | | | | |

PROBABLE HISTIDINOL-PHOSPHATASE,

| ORF Name | NTID | AAID | NT Length | AA Length | Score | Probability |
|---|---|---|---|---|---|---|
| 9921885_c1_81 | 3257 | 8479 | 472 | 1419 | 142 | 9.4e−06 |
| Protein name | | | Locus Name | | | Acc# |
| hypothetical protein | | | pir:A75613 | | | A75613 |
| Description | | | | | | |

| ORF Name | NTID | AAID | NT Length | AA Length | Score | Probability |
|---|---|---|---|---|---|---|
| 10351381_c1_216 | 3258 | 8480 | 409 | 1230 | 517 | 1.4e−49 |
| Protein name | | | Locus Name | | | Acc# |
| | | | sp:GLUP_BRUAB | | | Q44623 |
| Description | | | | | | |

GLUCOSE/GALACTOSE TRANSPORTER

| ORF Name | NTID | AAID | NT Length | AA Length | Score | Probability |
|---|---|---|---|---|---|---|
| 110683_f2_111 | 3259 | 8481 | 301 | 903 | 146 | 1.0e−09 |
| Protein name | | | Locus Name | | | Acc# |
| | | | gp:PVPVA1 | | | X92485 |
| Description | | | | | | |

*P. vivax* pval gene.

-continued

| ORF Name | NTID | AAID | NT Length | AA Length | Score | Probability |
|---|---|---|---|---|---|---|
| 12506407_c2_261 | 3260 | 8482 | 254 | 765 | 185 | 2.8e−17 |

| Protein name | Locus Name | Acc# |
|---|---|---|
| | sp:GPH_ECOLI | P32662 |

Description

PHOSPHOGLYCOLATE PHOSPHATASE, (PGP)

| ORF Name | NTID | AAID | NT Length | AA Length | Score | Probability |
|---|---|---|---|---|---|---|
| 12923212_c2_232 | 3261 | 8483 | 144 | 435 | 72 | 0.028 |

| Protein name | Locus Name | Acc# |
|---|---|---|
| | sp:DBHA_SALTY | P15148 |

Description

DNA-BINDING PROTEIN HU-ALPHA (NS2) (HU-2)

| ORF Name | NTID | AAID | NT Length | AA Length | Score | Probability |
|---|---|---|---|---|---|---|
| 13127090_f2_102 | 3262 | 8484 | 140 | 423 | 112 | 6.0e−06 |

| Protein name | Locus Name | Acc# |
|---|---|---|
| RNA-directed DNA polymerase,, msDNA specific:DNA nucleotidyltransferase (RNA-directed):reverse transcriptase:revertase | pir:S19248 | S19248 |

Description

| ORF Name | NTID | AAID | NT Length | AA Length | Score | Probability |
|---|---|---|---|---|---|---|
| 14226625_f1_1 | 3263 | 8485 | 187 | 564 | 220 | 4.3e−18 |

| Protein name | Locus Name | Acc# |
|---|---|---|
| | sp:YG77_METJA | Q59071 |

Description

HYPOTHETICAL PROTEIN MJ1677

| ORF Name | NTID | AAID | NT Length | AA Length | Score | Probability |
|---|---|---|---|---|---|---|
| 14958557_c1_200 | 3264 | 8486 | 430 | 1293 | 1219 | 5.9e−124 |

| Protein name | Locus Name | Acc# |
|---|---|---|
| | sp:XAPB_ECOLI | |

Description

XANTHOSINE PERMEASE (XANTHOSINE TRANSPORTER)

| ORF Name | NTID | AAID | NT Length | AA Length | Score | Probability |
|---|---|---|---|---|---|---|
| 15627161_c1_189 | 3265 | 8487 | 239 | 720 | 202 | 3.5e−16 |

| Protein name | Locus Name | Acc# |
|---|---|---|
| transcription regulator Crp/Fnr family | pir:A70344 | A70344 |

Description

-continued

| ORF Name | NTID | AAID | NT Length | AA Length | Score | Probability |
|---|---|---|---|---|---|---|
| 15644206_c1_207 | 3266 | 8488 | 251 | 756 | 601 | 1.8e−58 |

| Protein name | Locus Name | Acc# |
|---|---|---|
| | sp:KDSA_CHLPS | Q46225 |

Description (8-PHOSPHATE SYNTHETASE) (KDO 8-P SYNTHASE)

| ORF Name | NTID | AAID | NT Length | AA Length | Score | Probability |
|---|---|---|---|---|---|---|
| 16203213_c3_314 | 3267 | 8489 | 328 | 987 | 584 | 1.1e−56 |

| Protein name | Locus Name | Acc# |
|---|---|---|
| probable tRNA delta(2)-isopentenylpyrophosphate transferase (miaA) | pir:B71301 | B71301 |

Description

| ORF Name | NTID | AAID | NT Length | AA Length | Score | Probability |
|---|---|---|---|---|---|---|
| 16439662_c1_208 | 3268 | 8490 | 943 | 2832 | 2224 | 1.9e−230 |

| Protein name | Locus Name | Acc# |
|---|---|---|
| immunoreactive 106 kDa antigen PG115 | gp:AF153767 | AF153767 |

Description

*Porphyromonas gingivalis* strain W50 immunoreactive 106 kDa antigen PG115 gene, complete cds.

| ORF Name | NTID | AAID | NT Length | AA Length | Score | Probability |
|---|---|---|---|---|---|---|
| 16836063_c3_325 | 3269 | 8491 | 91 | 276 | 298 | 2.3e−26 |

| Protein name | Locus Name | Acc# |
|---|---|---|
| | sp:RK27_TOBAC | P30155 |

Description

50S RIBOSOMAL PROTEIN L27, CHLOROPLAST PRECURSOR (CL27)

| ORF Name | NTID | AAID | NT Length | AA Length | Score | Probability |
|---|---|---|---|---|---|---|
| 17084637_c3_281 | 3270 | 8492 | 370 | 1113 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 19569032_c2_268 | 3271 | 8493 | 340 | 1023 | 232 | 2.9e−17 |

| Protein name | Locus Name | Acc# |
|---|---|---|
| | sp:GLGA_BACST | O08328 |

Description (SYNTHASE)

-continued

| ORF Name | NTID | AAID | NT Length | AA Length | Score | Probability |
|---|---|---|---|---|---|---|
| 21893753_f3_136 | 3272 | 8494 | 88 | 267 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 22470938_c3_311 | 3273 | 8495 | 195 | 588 | 238 | 5.3e−20 |

| Protein name | | | Locus Name | | | Acc# |
|---|---|---|---|---|---|---|
| | | | sp:Y0DE_MYCTU | | | Q50604 |

Description

HYPOTHETICAL 18.1 KD PROTEIN RV1829

| ORF Name | NTID | AAID | NT Length | AA Length | Score | Probability |
|---|---|---|---|---|---|---|
| 23617062_c2_250 | 3274 | 8496 | 398 | 1197 | 668 | 1.4e−65 |

| Protein name | | | Locus Name | | | Acc# |
|---|---|---|---|---|---|---|
| Hypothetical protein | | | gp:D90734 | | | |

Description

*Escherichia coli* genomic DNA. (22.0–22.3 min).

| ORF Name | NTID | AAID | NT Length | AA Length | Score | Probability |
|---|---|---|---|---|---|---|
| 24025302_c2_264 | 3275 | 8497 | 763 | 2292 | 1140 | 1.4e−115 |

| Protein name | | | Locus Name | | | Acc# |
|---|---|---|---|---|---|---|
| glutamate synthase, beta subunit | | | pir:H72230 | | | H72230 |

Description

| ORF Name | NTID | AAID | NT Length | AA Length | Score | Probability |
|---|---|---|---|---|---|---|
| 24257807_c1_221 | 3276 | 8498 | 507 | 1524 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24431587_f2_104 | 3277 | 8499 | 305 | 918 | 893 | 2.1e−89 |

| Protein name | | | Locus Name | | | Acc# |
|---|---|---|---|---|---|---|
| | | | sp:YPGA_PORGI | | | Q51834 |

Description

HYPOTHETICAL 33.6 KD PROTEIN IN RNHB-PGAA INTERGENIC REGION

-continued

| ORF Name | NTID | AAID | NT Length | AA Length | Score | Probability |
|---|---|---|---|---|---|---|
| 24648542_f2_106 | 3278 | 8500 | 159 | 480 | | |
| Protein name | | | | Locus Name | | Acc# |
| Description | | | | | | |

NO-HIT

| ORF Name | NTID | AAID | NT Length | AA Length | Score | Probability |
|---|---|---|---|---|---|---|
| 24803137_c3_340 | 3279 | 8501 | 232 | 699 | 272 | 1.3e−23 |
| Protein name | | | | Locus Name | | Acc# |
| | | | | sp:Y03M_MYCTU | | Q10647 |
| Description | | | | | | |

HYPOTHETICAL 25.7 KD PROTEIN CY130.22

| ORF Name | NTID | AAID | NT Length | AA Length | Score | Probability |
|---|---|---|---|---|---|---|
| 24821094_c2_231 | 3280 | 8502 | 263 | 792 | 391 | 1.6e−35 |
| Protein name | | | | Locus Name | | Acc# |
| putative vicilin storage protein | | | | gp:ATAC006135 | | AC006135 |
| Description | | | | | | |

*Arabidopsis thaliana* chromosome II BAC F24H14 genomic sequence, complete sequence.

| ORF Name | NTID | AAID | NT Length | AA Length | Score | Probability |
|---|---|---|---|---|---|---|
| 25423461_c1_205 | 3281 | 8503 | 406 | 1221 | 77 | 0.046 |
| Protein name | | | | Locus Name | | Acc# |
| hypothetical protein aq_125 | | | | pir:B70312 | | B70312 |
| Description | | | | | | |

| ORF Name | NTID | AAID | NT Length | AA Length | Score | Probability |
|---|---|---|---|---|---|---|
| 25506557_f2_90 | 3282 | 8504 | 389 | 1170 | | |
| Protein name | | | | Locus Name | | Acc# |
| Description | | | | | | |

NO-HIT

| ORF Name | NTID | AAID | NT Length | AA Length | Score | Probability |
|---|---|---|---|---|---|---|
| 25589087_c3_322 | 3283 | 8505 | 176 | 531 | 267 | 4.5e−23 |
| Protein name | | | | Locus Name | | Acc# |
| | | | | sp:SPR_ECOLI | | |
| Description | | | | | | |

LIPOPROTEIN SPR PRECURSOR

-continued

| ORF Name | NTID | AAID | NT Length | AA Length | Score | Probability |
|---|---|---|---|---|---|---|
| 26204662_f3_113 | 3284 | 8506 | 466 | 1401 | 593 | 1.3e−57 |

| Protein name | | | | Locus Name | | Acc# |
|---|---|---|---|---|---|---|
| | | | | sp:AMY_METJA | | Q59006 |

Description

PUTATIVE ALPHA-AMYLASE,

| ORF Name | NTID | AAID | NT Length | AA Length | Score | Probability |
|---|---|---|---|---|---|---|
| 26287593_f2_66 | 3285 | 8507 | 61 | 186 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 26359703_c2_263 | 3286 | 8508 | 121 | 366 | 206 | 1.3e−16 |

| Protein name | | | | Locus Name | | Acc# |
|---|---|---|---|---|---|---|
| | | | | sp:RL21_HAEIN | | P44359 |

Description

50S RIBOSOMAL PROTEIN L21

| ORF Name | NTID | AAID | NT Length | AA Length | Score | Probability |
|---|---|---|---|---|---|---|
| 26449224_c1_169 | 3287 | 8509 | 158 | 477 | 266 | 5.7e−23 |

| Protein name | | | | Locus Name | | Acc# |
|---|---|---|---|---|---|---|
| hypothetical protein C11G6.3 | | | | pir:T19201 | | T19201 |

Description

| ORF Name | NTID | AAID | NT Length | AA Length | Score | Probability |
|---|---|---|---|---|---|---|
| 26600050_f2_103 | 3288 | 8510 | 599 | 1800 | 2475 | 4.7e−257 |

| Protein name | | | | Locus Name | | Acc# |
|---|---|---|---|---|---|---|
| heme uptake protein A and B | | | | gp:AF143945 | | AF143945 |

Description

*Porphyromonas gingivalis* heme uptake protein A and B gene, complete cds.

| ORF Name | NTID | AAID | NT Length | AA Length | Score | Probability |
|---|---|---|---|---|---|---|
| 29316930_f2_110 | 3289 | 8511 | 646 | 1941 | 416 | 1.2e−35 |

| Protein name | | | | Locus Name | | Acc# |
|---|---|---|---|---|---|---|
| sensory transduction histidine kinase slr2098:protein slr2098:protein slr2098 | | | | pir:S75130 | | S75130 |

Description

-continued

| ORF Name | NTID | AAID | NT Length | AA Length | Score | Probability |
|---|---|---|---|---|---|---|
| 30585005_c2_256 | 3290 | 8512 | 218 | 657 | 227 | 7.7e−19 |

| Protein name | Locus Name | Acc# |
|---|---|---|
| Vexp2 | gp:AF140784 | AF140784 |

Description

*Streptococcus pneumoniae* Vexp1 (vex1), Vexp2 (vex2), Vexp3 (vex3), and P28 (pep27) genes, complete cds.

| ORF Name | NTID | AAID | NT Length | AA Length | Score | Probability |
|---|---|---|---|---|---|---|
| 30743760_f2_100 | 3291 | 8513 | 740 | 2223 | | |

| Protein name | Locus Name | Acc# |
|---|---|---|
| | | |

Description

NO HIT

| ORF Name | NTID | AAID | NT Length | AA Length | Score | Probability |
|---|---|---|---|---|---|---|
| 33397137_f2_93 | 3292 | 8514 | 320 | 963 | 780 | 1.9e−77 |

| Protein name | Locus Name | Acc# |
|---|---|---|
| thioredoxin reductase | gp:AF124757 | AF124757 |

Description

*Zymomonas mobilis* fosmid clone 43D2, complete sequence.

| ORF Name | NTID | AAID | NT Length | AA Length | Score | Probability |
|---|---|---|---|---|---|---|
| 33476540_c2_248 | 3293 | 8515 | 237 | 714 | 107 | 0.00080 |

| Protein name | Locus Name | Acc# |
|---|---|---|
| hypothetical protein SC66T3.28c | pir:T35385 | T35385 |

Description

| ORF Name | NTID | AAID | NT Length | AA Length | Score | Probability |
|---|---|---|---|---|---|---|
| 34261093_c3_276 | 3294 | 8516 | 302 | 909 | 394 | 7.7e−36 |

| Protein name | Locus Name | Acc# |
|---|---|---|
| putative vicilin storage protein | gp:ATAC006135 | AC006135 |

Description

*Arabidopsis thaliana* chromosome II BAC F24H14 genomic sequence, complete sequence.

| ORF Name | NTID | AAID | NT Length | AA Length | Score | Probability |
|---|---|---|---|---|---|---|
| 35595442_f1_55 | 3295 | 8517 | 176 | 531 | | |

| Protein name | Locus Name | Acc# |
|---|---|---|
| | | |

Description

NO HIT

-continued

| ORF Name | NTID | AAID | NT Length | AA Length | Score | Probability |
|---|---|---|---|---|---|---|
| 35739643_c3_308 | 3296 | 8518 | 74 | 225 | | |

| Protein name | | | | Locus Name | | Acc# |
|---|---|---|---|---|---|---|
| | | | | | | |

Description

NO HIT

| ORF Name | NTID | AAID | NT Length | AA Length | Score | Probability |
|---|---|---|---|---|---|---|
| 36132943_c1_170 | 3297 | 8519 | 133 | 402 | 203 | 3.1e−15 |

| Protein name | | | | Locus Name | | Acc# |
|---|---|---|---|---|---|---|
| | | | | gp:SCYKL202W | | |

Description

*S. cerevisiae* chromosome XI reading frame ORF YKL202w.

| ORF Name | NTID | AAID | NT Length | AA Length | Score | Probability |
|---|---|---|---|---|---|---|
| 36225250_f3_112 | 3298 | 8520 | 431 | 1296 | 363 | 4.3e−40 |

| Protein name | | | | Locus Name | | Acc# |
|---|---|---|---|---|---|---|
| probable lipopolysaccharide N-acetylglucosaminyltransferase, rfbU | | | | pir:F64500 | | F64500 |

Description

| ORF Name | NTID | AAID | NT Length | AA Length | Score | Probability |
|---|---|---|---|---|---|---|
| 3913411_c3_298 | 3299 | 8521 | 819 | 2460 | 1108 | 1.4e−119 |

| Protein name | | | | Locus Name | | Acc# |
|---|---|---|---|---|---|---|
| beta-N-acetylglucosaminidase | | | | gp:AF072374 | | AF072374 |

Description

*Pseudoalteromonas* sp. S9 beta-N-acetylglucosaminidase (chiQ) gene, complete cds.

| ORF Name | NTID | AAID | NT Length | AA Length | Score | Probability |
|---|---|---|---|---|---|---|
| 4004010_f1_51 | 3300 | 8522 | 85 | 258 | | |

| Protein name | | | | Locus Name | | Acc# |
|---|---|---|---|---|---|---|
| | | | | | | |

Description

NO HIT

| ORF Name | NTID | AAID | NT Length | AA Length | Score | Probability |
|---|---|---|---|---|---|---|
| 4022790_f1_2 | 3301 | 8523 | 649 | 1950 | 236 | 1.4e−27 |

| Protein name | | | | Locus Name | | Acc# |
|---|---|---|---|---|---|---|
| glycogen debranching enzyme-related protein | | | | pir:H75549 | | H75549 |

Description

-continued

| ORF Name | NTID | AAID | NT Length | AA Length | Score | Probability |
|---|---|---|---|---|---|---|
| 4085937_c2_241 | 3302 | 8524 | 745 | 2238 | 3767 | 0.0 |

| Protein name | Locus Name | Acc# |
|---|---|---|
| | sp:GLNA_BACFR | P15623 |

Description

GLUTAMINE SYNTHETASE, (GLUTAMATE--AMMONIA LIGASE) (GS)

| ORF Name | NTID | AAID | NT Length | AA Length | Score | Probability |
|---|---|---|---|---|---|---|
| 4104687_c2_260 | 3303 | 8525 | 238 | 717 | 343 | 4.0e−31 |

| Protein name | Locus Name | Acc# |
|---|---|---|
| abc transporter, ATP-binding protein PAB1696 | pir:H75077 | H75077 |

Description

| ORF Name | NTID | AAID | NT Length | AA Length | Score | Probability |
|---|---|---|---|---|---|---|
| 4115892_c3_326 | 3304 | 8526 | 427 | 1284 | 879 | 6.3e−88 |

| Protein name | Locus Name | Acc# |
|---|---|---|
| | sp:SYS_AQUAE | O66647 |

Description

SERYL-TRNA SYNTHETASE, (SERINE--TRNA LIGASE) (SERRS)

| ORF Name | NTID | AAID | NT Length | AA Length | Score | Probability |
|---|---|---|---|---|---|---|
| 4117177_c2_254 | 3305 | 8527 | 232 | 699 | 208 | 8.0e−17 |

| Protein name | Locus Name | Acc# |
|---|---|---|
| | sp:YGGJ_HAEIN | P44627 |

Description

HYPOTHETICAL PROTEIN HI0303

| ORF Name | NTID | AAID | NT Length | AA Length | Score | Probability |
|---|---|---|---|---|---|---|
| 4408537_c1_209 | 3306 | 8528 | 496 | 1491 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4490927_c2_238 | 3307 | 8529 | 264 | 795 | 624 | 6.6e−61 |

| Protein name | Locus Name | Acc# |
|---|---|---|
| | sp:YABN_BACSU | P37556 |

Description

HYPOTHETICAL 56.1 KD PROTEIN IN MFD-DIVIC INTERGENIC REGION

-continued

| ORF Name | NTID | AAID | NT Length | AA Length | Score | Probability |
|---|---|---|---|---|---|---|
| 4798203_f1_45 | 3308 | 8530 | 216 | 651 | 108 | 0.0012 |

| Protein name | | | | Locus Name | | Acc# |
|---|---|---|---|---|---|---|
| | | | | sp:Y687_METJA | | Q58100 |

Description

HYPOTHETICAL PROTEIN MJ0687

| ORF Name | NTID | AAID | NT Length | AA Length | Score | Probability |
|---|---|---|---|---|---|---|
| 4876507_f1_57 | 3309 | 8531 | 884 | 2655 | 1890 | 4.6e−195 |

| Protein name | | | | Locus Name | | Acc# |
|---|---|---|---|---|---|---|
| valine--tRNA ligase, | | | | pir:D72206 | | D72206 |

Description

| ORF Name | NTID | AAID | NT Length | AA Length | Score | Probability |
|---|---|---|---|---|---|---|
| 4895087_c3_315 | 3310 | 8532 | 317 | 954 | 289 | 2.1e−25 |

| Protein name | | | | Locus Name | | Acc# |
|---|---|---|---|---|---|---|
| conserved hypothetical protein | | | | pir:F72386 | | F72386 |

Description

| ORF Name | NTID | AAID | NT Length | AA Length | Score | Probability |
|---|---|---|---|---|---|---|
| 4897750_c2_255 | 3311 | 8533 | 526 | 1581 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 4944011_f2_105 | 3312 | 8534 | 191 | 576 | 218 | 7.0e−18 |

| Protein name | | | | Locus Name | | Acc# |
|---|---|---|---|---|---|---|
| RNA polymerase sigma-E factor | | | | pir:B72234 | | B72234 |

Description

| ORF Name | NTID | AAID | NT Length | AA Length | Score | Probability |
|---|---|---|---|---|---|---|
| 5110962_c2_249 | 3313 | 8535 | 218 | 657 | 230 | 1.3e−17 |

| Protein name | | | | Locus Name | | Acc# |
|---|---|---|---|---|---|---|
| DNA helicase 1 | | | | pir:T14895 | | T14895 |

Description

-continued

| ORF Name | NTID | AAID | NT Length | AA Length | Score | Probability |
|---|---|---|---|---|---|---|
| 5350265_f1_52 | 3314 | 8536 | 287 | 864 | 209 | 2.2e−34 |
| Protein name | | | | Locus Name | | Acc# |
| | | | | sp:RT65_MYXXA | | P23071 |

Description

TRANSCRIPTASE) (MX65-RT)

| ORF Name | NTID | AAID | NT Length | AA Length | Score | Probability |
|---|---|---|---|---|---|---|
| 657555_f1_44 | 3315 | 8537 | 838 | 2517 | 1042 | 9.7e−108 |
| Protein name | | | | Locus Name | | Acc# |
| | | | | sp:SP3E_BACSU | | |

Description

STAGE III SPORULATION PROTEIN E

| ORF Name | NTID | AAID | NT Length | AA Length | Score | Probability |
|---|---|---|---|---|---|---|
| 819075_f1_8 | 3316 | 8538 | 134 | 405 | 342 | 5.0e−31 |
| Protein name | | | | Locus Name | | Acc# |
| PanD protein | | | | gp:WSAJ3049 | | AJ003049 |

Description

*Wolinella succinogenes* hydD, hydE, panD and ispA genes; orf102 and orf341.

| ORF Name | NTID | AAID | NT Length | AA Length | Score | Probability |
|---|---|---|---|---|---|---|
| 822750_f3_116 | 3317 | 8539 | 310 | 933 | 593 | 1.3e−57 |
| Protein name | | | | Locus Name | | Acc# |
| pantoate--beta-alanine ligase | | | | pir:E72296 | | E72296 |

Description

| ORF Name | NTID | AAID | NT Length | AA Length | Score | Probability |
|---|---|---|---|---|---|---|
| 10552012_c3_265 | 3318 | 8540 | 288 | 867 | 151 | 2.0e−08 |
| Protein name | | | | Locus Name | | Acc# |
| PobR | | | | gp:RLU40388 | | U40388 |

Description

*Rhizobium leguminosarum* positive regulator of pobA (pobR) gene, complete cds, and 4-hydroxybenzoate hydroxylase (pobA) gene, partial cds.

| ORF Name | NTID | AAID | NT Length | AA Length | Score | Probability |
|---|---|---|---|---|---|---|
| 10597812_c2_233 | 3319 | 8541 | 323 | 972 | 249 | 3.6e−21 |
| Protein name | | | | Locus Name | | Acc# |
| hypothetical protein PAB0040 | | | | pir:B75194 | | B75194 |

Description

| ORF Name | NTID | AAID | NT Length | AA Length | Score | Probability |
|---|---|---|---|---|---|---|
| 10728380_c3_284 | 3320 | 8542 | 269 | 810 | 138 | 5.6e−07 |

| Protein name | Locus Name | Acc# |
|---|---|---|
| | sp:YA52_HAEIN | P45008 |

Description

HYPOTHETICAL TRANSCRIPTIONAL REGULATOR HI1052

| ORF Name | NTID | AAID | NT Length | AA Length | Score | Probability |
|---|---|---|---|---|---|---|
| 10815938_f3_136 | 3321 | 8543 | 165 | 498 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 11928462_f2_82 | 3322 | 8544 | 291 | 876 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 12557692_c3_288 | 3323 | 8545 | 430 | 1293 | 791 | 1.3e−78 |

| Protein name | Locus Name | Acc# |
|---|---|---|
| hypothetical protein HP0513 | pir:A64584 | A64584 |

Description

| ORF Name | NTID | AAID | NT Length | AA Length | Score | Probability |
|---|---|---|---|---|---|---|
| 12968877_f1_13 | 3324 | 8546 | 283 | 852 | 204 | 2.1e−16 |

| Protein name | Locus Name | Acc# |
|---|---|---|
| | sp:FPG_LACLC | P42371 |

Description

GLYCOSYLASE)

| ORF Name | NTID | AAID | NT Length | AA Length | Score | Probability |
|---|---|---|---|---|---|---|
| 12978802_c2_218 | 3325 | 8547 | 338 | 1017 | 502 | 5.6e−48 |

| Protein name | Locus Name | Acc# |
|---|---|---|
| OprM | gp:AB011381 | AB011381 |

Description

*Pseudomonas aeruginosa* gene for OprM, complete cds.

-continued

| ORF Name | NTID | AAID | NT Length | AA Length | Score | Probability |
|---|---|---|---|---|---|---|
| 13711378_c1_183 | 3326 | 8548 | 560 | 1683 | 1603 | 1.2e−164 |

| Protein name | Locus Name | Acc# |
|---|---|---|
| probable pyrophosphate--fructose 6-phosphate 1-phosphotransferase, beta subunit | pir:C71312 | C71312 |

Description

| ORF Name | NTID | AAID | NT Length | AA Length | Score | Probability |
|---|---|---|---|---|---|---|
| 13867937_c3_254 | 3327 | 8549 | 968 | 2097 | 149 | 1.5e−05 |

| Protein name | Locus Name | Acc# |
|---|---|---|
| KIAA0738 protein | gp:AB018281 | AB018281 |

Description

*Homo sapiens* mRNA for KIAA0738 protein, complete cds.

| ORF Name | NTID | AAID | NT Length | AA Length | Score | Probability |
|---|---|---|---|---|---|---|
| 14644032_f1_19 | 3328 | 8550 | 176 | 531 | 140 | 1.3e−09 |

| Protein name | Locus Name | Acc# |
|---|---|---|
| arsenate reductase | pir:B70360 | B70360 |

Description

| ORF Name | NTID | AAID | NT Length | AA Length | Score | Probability |
|---|---|---|---|---|---|---|
| 14867837_c3_255 | 3329 | 8551 | 62 | 189 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 156306_c2_231 | 3330 | 8552 | 395 | 1188 | 802 | 9.1e−80 |

| Protein name | Locus Name | Acc# |
|---|---|---|
| | sp:TRKH_ECOLI | |

Description

TRK SYSTEM POTASSIUM UPTAKE PROTEIN TRKH

| ORF Name | NTID | AAID | NT Length | AA Length | Score | Probability |
|---|---|---|---|---|---|---|
| 156376_c3_253 | 3331 | 8553 | 250 | 753 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 16603380_c2_247 | 3332 | 8554 | 316 | 951 | 546 | 1.2e−52 |

| Protein name | Locus Name | Acc# |
|---|---|---|
| hypothetical protein jhp0462 | pir:C71929 | C71929 |

Description

| ORF Name | NTID | AAID | NT Length | AA Length | Score | Probability |
|---|---|---|---|---|---|---|
| 16832885_f1_16 | 3333 | 8555 | 431 | 1296 | 1723 | 2.3e−177 |

| Protein name | Locus Name | Acc# |
|---|---|---|
| hypothetical protein | pir:JQ1020 | JQ1020 |

Description

| ORF Name | NTID | AAID | NT Length | AA Length | Score | Probability |
|---|---|---|---|---|---|---|
| 20447626_c3_285 | 3334 | 8556 | 134 | 405 | 86 | 0.00069 |

| Protein name | Locus Name | Acc# |
|---|---|---|
| unknown | gp:AF025662 | AF025662 |

Description

*Vibrio cholerae* lipoprotein (vlpA) and unknown proteins genes, complete cds.

| ORF Name | NTID | AAID | NT Length | AA Length | Score | Probability |
|---|---|---|---|---|---|---|
| 20502012_c3_290 | 3335 | 8557 | 256 | 771 | 741 | 2.6e−73 |

| Protein name | Locus Name | Acc# |
|---|---|---|
|  | sp:HIS6_BACSU | O34727 |

Description

HISF PROTEIN (CYCLASE)

| ORF Name | NTID | AAID | NT Length | AA Length | Score | Probability |
|---|---|---|---|---|---|---|
| 22459550_f3_174 | 3336 | 8558 | 186 | 561 | 199 | 7.2e−16 |

| Protein name | Locus Name | Acc# |
|---|---|---|
| RNA polymerase sigma factor SigZ-like protein | gp:AF137263 | AF137263 |

Description

Bacteroides thetaiotaomicron 30S ribosomal protein S16-like protein, fucose
gene cluster, and RNA polymerase sigma factor SigZ-like protein (sigZ) genes, complete cds.

| ORF Name | NTID | AAID | NT Length | AA Length | Score | Probability |
|---|---|---|---|---|---|---|
| 22860128_f2_84 | 3337 | 8559 | 83 | 252 | 64 | 0.031 |

| Protein name | Locus Name | Acc# |
|---|---|---|
|  | sp:SPRC_XENLA | P36378 |

Description (OSTEONECTIN) (ON) (BASEMENT MEMBRANE PROTEIN BM-40)

-continued

| ORF Name | NTID | AAID | NT Length | AA Length | Score | Probability |
|---|---|---|---|---|---|---|
| 23445387_c1_197 | 3338 | 8560 | 194 | 585 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 23598385_f3_135 | 3339 | 8561 | 205 | 618 | 319 | 1.4e−28 |
| Protein name | | | Locus Name | | | Acc# |
| hypothetical protein ydeA | | | pir:C69777 | | | C69777 |
| Description | | | | | | |

| ORF Name | NTID | AAID | NT Length | AA Length | Score | Probability |
|---|---|---|---|---|---|---|
| 24025292_c1_178 | 3340 | 8562 | 1126 | 3381 | 455 | 3.8e−73 |
| Protein name | | | Locus Name | | | Acc# |
| 115K outer membrane protein precursor:SusC protein | | | pir:JC6027 | | | JC6027 |
| Description | | | | | | |

| ORF Name | NTID | AAID | NT Length | AA Length | Score | Probability |
|---|---|---|---|---|---|---|
| 24227211_f1_30 | 3341 | 8563 | 102 | 309 | 229 | 4.8e−19 |
| Protein name | | | Locus Name | | | Acc# |
| | | | sp:YGBA_ECOLI | | | P25728 |
| Description | | | | | | |
| HYPOTHETICAL 13.9 KD PROTEIN IN FHLA-MUTS INTERGENIC REGION | | | | | | |

| ORF Name | NTID | AAID | NT Length | AA Length | Score | Probability |
|---|---|---|---|---|---|---|
| 24257786_f2_114 | 3342 | 8564 | 89 | 270 | 91 | 0.0032 |
| Protein name | | | Locus Name | | | Acc# |
| hypothetical protein pXO1-90 | | | pir:B59102 | | | B59102 |
| Description | | | | | | |

| ORF Name | NTID | AAID | NT Length | AA Length | Score | Probability |
|---|---|---|---|---|---|---|
| 24406506_f2_97 | 3343 | 8565 | 96 | 291 | 131 | 1.2e−08 |
| Protein name | | | Locus Name | | | Acc# |
| unknown | | | gp:LLU80410 | | | U80410 |
| Description | | | | | | |
| *Lactococcus lactis* cremoris phosphopentomutase (deoB) and purine nucleoside phosphorylase (deoD) genes, complete cds. | | | | | | |

-continued

| ORF Name | NTID | AAID | NT Length | AA Length | Score | Probability |
|---|---|---|---|---|---|---|
| 24647562_c2_223 | 3344 | 8566 | 287 | 864 | 488 | 1.7e−46 |

| Protein name | Locus Name | Acc# |
|---|---|---|
| | sp:YEGX_ECOLI | |

Description

HYPOTHETICAL 32.0 KD PROTEIN IN FBAB-THID INTERGENIC REGION

| ORF Name | NTID | AAID | NT Length | AA Length | Score | Probability |
|---|---|---|---|---|---|---|
| 24647760_c3_287 | 3345 | 8567 | 137 | 414 | 157 | 2.0e−11 |

| Protein name | Locus Name | Acc# |
|---|---|---|
| probable general stress protein 26 | pir:D75431 | D75431 |

Description

| ORF Name | NTID | AAID | NT Length | AA Length | Score | Probability |
|---|---|---|---|---|---|---|
| 24648567_c1_180 | 3346 | 8568 | 302 | 909 | 129 | 0.00044 |

| Protein name | Locus Name | Acc# |
|---|---|---|
| hypothetical protein SC3A7.16c | pir:T29435 | T29435 |

Description

| ORF Name | NTID | AAID | NT Length | AA Length | Score | Probability |
|---|---|---|---|---|---|---|
| 26257937_f1_15 | 3347 | 8569 | 360 | 1083 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 26384687_c3_258 | 3348 | 8570 | 88 | 267 | 129 | 1.9e−08 |

| Protein name | Locus Name | Acc# |
|---|---|---|
| hypothetical protein APE0900 | pir:D72685 | D72685 |

Description

| ORF Name | NTID | AAID | NT Length | AA Length | Score | Probability |
|---|---|---|---|---|---|---|
| 26447312_f1_40 | 3349 | 8571 | 73 | 222 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 26597066_c1_214 | 3350 | 8572 | 234 | 705 | 445 | 6.1e−42 |

| Protein name | Locus Name | Acc# |
|---|---|---|
| cell division ATP-binding protein ftsE | pir:E70919 | |

Description

-continued

| ORF Name | NTID | AAID | NT Length | AA Length | Score | Probability |
|---|---|---|---|---|---|---|
| 26694091_f3_125 | 3351 | 8573 | 69 | 210 | 102 | 1.4e−05 |

| Protein name | | | | Locus Name | | Acc# |
|---|---|---|---|---|---|---|
| hypothetical protein | | | | gp:SSU18930 | | Y18930 |

Description

*Sulfolobus solfataricus* 281 kb genomic DNA fragment, strain P2.

| ORF Name | NTID | AAID | NT Length | AA Length | Score | Probability |
|---|---|---|---|---|---|---|
| 29406301_c2_230 | 3352 | 8574 | 128 | 387 | 97 | 0.00048 |

| Protein name | | | | Locus Name | | Acc# |
|---|---|---|---|---|---|---|
| TRK potassium uptake system protein (trkH) homolog | | | | pir:G69354 | | G69354 |

Description

| ORF Name | NTID | AAID | NT Length | AA Length | Score | Probability |
|---|---|---|---|---|---|---|
| 29417562_f2_81 | 3353 | 8575 | 257 | 774 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 32125280_f3_154 | 3354 | 8576 | 61 | 186 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 33229628_f3_163 | 3355 | 8577 | 65 | 198 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 33369017_c3_286 | 3356 | 8578 | 274 | 825 | 109 | 2.5e−05 |

| Protein name | | | | Locus Name | | Acc# |
|---|---|---|---|---|---|---|
| probable araC family transcription regulator | | | | pir:T35902 | | T35902 |

Description

-continued

| ORF Name | NTID | AAID | NT Length | AA Length | Score | Probability |
|---|---|---|---|---|---|---|
| 33789127_c1_212 | 3357 | 8579 | 244 | 735 | 455 | 5.4e−43 |

| Protein name | Locus Name | Acc# |
|---|---|---|
| phosphoribosylformimino-5 aminoimidazole | gp:AB008676 | AB008676 |

Description

*Escherichia coli* 0157 DNA, map position at 46 min., complete cds.

| ORF Name | NTID | AAID | NT Length | AA Length | Score | Probability |
|---|---|---|---|---|---|---|
| 34084407_f3_158 | 3358 | 8580 | 60 | 183 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 3928385_c1_179 | 3359 | 8581 | 639 | 1920 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4098430_f1_35 | 3360 | 8582 | 395 | 1188 | 656 | 2.7e−64 |

| Protein name | Locus Name | Acc# |
|---|---|---|
| putative membrane transport protein. | gp:SCC75A | AL133220 |

Description

*Streptomyces coelicolor* cosmid C75A.

| ORF Name | NTID | AAID | NT Length | AA Length | Score | Probability |
|---|---|---|---|---|---|---|
| 4101550_c1_202 | 3361 | 8583 | 105 | 318 | 208 | 8.0e−17 |

| Protein name | Locus Name | Acc# |
|---|---|---|
| hypothetical protein ysdA | pir:G69983 | G69983 |

Description

| ORF Name | NTID | AAID | NT Length | AA Length | Score | Probability |
|---|---|---|---|---|---|---|
| 4175305_f2_72 | 3362 | 8584 | 81 | 246 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 42700_f1_17 | 3363 | 8585 | 247 | 744 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 4414677_c2_249 | 3364 | 8586 | 206 | 621 | 540 | 5.3e−52 |

| Protein name | | | | Locus Name | | Acc# |
|---|---|---|---|---|---|---|
| | | | | sp:HIS2_KLEPN | | O24714 |

Description

| ORF Name | NTID | AAID | NT Length | AA Length | Score | Probability |
|---|---|---|---|---|---|---|
| 4459456_c3_268 | 3365 | 8587 | 407 | 1224 | 152 | 3.9e−07 |

| Protein name | | | | Locus Name | | Acc# |
|---|---|---|---|---|---|---|
| chromosome assembly protein homolog | | | | pir:B70356 | | B70356 |

Description

| ORF Name | NTID | AAID | NT Length | AA Length | Score | Probability |
|---|---|---|---|---|---|---|
| 4723450_f1_8 | 3366 | 8588 | 68 | 207 | 79 | 0.017 |

| Protein name | | | | Locus Name | | Acc# |
|---|---|---|---|---|---|---|
| hypothetical protein YHR167w | | | | pir:S52609 | | S52609 |

Description

| ORF Name | NTID | AAID | NT Length | AA Length | Score | Probability |
|---|---|---|---|---|---|---|
| 4875287_c1_211 | 3367 | 8589 | 199 | 600 | 440 | 2.1e−41 |

| Protein name | | | | Locus Name | | Acc# |
|---|---|---|---|---|---|---|
| | | | | sp:HIS5_ECOLI | | P10375 |

Description

AMIDOTRANSFERASE HISH,

| ORF Name | NTID | AAID | NT Length | AA Length | Score | Probability |
|---|---|---|---|---|---|---|
| 4878126_c2_251 | 3368 | 8590 | 390 | 1173 | 700 | 5.8e−69 |

| Protein name | | | | Locus Name | | Acc# |
|---|---|---|---|---|---|---|
| diaminopimelate decarboxylase, | | | | pir:C70404 | | C70404 |

Description

-continued

| ORF Name | NTID | AAID | NT Length | AA Length | Score | Probability |
|---|---|---|---|---|---|---|
| 4885942_c2_250 | 3369 | 8591 | 377 | 1134 | 538 | 8.6e−52 |

| Protein name | Locus Name | Acc# |
|---|---|---|
| precursor monofunctional aspartokinase | gp:AF135862 | AF135862 |

Description

Glycine max precursor monofunctional aspartokinase mRNA, complete cds.

| ORF Name | NTID | AAID | NT Length | AA Length | Score | Probability |
|---|---|---|---|---|---|---|
| 4901562_c2_224 | 3370 | 8592 | 446 | 1341 | 378 | 1.8e−39 |

| Protein name | Locus Name | Acc# |
|---|---|---|
| cell division inhibitor:protein slr1223:protein slr1223 | pir:S77404 | S77404 |

Description

| ORF Name | NTID | AAID | NT Length | AA Length | Score | Probability |
|---|---|---|---|---|---|---|
| 5177305_f1_18 | 3371 | 8593 | 320 | 963 | 738 | 5.5e−73 |

| Protein name | Locus Name | Acc# |
|---|---|---|
| | sp:YBIN_ECOLI | P75782 |

Description

HYPOTHETICAL 34.2 KD PROTEIN IN DING-GLNQ INTERGENIC REGION

| ORF Name | NTID | AAID | NT Length | AA Length | Score | Probability |
|---|---|---|---|---|---|---|
| 5329811_f2_96 | 3372 | 8594 | 303 | 912 | 190 | 2.8e−13 |

| Protein name | Locus Name | Acc# |
|---|---|---|
| transcription regulator AraC/XylS family homolog ydeE | pir:G69777 | G69777 |

Description

| ORF Name | NTID | AAID | NT Length | AA Length | Score | Probability |
|---|---|---|---|---|---|---|
| 5875817_c2_240 | 3373 | 8595 | 256 | 771 | 162 | 6.5e−12 |

| Protein name | Locus Name | Acc# |
|---|---|---|
| mutator protein mutT:hypothetical protein sll1045:hypothetical protein sll1045 | pir:S74508 | S74508 |

Description

| ORF Name | NTID | AAID | NT Length | AA Length | Score | Probability |
|---|---|---|---|---|---|---|
| 631558_f2_95 | 3374 | 8596 | 319 | 960 | 226 | 9.9e−19 |

| Protein name | Locus Name | Acc# |
|---|---|---|
| | sp:YT29_MYCTU | P71564 |

Description

PUTATIVE OXIDOREDUCTASE RV0945,

-continued

| ORF Name | NTID | AAID | NT Length | AA Length | Score | Probability |
|---|---|---|---|---|---|---|
| 800677_c1_184 | 3375 | 8597 | 572 | 1719 | | |

| Protein name | | Locus Name | Acc# |
|---|---|---|---|
| | | | |

Description

NO-HIT

| ORF Name | NTID | AAID | NT Length | AA Length | Score | Probability |
|---|---|---|---|---|---|---|
| 9792715_c2_236 | 3376 | 8598 | 1242 | 3729 | 194 | 2.7e−23 |

| Protein name | | Locus Name | Acc# |
|---|---|---|---|
| chromosome assembly protein homolog | | pir:B70356 | B70356 |

Description

| ORF Name | NTID | AAID | NT Length | AA Length | Score | Probability |
|---|---|---|---|---|---|---|
| 9820893_c1_216 | 3377 | 8599 | 68 | 207 | | |

| Protein name | | Locus Name | Acc# |
|---|---|---|---|
| | | | |

Description

NO-HIT

| ORF Name | NTID | AAID | NT Length | AA Length | Score | Probability |
|---|---|---|---|---|---|---|
| 12583432_c1_57 | 3378 | 8600 | 111 | 336 | 146 | 3.0e−10 |

| Protein name | | Locus Name | Acc# |
|---|---|---|---|
| | | gp:AB006709 | AB006709 |

Description

*Vibrio alginolyticus* rpoN gene for RNA polymerase sigma factor N, partial and complete cds.

| ORF Name | NTID | AAID | NT Length | AA Length | Score | Probability |
|---|---|---|---|---|---|---|
| 14508412_c3_77 | 3379 | 8601 | 174 | 525 | 158 | 1.6e−11 |

| Protein name | | Locus Name | Acc# |
|---|---|---|---|
| | | sp:RL10_BACSU | P42923 |

Description (VEGETATIVE PROTEIN 300) (VEG300)

| ORF Name | NTID | AAID | NT Length | AA Length | Score | Probability |
|---|---|---|---|---|---|---|
| 19627151_f1_16 | 3380 | 8602 | 196 | 591 | 383 | 2.3e−35 |

| Protein name | | Locus Name | Acc# |
|---|---|---|---|
| hypothetical protein RP516 | | pir:F71655 | F71655 |

Description

-continued

| ORF Name | NTID | AAID | NT Length | AA Length | Score | Probability |
|---|---|---|---|---|---|---|
| 22462765_f3_47 | 3381 | 8603 | 593 | 1782 | 1077 | 6.6e−109 |

| Protein name | Locus Name | Acc# |
|---|---|---|
| aminopeptidase P | gp:DME131920 | AJ131920 |

Description

*Drosophila melanogaster* Daminopep-p gene, partial.

| ORF Name | NTID | AAID | NT Length | AA Length | Score | Probability |
|---|---|---|---|---|---|---|
| 23710302_c2_65 | 3382 | 8604 | 399 | 1200 | 2049 | 6.5e−212 |

| Protein name | Locus Name | Acc# |
|---|---|---|
|  | sp:EFTU_BACFR | P33165 |

Description

ELONGATION FACTOR TU (EF-TU)

| ORF Name | NTID | AAID | NT Length | AA Length | Score | Probability |
|---|---|---|---|---|---|---|
| 24407752_c2_67 | 3383 | 8605 | 151 | 456 | 442 | 1.3e−41 |

| Protein name | Locus Name | Acc# |
|---|---|---|
|  | sp:RL11_MYCTU | P96931 |

Description

50S RIBOSOMAL PROTEIN L11

| ORF Name | NTID | AAID | NT Length | AA Length | Score | Probability |
|---|---|---|---|---|---|---|
| 274030_f1_12 | 3384 | 8606 | 95 | 288 | 108 | 3.2e−06 |

| Protein name | Locus Name | Acc# |
|---|---|---|
| hypothetical protein PH1485 | pir:H71023 | H71023 |

Description

| ORF Name | NTID | AAID | NT Length | AA Length | Score | Probability |
|---|---|---|---|---|---|---|
| 2985637_c1_59 | 3385 | 8607 | 114 | 345 | 93 | 0.00012 |

| Protein name | Locus Name | Acc# |
|---|---|---|
| SecE protein | pir:JE0331 | JE0331 |

Description

| ORF Name | NTID | AAID | NT Length | AA Length | Score | Probability |
|---|---|---|---|---|---|---|
| 34120287_c3_76 | 3386 | 8608 | 76 | 231 | 168 | 1.4e−12 |

| Protein name | Locus Name | Acc# |
|---|---|---|
|  | sp:RL1_HAEIN | P44342 |

Description

50S RIBOSOMAL PROTEIN L1

-continued

| ORF Name | NTID | AAID | NT Length | AA Length | Score | Probability |
|---|---|---|---|---|---|---|
| 36222568_c2_60 | 3387 | 8609 | 410 | 1233 | 390 | 4.1e−36 |

| Protein name | Locus Name | Acc# |
|---|---|---|
| 3-deoxy-manno-octulosonic acid transferase | gp:SMU52844 | U52844 |

Description

*Serratia marcescens* putative glycosyltransferase, putative glycosyltransferase, putative heptosyl III transferase (waaQ), 3-deoxy-manno-octulosonic acid transferase (waaA), glucosyltransferase (waaE), and KdtB (kdtB) genes, complete cds; and Fpg (fpg) gene, partial cds.

| ORF Name | NTID | AAID | NT Length | AA Length | Score | Probability |
|---|---|---|---|---|---|---|
| 4297002_c2_63 | 3388 | 8610 | 308 | 927 | 507 | 1.7e−48 |

| Protein name | Locus | Name Acc# |
|---|---|---|
| tyrosine recombinase XerD | gp:AF093548 | AF093548 |

Description

*Staphylococcus aureus* tyrosine recombinase XerD (xerD) gene, complete cds.

| ORF Name | NTID | AAID | NT Length | AA Length | Score | Probability |
|---|---|---|---|---|---|---|
| 4472125_c2_66 | 3389 | 8611 | 190 | 573 | 384 | 1.8e−35 |

| Protein name | Locus Name | Acc# |
|---|---|---|
| 99% identity over 181 amino acids with *E. coli* | gp:STYSTMF1 | AF170176 |

Description

*Salmonella typhimurium* fragment STMF1.

| ORF Name | NTID | AAID | NT Length | AA Length | Score | Probability |
|---|---|---|---|---|---|---|
| 5897507_c2_68 | 3390 | 8612 | 180 | 543 | 463 | 7.6e−44 |

| Protein name | Locus Name | Acc# |
|---|---|---|
| | sp:RL1_STRSQ | Q07976 |

Description

50S RIBOMOMAL PROTEIN L1

| ORF Name | NTID | AAID | NT Length | AA Length | Score | Probability |
|---|---|---|---|---|---|---|
| 6839052_c1_56 | 3391 | 8613 | 89 | 270 | 138 | 2.1e−09 |

| Protein name | Locus Name | Acc# |
|---|---|---|
| | sp:RS21_BORBU | O51271 |

Description

30S RIBOSOMAL PROTEIN S21

-continued

| ORF Name | NTID | AAID | NT Length | AA Length | Score | Probability |
|---|---|---|---|---|---|---|
| 781536_c3_78 | 3392 | 8614 | 138 | 417 | 339 | 1.0e−30 |

| Protein name | Locus Name | Acc# |
|---|---|---|
| | sp:RL7_HAEIN | P44348 |

Description

50S RIBOSOMAL PROTEIN L7/L12

| ORF Name | NTID | AAID | NT Length | AA Length | Score | Probability |
|---|---|---|---|---|---|---|
| 9853461_c2_69 | 3393 | 8615 | 957 | 2871 | 1716 | 1.5e−228 |

| Protein name | Locus Name | Acc# |
|---|---|---|
| RNA polymerase B-subunit | gp:AF087812 | AF087812 |

Description

*Legionella pneumophila* RNA polymerase B-subunit (rpoB) gene, complete cds; and RNA polymerase B'-subunit (rpoC) gene, partial cds.

| ORF Name | NTID | AAID | NT Length | AA Length | Score | Probability |
|---|---|---|---|---|---|---|
| 14650337_f2_2 | 3394 | 8616 | 595 | 1788 | 103 | 1.8e−07 |

| Protein name | Locus Name | Acc# |
|---|---|---|
| unknown | gp:U96771 | U96771 |

Description

*Prevotella bryantii* putative polygalacturonase, B-1,4-endoglucanase, and mannanase genes, complete cds; and unknown genes.

| ORF Name | NTID | AAID | NT Length | AA Length | Score | Probability |
|---|---|---|---|---|---|---|
| 24415717_f3_4 | 3395 | 8617 | 77 | 234 | 146 | 1.6e−09 |

| Protein name | Locus Name | Acc# |
|---|---|---|
| | sp:SUCC_THEFL | P25126 |

Description

SUCCINYL-COA SYNTHETASE BETA CHAIN, (SCS-BETA)

| ORF Name | NTID | AAID | NT Length | AA Length | Score | Probability |
|---|---|---|---|---|---|---|
| 33324216_f2_1 | 3396 | 8618 | 668 | 2007 | 473 | 2.0e−42 |

| Protein name | Locus Name | Acc# |
|---|---|---|
| 115K outer membrane protein precursor:SusC protein | pir:JC6027 | JC6027 |

Description

| ORF Name | NTID | AAID | NT Length | AA Length | Score | Probability |
|---|---|---|---|---|---|---|
| 23617128_c1_25 | 3397 | 8619 | 405 | 1218 | 734 | 1.5e−72 |

| Protein name | Locus Name | Acc# |
|---|---|---|
| putative hydrolase | gp:SCM11 | AL133278 |

Description

*Streptomyces coelicolor* cosmid M11.

-continued

| ORF Name | NTID | AAID | NT Length | AA Length | Score | Probability |
|---|---|---|---|---|---|---|
| 24317062_f2_14 | 3398 | 8620 | 691 | 2076 | 220 | 2.2e−18 |

| Protein name | Locus Name | Acc# |
|---|---|---|
| hypothetical protein TM0280 | pir:F72395 | F72395 |

Description

| ORF Name | NTID | AAID | NT Length | AA Length | Score | Probability |
|---|---|---|---|---|---|---|
| 2991276_f3_19 | 3399 | 8621 | 528 | 1587 | 165 | 5.5e−09 |

| Protein name | Locus Name | Acc# |
|---|---|---|
|  | gp:BOU15179 | U15179 |

Description

*Bacteroides ovatus* arabinosidase (asdII) gene, complete cds and putative transketolase, partial cds.

| ORF Name | NTID | AAID | NT Length | AA Length | Score | Probability |
|---|---|---|---|---|---|---|
| 31437792_f1_9 | 3400 | 8622 | 244 | 735 |  |  |

| Protein name | Locus Name | Acc# |
|---|---|---|
|  |  |  |

Description

NO-HIT

| ORF Name | NTID | AAID | NT Length | AA Length | Score | Probability |
|---|---|---|---|---|---|---|
| 35837506_c1_20 | 3401 | 8623 | 60 | 183 |  |  |

| Protein name | Locus Name | Acc# |
|---|---|---|
|  |  |  |

Description

NO-HIT

| ORF Name | NTID | AAID | NT Length | AA Length | Score | Probability |
|---|---|---|---|---|---|---|
| 4039086_c1_24 | 3402 | 8624 | 371 | 1116 | 102 | 0.017 |

| Protein name | Locus Name | Acc# |
|---|---|---|
| endo-a1,5-arabinanase | gp:PFARBA | Y10458 |

Description

*P. fluorescens* arbA gene or endo-a1,5-arabinanase.

| ORF Name | NTID | AAID | NT Length | AA Length | Score | Probability |
|---|---|---|---|---|---|---|
| 10751260_f3_9 | 3403 | 8625 | 740 | 2223 | 842 | 2.2e−89 |

| Protein name | Locus Name | Acc# |
|---|---|---|
|  | sp:HLY2_ECOLI | P10089 |

Description

HEMOLYSIN SECRETION ATP-BINDING PROTEIN, CHROMOSOMAL

-continued

| ORF Name | NTID | AAID | NT Length | AA Length | Score | Probability |
|---|---|---|---|---|---|---|
| 2365937_f1_2 | 3404 | 8626 | 203 | 612 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24644135_f1_1 | 3405 | 8627 | 223 | 672 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24665831_f3_7 | 3406 | 8628 | 239 | 720 | 146 | 4.8e−08 |

| Protein name | | | | Locus Name | | Acc# |
|---|---|---|---|---|---|---|
| glycosyltransferase | | | | gp:AF146532 | | AF146532 |

Description

*Klebsiella pneumoniae* waa gene cluster.

| ORF Name | NTID | AAID | NT Length | AA Length | Score | Probability |
|---|---|---|---|---|---|---|
| 33442593_f2_6 | 3407 | 8629 | 208 | 627 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 1347692_f1_1 | 3408 | 8630 | 255 | 768 | 557 | 8.3e−54 |

| Protein name | | | | Locus Name | | Acc# |
|---|---|---|---|---|---|---|
| | | | | sp:ATCS_SYNY3 | | P73241 |

Description

CATION-TRANSPORTING ATPASE PACS,

| ORF Name | NTID | AAID | NT Length | AA Length | Score | Probability |
|---|---|---|---|---|---|---|
| 48828124_c1_5 | 3409 | 8631 | 67 | 204 | 178 | 9.6e−13 |

| Protein name | | | | Locus Name | | Acc# |
|---|---|---|---|---|---|---|
| hypothetical protein PFB0225c | | | | pir:E71620 | | E71620 |

Description

-continued

| ORF Name | NTID | AAID | NT Length | AA Length | Score | Probability |
|---|---|---|---|---|---|---|
| 48828124_c2_8 | 3410 | 8632 | 63 | 192 | 168 | 1.2e−11 |
| Protein name | | | | Locus Name | | Acc# |
| hypothetical protein PFB0225c | | | | pir:E71620 | | E71620 |
| Description | | | | | | |

| ORF Name | NTID | AAID | NT Length | AA Length | Score | Probability |
|---|---|---|---|---|---|---|
| 48828124_c3_10 | 3411 | 8633 | 61 | 186 | 50 | 0.0053 |
| Protein name | | | | Locus Name | | Acc# |
| translation initiation factor eIF-2 beta chain | | | | pir:T17104 | | T17104 |
| Description | | | | | | |

| ORF Name | NTID | AAID | NT Length | AA Length | Score | Probability |
|---|---|---|---|---|---|---|
| 12587876_c2_118 | 3412 | 8634 | 767 | 2304 | 195 | 2.2e−11 |
| Protein name | | | | Locus Name | | Acc# |
| 115K outer membrane protein precursor:SusC protein | | | | pir:JC6027 | | JC6027 |
| Description | | | | | | |

| ORF Name | NTID | AAID | NT Length | AA Length | Score | Probability |
|---|---|---|---|---|---|---|
| 15040927_c1_80 | 3413 | 8635 | 190 | 573 | 203 | 2.7e−16 |
| Protein name | | | | Locus Name | | Acc# |
| | | | | sp:YM67_ARCFU | | O28017 |
| Description | | | | | | |
| (EC 1.—.—.—) | | | | | | |

| ORF Name | NTID | AAID | NT Length | AA Length | Score | Probability |
|---|---|---|---|---|---|---|
| 15632927_c3_157 | 3414 | 8636 | 240 | 720 | | |
| Protein name | | | | Locus Name | | Acc# |
| Description | | | | | | |
| NO-HIT | | | | | | |

| ORF Name | NTID | AAID | NT Length | AA Length | Score | Probability |
|---|---|---|---|---|---|---|
| 20336010_f2_50 | 3415 | 8637 | 305 | 918 | 132 | 9.8e−06 |
| Protein name | | | | Locus Name | | Acc# |
| endo-1,4-beta-xylanase homolog yjeA | | | | pir:G69849 | | G69849 |
| Description | | | | | | |

-continued

| ORF Name | NTID | AAID | NT Length | AA Length | Score | Probability |
|---|---|---|---|---|---|---|
| 23615882_f2_38 | 3416 | 8638 | 671 | 2016 | 1649 | 1.6e−169 |

| Protein name | Locus Name | Acc# |
|---|---|---|
| hypothetical protein | gp:PAL243361 | AJ243361 |

Description

*Prevotella albensis* ORF1, isolate M384.

| ORF Name | NTID | AAID | NT Length | AA Length | Score | Probability |
|---|---|---|---|---|---|---|
| 23625277_f3_79 | 3417 | 8639 | 953 | 2862 | 2467 | 3.3e−256 |

| Protein name | Locus Name | Acc# |
|---|---|---|
| hypothetical protein | pir:S76257 | S76257 |

Description

| ORF Name | NTID | AAID | NT Length | AA Length | Score | Probability |
|---|---|---|---|---|---|---|
| 23712752_c1_91 | 3418 | 8640 | 737 | 2214 | 1460 | 9.0e−161 |

| Protein name | Locus Name | Acc# |
|---|---|---|
| probable copper-transporting ATPase, yvgX | pir:E70041 | E70041 |

Description

| ORF Name | NTID | AAID | NT Length | AA Length | Score | Probability |
|---|---|---|---|---|---|---|
| 24475400_f1_2 | 3419 | 8641 | 214 | 645 | 138 | 6.4e−08 |

| Protein name | Locus Name | Acc# |
|---|---|---|
| response regulator | gp:PPUY18245 | Y18245 |

Description

*Pseudomonas putida* todX, todF, todC1, todC2, todB, todA, todD, todE, todG, todI, todH, todS, todT genes.

| ORF Name | NTID | AAID | NT Length | AA Length | Score | Probability |
|---|---|---|---|---|---|---|
| 24806562_f1_6 | 3420 | 8642 | 132 | 399 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 25525416_f1_12 | 3421 | 8643 | 318 | 957 | 282 | 8.7e−24 |

| Protein name | Locus Name | Acc# |
|---|---|---|
| | sp:XYNB_BUTFI | P26223 |

Description

D-XYLAN XYLANOHYDROLASE B)

-continued

| ORF Name | NTID | AAID | NT Length | AA Length | Score | Probability |
|---|---|---|---|---|---|---|
| 25567276_c1_90 | 3422 | 8644 | 145 | 438 | 115 | 5.7e−07 |
| Protein name | | | Locus Name | | Acc# | |
| mercury reductase homolog | | | pir:I64109 | | I64109 | |
| Description | | | | | | |

| ORF Name | NTID | AAID | NT Length | AA Length | Score | Probability |
|---|---|---|---|---|---|---|
| 26281308_f1_15 | 3423 | 8645 | 106 | 321 | | |
| Protein name | | | Locus Name | | Acc# | |
| Description | | | | | | |

NO-HIT

| ORF Name | NTID | AAID | NT Length | AA Length | Score | Probability |
|---|---|---|---|---|---|---|
| 29579692_f2_39 | 3424 | 8646 | 282 | 849 | 102 | 0.023 |
| Protein name | | | Locus Name | | Acc# | |
| | | | gp:AF025396 | | AF025396 | |
| Description | | | | | | |

*Vibrio anguillarum* rfb region, partial sequence.

| ORF Name | NTID | AAID | NT Length | AA Length | Score | Probability |
|---|---|---|---|---|---|---|
| 30276381_f3_61 | 3425 | 8647 | 467 | 1404 | 259 | 2.6e−19 |
| Protein name | | | Locus Name | | Acc# | |
| | | | sp:RESE_BACSU | | P35164 | |
| Description | | | | | | |

SENSOR PROTEIN RESE,

| ORF Name | NTID | AAID | NT Length | AA Length | Score | Probability |
|---|---|---|---|---|---|---|
| 31883436_c1_93 | 3426 | 8648 | 282 | 849 | 419 | 3.5e−39 |
| Protein name | | | Locus Name | | Acc# | |
| lipoate-protein ligase B | | | gp:AF153678 | | AF153678 | |
| Description | | | | | | |

*Myxococcus xanthus* lipoic acid synthetase precursor, lipoamideacyltransferase, and lipoate-protein ligase B genes, complete cds; and unknown genes.

| ORF Name | NTID | AAID | NT Length | AA Length | Score | Probability |
|---|---|---|---|---|---|---|
| 32218816_f3_78 | 3427 | 8649 | 221 | 666 | 370 | 5.4e−34 |
| Protein name | | | Locus Name | | Acc# | |
| | | | sp:YCBL_ECOLI | | P75849 | |
| Description | | | | | | |

HYPOTHETICAL 23.8 KD PROTEIN IN MUKB-ASPC INTERGENIC REGION

-continued

| ORF Name | NTID | AAID | NT Length | AA Length | Score | Probability |
|---|---|---|---|---|---|---|
| 33603128_c1_100 | 3428 | 8650 | 129 | 390 | 135 | 4.3e−09 |

| Protein name | Locus Name | Acc# |
|---|---|---|
| hypothetical protein PH0362 | pir:G71143 | G71143 |

Description

| ORF Name | NTID | AAID | NT Length | AA Length | Score | Probability |
|---|---|---|---|---|---|---|
| 34173437_f3_68 | 3429 | 8651 | 296 | 891 | 171 | 9.1e−11 |

| Protein name | Locus Name | Acc# |
|---|---|---|
| regulatory protein | gp:AF036244 | AF036244 |

Description

*Azotobacter chroococcum* 4-hydroxybenzoate hydroxylase (pobA) gene, partial cds; and regulatory protein (pobR) gene, complete cds.

| ORF Name | NTID | AAID | NT Length | AA Length | Score | Probability |
|---|---|---|---|---|---|---|
| 3910880_f2_51 | 3430 | 8652 | 237 | 714 | 230 | 3.7e−19 |

| Protein name | Locus Name | Acc# |
|---|---|---|
|  | sp:GIDB_BACSU | P25813 |

Description

GLUCOSE INHIBITED DIVISION PROTEIN B

| ORF Name | NTID | AAID | NT Length | AA Length | Score | Probability |
|---|---|---|---|---|---|---|
| 504010_f2_44 | 3431 | 8653 | 134 | 405 | 127 | 3.1e−08 |

| Protein name | Locus Name | Acc# |
|---|---|---|
| hypothetical protein APE1455 | pir:G72624 | G72624 |

Description

| ORF Name | NTID | AAID | NT Length | AA Length | Score | Probability |
|---|---|---|---|---|---|---|
| 6351450_f2_35 | 3432 | 8654 | 338 | 1017 | 650 | 1.2e−63 |

| Protein name | Locus Name | Acc# |
|---|---|---|
| transcription regulator NtrC family | pir:C70396 | C70396 |

Description

| ORF Name | NTID | AAID | NT Length | AA Length | Score | Probability |
|---|---|---|---|---|---|---|
| 6647150_c3_138 | 3433 | 8655 | 158 | 477 | 101 | 0.0015 |

| Protein name | Locus Name | Acc# |
|---|---|---|
| chitinase IV precursor | gp:AF112966 | AF112966 |

Description

*Triticum aestivum* chitinase IV precursor (Cht4) mRNA, complete cds.

-continued

| ORF Name | NTID | AAID | NT Length | AA Length | Score | Probability |
|---|---|---|---|---|---|---|
| 10189063_f1_98 | 3434 | 8656 | 433 | 1302 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 1051942_f1_25 | 3435 | 8657 | 266 | 801 | 131 | 5.1e−06 |

| Protein name | | | | Locus Name | | Acc# |
|---|---|---|---|---|---|---|
| hypothetical protein AF2299 | | | | pir:C69537 | | C69537 |

Description

| ORF Name | NTID | AAID | NT Length | AA Length | Score | Probability |
|---|---|---|---|---|---|---|
| 10546880_c2_519 | 3436 | 8658 | 221 | 666 | 136 | 3.8e−07 |

| Protein name | | | | Locus Name | | Acc# |
|---|---|---|---|---|---|---|
| hypothetical protein PAB0790 | | | | pir:H75098 | | H75098 |

Description

| ORF Name | NTID | AAID | NT Length | AA Length | Score | Probability |
|---|---|---|---|---|---|---|
| 10586563_f2_192 | 3437 | 8659 | 304 | 915 | 90 | 0.0014 |

| Protein name | | | | Locus Name | | Acc# |
|---|---|---|---|---|---|---|
| | | | | gp:D42067 | | D42067 |

Description

*Porphyromonas gingivalis* DNA for Fimbrilin, ORF1-4, complete cds.

| ORF Name | NTID | AAID | NT Length | AA Length | Score | Probability |
|---|---|---|---|---|---|---|
| 10650701_f1_51 | 3438 | 8660 | 61 | 186 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 10665908_f1_96 | 3439 | 8661 | 302 | 909 | 81 | 0.023 |

| Protein name | | | | Locus Name | | Acc# |
|---|---|---|---|---|---|---|
| *L. lactis* predicted coding region ORF00061 | | | | gp:AE001272 | | AE001272 |

Description

*Lactococcus lactis* DPC3147 plasmid pMRC01, complete plasmid sequence.

-continued

| ORF Name | NTID | AAID | NT Length | AA Length | Score | Probability |
|---|---|---|---|---|---|---|
| 117142_c2_481 | 3440 | 8662 | 326 | 981 | 304 | 5.4e−27 |

| Protein name | Locus Name | Acc# |
|---|---|---|
| hypothetical protein | pir:S76925 | S76925 |

Description

| ORF Name | NTID | AAID | NT Length | AA Length | Score | Probability |
|---|---|---|---|---|---|---|
| 11834807_c1_346 | 3441 | 8663 | 75 | 228 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 1210252_f2_116 | 3442 | 8664 | 513 | 1542 | 1190 | 7.0e−121 |

| Protein name | Locus Name | Acc# |
|---|---|---|
| conserved hypothetical protein ymdA | pir:F69884 | F69884 |

Description

| ORF Name | NTID | AAID | NT Length | AA Length | Score | Probability |
|---|---|---|---|---|---|---|
| 12110668_c1_418 | 3443 | 8665 | 61 | 186 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 12501250_f2_154 | 3444 | 8666 | 251 | 756 | 127 | 3.1e−06 |

| Protein name | Locus Name | Acc# |
|---|---|---|
| hypothetical protein PAB1224 | pir:A70522 | A75022 |

Description

| ORF Name | NTID | AAID | NT Length | AA Length | Score | Probability |
|---|---|---|---|---|---|---|
| 1253425_f1_38 | 3445 | 8667 | 1445 | 4338 | 822 | 2.9e−79 |

| Protein name | Locus Name | Acc# |
|---|---|---|
| DNA helicase related protein | pir:H69163 | H69163 |

Description

-continued

| ORF Name | NTID | AAID | NT Length | AA Length | Score | Probability |
|---|---|---|---|---|---|---|
| 12612930_c2_546 | 3446 | 8668 | 343 | 1032 | 146 | 1.6e-07 |

| Protein name | Locus Name | Acc# |
|---|---|---|
| transmembrane sensor | gp:AF051691 | AF051691 |

Description

*Pseudomonas aeruginosa* stress factor A (psfA), ECF sigma factor (fiuI), transmembrane sensor (fiuR), and hydroxamate-typeferrisiderophore receptor (fiuA) genes, complete cds.

| ORF Name | NTID | AAID | NT Length | AA Length | Score | Probability |
|---|---|---|---|---|---|---|
| 12697702_f1_17 | 3447 | 8669 | 63 | 192 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 12770151_f2_141 | 3448 | 8670 | 289 | 870 | 128 | 1.0e-05 |

| Protein name | Locus Name | Acc# |
|---|---|---|
| hypothetical protein | gp:PST249385 | AJ249385 |

Description

*Pseudomonas stutzeri* pilT, pilU, ORF1 (partial) and ORF2 (partial) genes.

| ORF Name | NTID | AAID | NT Length | AA Length | Score | Probability |
|---|---|---|---|---|---|---|
| 1360802_f3_306 | 3449 | 8671 | 373 | 1122 | 100 | 0.030 |

| Protein name | Locus Name | Acc# |
|---|---|---|
| neurofilament protein H form H2 (repetitive region) | pir:B43427 | B43427 |

| ORF Name | NTID | AAID | NT Length | AA Length | Score | Probability |
|---|---|---|---|---|---|---|
| 13884627_f1_93 | 3450 | 8672 | 125 | 378 | 260 | 1.7e-21 |

| Protein name | Locus Name | Acc# |
|---|---|---|
| | sp:TRA2_BACFR | Q45119 |

Description

TRANSPOSASE FOR INSERTION SEQUENCE ELEMENT IS21-LIKE

| ORF Name | NTID | AAID | NT Length | AA Length | Score | Probability |
|---|---|---|---|---|---|---|
| 14344010_c1_391 | 3451 | 8673 | 303 | 912 | 610 | 2.0e-59 |

| Protein name | Locus Name | Acc# |
|---|---|---|
| probable ion transporter | pir:E75470 | E75470 |

Description

-continued

| ORF Name | NTID | AAID | NT Length | AA Length | Score | Probability |
|---|---|---|---|---|---|---|
| 14501300_f1_43 | 3452 | 8674 | 149 | 450 | 71 | 0.040 |

| Protein name | | Locus Name | Acc# |
|---|---|---|---|
| | | sp:TXMA_DENPO | P80494 |

Description

MUSCARINIC TOXIN ALPHA (MT-ALPHA)

| ORF Name | NTID | AAID | NT Length | AA Length | Score | Probability |
|---|---|---|---|---|---|---|
| 14730202_c3_613 | 3453 | 8675 | 88 | 267 | 99 | 9.4e−05 |

| Protein name | Locus Name | Acc# |
|---|---|---|
| hypothetical protein F13D12.3 | pir:T20831 | T20831 |

Description

| ORF Name | NTID | AAID | NT Length | AA Length | Score | Probability |
|---|---|---|---|---|---|---|
| 14955312_c1_369 | 3454 | 8676 | 68 | 207 | 78 | 0.012 |

| Protein name | Locus Name | Acc# |
|---|---|---|
| | sp:H5_CHICK | P02259 |

Description

HISTONE H5

| ORF Name | NTID | AAID | NT Length | AA Length | Score | Probability |
|---|---|---|---|---|---|---|
| 15105287_f2_174 | 3455 | 8677 | 85 | 258 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 16225407_f1_97 | 3456 | 8678 | 138 | 417 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 16407262_f3_222 | 3457 | 8679 | 164 | 495 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 16517037_f2_194 | 3458 | 8680 | 61 | 186 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 16525383_f1_99 | 3459 | 8681 | 119 | 360 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 16923417_f3_221 | 3460 | 8682 | 63 | 192 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 189032_f2_161 | 3461 | 8683 | 450 | 1353 | 1085 | 9.3e−110 |

| Protein name | | | | Locus Name | | Acc# |
|---|---|---|---|---|---|---|
| O-acetylhomoserine sulfhydrylase | | | | pir:D72324 | | D72324 |

Description

| ORF Name | NTID | AAID | NT Length | AA Length | Score | Probability |
|---|---|---|---|---|---|---|
| 196062_c1_399 | 3462 | 8684 | 227 | 684 | 378 | 7.7e−35 |

| Protein name | | | | Locus Name | | Acc# |
|---|---|---|---|---|---|---|
| | | | | sp:YHID_ECOLI | | P26606 |

Description

HYPOTHETICAL 23.2 KD PROTEIN IN SLP-HDEB INTERGENIC REGION (ORF-C)

| ORF Name | NTID | AAID | NT Length | AA Length | Score | Probability |
|---|---|---|---|---|---|---|
| 1992011_c1_367 | 3463 | 8685 | 91 | 276 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 20047683_f3_225 | 3464 | 8686 | 478 | 1437 | 772 | 1.4e−76 |

| Protein name | | | | Locus Name | | Acc# |
|---|---|---|---|---|---|---|
| | | | | sp:YKGF_ECOLI | | P77536 |

Description

HYPOTHETICAL 53.1 KD PROTEIN IN EAEH-BETA INTERGENIC REGION

| ORF Name | NTID | AAID | NT Length | AA Length | Score | Probability |
|---|---|---|---|---|---|---|
| 20712687_c3_604 | 3465 | 8687 | 95 | 288 | 75 | 0.047 |

| Protein name | | | | Locus Name | | Acc# |
|---|---|---|---|---|---|---|
| hypothetical protein aq_1680 | | | | pir:F70445 | | F70445 |

Description

| ORF Name | NTID | AAID | NT Length | AA Length | Score | Probability |
|---|---|---|---|---|---|---|
| 21534653_c3_651 | 3466 | 8688 | 150 | 453 | 79 | 0.0047 |

| Protein name | | | | Locus Name | | Acc# |
|---|---|---|---|---|---|---|
| hypothetical protein Rv0603 | | | | pir:F70909 | | F70909 |

Description

| ORF Name | NTID | AAID | NT Length | AA Length | Score | Probability |
|---|---|---|---|---|---|---|
| 21995337_c2_469 | 3467 | 8689 | 543 | 1632 | 227 | 5.5e−18 |

| Protein name | | | | Locus Name | | Acc# |
|---|---|---|---|---|---|---|
| hypothetical protein PH0142 | | | | pir:D71235 | | D71235 |

Description

| ORF Name | NTID | AAID | NT Length | AA Length | Score | Probability |
|---|---|---|---|---|---|---|
| 22052177_c3_568 | 3468 | 8690 | 300 | 903 | 90 | 0.0014 |

| Protein name | | | | Locus Name | | Acc# |
|---|---|---|---|---|---|---|
| | | | | sp:PQRA_PROVU | | Q52620 |

Description

REGULATORY PROTEIN PQRA

| ORF Name | NTID | AAID | NT Length | AA Length | Score | Probability |
|---|---|---|---|---|---|---|
| 22548450_f2_172 | 3469 | 8691 | 63 | 192 | | |

| Protein name | | | | Locus Name | | Acc# |
|---|---|---|---|---|---|---|

Description

NO-HIT

-continued

| ORF Name | NTID | AAID | NT Length | AA Length | Score | Probability |
|---|---|---|---|---|---|---|
| 23445887_f2_152 | 3470 | 8692 | 281 | 846 | 107 | 0.0025 |

| Protein name | Locus Name | Acc# |
|---|---|---|
| sensory transduction histidine kinase sll1475:protein sll1475:protein sll1475 | pir:S76818 | S76818 |

Description

| ORF Name | NTID | AAID | NT Length | AA Length | Score | Probability |
|---|---|---|---|---|---|---|
| 23476512_c1_344 | 3471 | 8693 | 519 | 1560 | 1712 | 3.4e−176 |

| Protein name | Locus Name | Acc# |
|---|---|---|
| propionyl-CoA carboxylase | gp:AB007000 | AB007000 |

Description

*Myxococcus xanthus* MxppcB gene for propionyl-CoA carboxylase, complete cds.

| ORF Name | NTID | AAID | NT Length | AA Length | Score | Probability |
|---|---|---|---|---|---|---|
| 23635902_c1_445 | 3472 | 8694 | 351 | 1056 | 94 | 0.038 |

| Protein name | Locus Name | Acc# |
|---|---|---|
| ORF188 | gp:AB000109 | AB000109 |

Description

*Dictyostelium discoideum* mitochondrial DNA, complete sequence.

| ORF Name | NTID | AAID | NT Length | AA Length | Score | Probability |
|---|---|---|---|---|---|---|
| 23838137_c2_547 | 3473 | 8695 | 1094 | 3285 | 300 | 1.0e−47 |

| Protein name | Locus Name | Acc# |
|---|---|---|
| receptor antigen (RagA) | gp:PGI130872 | AJ130872 |

Description

*Porphyromonas gingivalis* W50 receptor antigen (rag) locus encoding a major immunodominant 55 kDa antigen.

| ORF Name | NTID | AAID | NT Length | AA Length | Score | Probability |
|---|---|---|---|---|---|---|
| 241542_f1_86 | 3474 | 8696 | 98 | 297 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24219077_c1_439 | 3475 | 8697 | 179 | 540 | 404 | 1.4e−37 |

| Protein name | Locus Name | Acc# |
|---|---|---|
| RNA polymerase sigma factor SigZ-like protein | gp:AF137263 | AF137263 |

Description

*Bacteroides thetaiotaomicron* 30S ribosomal protein S16-like protein, fucose gene cluster, and RNA polymerase sigma factor SigZ-like protein (sigZ) genes, complete cds.

-continued

| ORF Name | NTID | AAID | NT Length | AA Length | Score | Probability |
|---|---|---|---|---|---|---|
| 24225006_c3_666 | 3476 | 8698 | 769 | 2310 | 1773 | 1.2e−182 |

| Protein name | Locus Name | Acc# |
|---|---|---|
| hypothetical protein b2463 | pir:F65021 | F65021 |

Description

| ORF Name | NTID | AAID | NT Length | AA Length | Score | Probability |
|---|---|---|---|---|---|---|
| 24225326_f2_189 | 3477 | 8699 | 317 | 954 | 122 | 7.2e−06 |

| Protein name | Locus Name | Acc# |
|---|---|---|
| | sp:EXSA_PSEAE | P26993 |

Description

EXOENZYME S SYNTHESIS REGULATORY PROTEIN EXSA

| ORF Name | NTID | AAID | NT Length | AA Length | Score | Probability |
|---|---|---|---|---|---|---|
| 24255332_f1_87 | 3478 | 8700 | 770 | 2313 | 504 | 8.9e−48 |

| Protein name | Locus Name | Acc# |
|---|---|---|
| | sp:YBAL_ECOLI | |

Description

HYPOTHETICAL 59.4 KD PROTEIN IN GSK-FSR INTERGENIC REGION

| ORF Name | NTID | AAID | NT Length | AA Length | Score | Probability |
|---|---|---|---|---|---|---|
| 24258385_c1_412 | 3479 | 8701 | 121 | 366 | 285 | 5.5e−25 |

| Protein name | Locus Name | Acc# |
|---|---|---|
| arsenate reductase homolog yusI | pir:B70021 | B70021 |

Description

| ORF Name | NTID | AAID | NT Length | AA Length | Score | Probability |
|---|---|---|---|---|---|---|
| 24260885_c3_570 | 3480 | 8702 | 68 | 207 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24328338_c1_444 | 3481 | 8703 | 277 | 834 | 110 | 0.00067 |

| Protein name | Locus Name | Acc# |
|---|---|---|
| | sp:EBA2_FLAME | P36912 |

Description (ENDOGLYCOSIDASE F2)

-continued

| ORF Name | NTID | AAID | NT Length | AA Length | Score | Probability |
|---|---|---|---|---|---|---|
| 24407150_f2_170 | 3482 | 8704 | 296 | 891 | 157 | 4.0e-09 |

| Protein name | Locus Name | Acc# |
|---|---|---|
| pobR regulator | gp:PSEY18527 | Y18527 |

Description

*Pseudomonas* sp. pobA, pobR, pcaQ, pcaH and pcaG genes.

| ORF Name | NTID | AAID | NT Length | AA Length | Score | Probability |
|---|---|---|---|---|---|---|
| 24413137_f2_118 | 3483 | 8705 | 194 | 585 | 122 | 2.0e-12 |

| Protein name | Locus Name | Acc# |
|---|---|---|
|  | sp:PFS_BACSU | O32028 |

Description

| ORF Name | NTID | AAID | NT Length | AA Length | Score | Probability |
|---|---|---|---|---|---|---|
| 24414711_c1_333 | 3484 | 8706 | 394 | 1185 | 521 | 5.4e-50 |

| Protein name | Locus Name | Acc# |
|---|---|---|
|  | sp:PNCB_ECOLI | P18133 |

Description

NICOTINATE PHOSPHORIBOSYLTRANSFERASE, (NAPRTASE)

| ORF Name | NTID | AAID | NT Length | AA Length | Score | Probability |
|---|---|---|---|---|---|---|
| 24417062_f3_291 | 3485 | 8707 | 228 | 687 | 124 | 2.3e-06 |

| Protein name | Locus Name | Acc# |
|---|---|---|
| isochorismatase homolog ywoC | pir:F70064 | F70064 |

Description

| ORF Name | NTID | AAID | NT Length | AA Length | Score | Probability |
|---|---|---|---|---|---|---|
| 24494000_f1_20 | 3486 | 8708 | 182 | 549 | 251 | 2.2e-21 |

| Protein name | Locus Name | Acc# |
|---|---|---|
|  | sp:YGCF_HAEIN | P45097 |

Description

HYPOTHETICAL PROTEIN HI1189

| ORF Name | NTID | AAID | NT Length | AA Length | Score | Probability |
|---|---|---|---|---|---|---|
| 24633462_c3_630 | 3487 | 8709 | 366 | 1101 | 971 | 1.1E-97 |

| Protein name | Locus Name | Acc# |
|---|---|---|
|  | sp:YE55_HAEIN | P45213 |

Description

HYPOTHETICAL PROTEIN HI1455

-continued

| ORF Name | NTID | AAID | NT Length | AA Length | Score | Probability |
|---|---|---|---|---|---|---|
| 24640885_f1_21 | 3488 | 8710 | 248 | 747 | 488 | 1.7e−46 |

| Protein name | Locus Name | Acc# |
|---|---|---|
| hypothetical protein SCF43A.05 | pir:T36428 | T36428 |

Description

| ORF Name | NTID | AAID | NT Length | AA Length | Score | Probability |
|---|---|---|---|---|---|---|
| 24641512_f2_187 | 3489 | 8711 | 405 | 1218 | 132 | 6.1e−08 |

| Protein name | Locus Name | Acc# |
|---|---|---|
| | gp:YP102KB | AL031866 |

Description

*Yersinia pestis* 102 kbases unstable region: from 1 to 119443.

| ORF Name | NTID | AAID | NT Length | AA Length | Score | Probability |
|---|---|---|---|---|---|---|
| 24645932_c2_477 | 3490 | 8712 | 477 | 1434 | 511 | 6.2e−49 |

| Protein name | Locus Name | Acc# |
|---|---|---|
| | sp:YLCB_ECOLI | P77211 |

Description

PRECURSOR

| ORF Name | NTID | AAID | NT Length | AA Length | Score | Probability |
|---|---|---|---|---|---|---|
| 24648387_f3_234 | 3491 | 8713 | 320 | 963 | 578 | 4.9e−56 |

| Protein name | Locus Name | Acc# |
|---|---|---|
| | sp:YNBB_ECOLI | |

Description

HYPOTHETICAL 33.1 KD PROTEIN IN MAOC-ACPD INTERGENIC REGION

| ORF Name | NTID | AAID | NT Length | AA Length | Score | Probability |
|---|---|---|---|---|---|---|
| 24650187_f2_131 | 3492 | 8714 | 443 | 1332 | 1119 | 2.3e−113 |

| Protein name | Locus Name | Acc# |
|---|---|---|
| | sp:YICE_ECOLI | P27432 |

Description

HYPOTHETICAL 48.9 KD PROTEIN IN GLTS-SELC INTERGENIC REGION

| ORF Name | NTID | AAID | NT Length | AA Length | Score | Probability |
|---|---|---|---|---|---|---|
| 24806512_f2_117 | 3493 | 8715 | 252 | 759 | 569 | 4.4e−55 |

| Protein name | Locus Name | Acc# |
|---|---|---|
| CGI-32 protein | gp:AF132966 | AF132966 |

Description

*Homo sapiens* CGI-32 protein mRNA, complete cds.

-continued

| ORF Name | NTID | AAID | NT Length | AA Length | Score | Probability |
|---|---|---|---|---|---|---|
| 24870957_f2_200 | 3494 | 8716 | 291 | 876 | 104 | 0.0042 |

| Protein name | Locus Name | Acc# |
|---|---|---|
| | sp:VG77_BPML5 | Q05292 |

Description

GENE 77 PROTEIN (GP77)

| ORF Name | NTID | AAID | NT Length | AA Length | Score | Probability |
|---|---|---|---|---|---|---|
| 24897892_f2_120 | 3495 | 8717 | 200 | 603 | 119 | 1.2e−05 |

| Protein name | Locus Name | Acc# |
|---|---|---|
| hypothetical protein HP0137 | pir:A64537 | A64537 |

Description

| ORF Name | NTID | AAID | NT Length | AA Length | Score | Probability |
|---|---|---|---|---|---|---|
| 25422952_f1_94 | 3496 | 8718 | 165 | 498 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 26257687_f3_254 | 3497 | 8719 | 505 | 1518 | 107 | 0.0052 |

| Protein name | Locus Name | Acc# |
|---|---|---|
| fibroin heavy chain PG-2' | pir:B61615 | B61615 |

Description

| ORF Name | NTID | AAID | NT Length | AA Length | Score | Probability |
|---|---|---|---|---|---|---|
| 26260191_c1_421 | 3498 | 8720 | 60 | 183 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 26287817_f2_146 | 3499 | 8721 | 78 | 237 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 26369387_f3_244 | 3500 | 8722 | 128 | 387 | 83 | 0.013 |

| Protein name | Locus Name | Acc# |
|---|---|---|
| putative integral membrane protein | gp:SC51A | AL121596 |

Description

*Streptomyces coelicolor* cosmid 51A.

| ORF Name | NTID | AAID | NT Length | AA Length | Score | Probability |
|---|---|---|---|---|---|---|
| 26439037_c1_370 | 3501 | 8723 | 80 | 243 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 26815936_f1_60 | 3502 | 8724 | 373 | 1122 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 26853838_f2_114 | 3503 | 8725 | 138 | 417 | 93 | 0.00012 |

| Protein name | Locus Name | Acc# |
|---|---|---|
| vacuolar type ATP synthase subunit | gp:D63799 | D63799 |

Description

*Thermus thermophilus* genes, Operon or Vacuolar type ATP syntase subunit, complete cds.

| ORF Name | NTID | AAID | NT Length | AA Length | Score | Probability |
|---|---|---|---|---|---|---|
| 2931593_f2_126 | 3504 | 8726 | 390 | 1173 | 202 | 9.2e−13 |

| Protein name | Locus Name | Acc# |
|---|---|---|
| 115K outer membrane protein precursor:SusC protein | pir:JC6027 | JC6027 |

Description

| ORF Name | NTID | AAID | NT Length | AA Length | Score | Probability |
|---|---|---|---|---|---|---|
| 29390682_f2_140 | 3505 | 8727 | 311 | 936 | 117 | 0.00023 |

| Protein name | Locus Name | Acc# |
|---|---|---|
| unknown | gp:AF175293 | AF175293 |

Description

*Enterococcus faecium* strain N97-330 vanD glycopeptide resistance gene cluster, complete cds; and unknown gene.

-continued

| ORF Name | NTID | AAID | NT Length | AA Length | Score | Probability |
|---|---|---|---|---|---|---|
| 29486512_f1_49 | 3506 | 8728 | 552 | 1659 | 360 | 1.2e−32 |
| Protein name | | | Locus Name | | | Acc# |
| cation efflux system protein | | | pir:C71831 | | | C71831 |
| Description | | | | | | |

| ORF Name | NTID | AAID | NT Length | AA Length | Score | Probability |
|---|---|---|---|---|---|---|
| 30275287_c3_674 | 3507 | 8729 | 394 | 1185 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 30351687_f1_76 | 3508 | 8730 | 511 | 1536 | 1766 | 6.4e−182 |
| Protein name | | | Locus Name | | | Acc# |
| | | | sp:IMDH_TRIFO | | | P50097 |
| Description | | | | | | |

DEHYDROGENASE) (IMPDH) (IMPD)

| ORF Name | NTID | AAID | NT Length | AA Length | Score | Probability |
|---|---|---|---|---|---|---|
| 30470408_f2_171 | 3509 | 8731 | 110 | 333 | 196 | 1.5e−15 |
| Protein name | | | Locus Name | | | Acc# |
| hypothetical protein SC5F2A.08c | | | pir:T35250 | | | T35250 |
| Description | | | | | | |

| ORF Name | NTID | AAID | NT Length | AA Length | Score | Probability |
|---|---|---|---|---|---|---|
| 31914013_f1_36 | 3510 | 8732 | 435 | 1308 | 544 | 2.0e−52 |
| Protein name | | | Locus Name | | | Acc# |
| hypothetical protein MTH1458 | | | pir:B69061 | | | B69061 |
| Description | | | | | | |

| ORF Name | NTID | AAID | NT Length | AA Length | Score | Probability |
|---|---|---|---|---|---|---|
| 32110150_c1_438 | 3511 | 8733 | 82 | 249 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 32422050_f2_130 | 3512 | 8734 | 246 | 741 | | |
| Protein name | | | Locus Name | | | Acc# |
| Description | | | | | | |

NO-HIT

-continued

| ORF Name | NTID | AAID | NT Length | AA Length | Score | Probability |
|---|---|---|---|---|---|---|
| 32507687_c3_639 | 3513 | 8735 | 703 | 2112 | 196 | 1.0e−26 |

| Protein name | Locus Name | Acc# |
|---|---|---|
| | sp:Y634_METJA | Q58051 |

Description

HYPOTHETICAL PROTEIN MJ0634

| ORF Name | NTID | AAID | NT Length | AA Length | Score | Probability |
|---|---|---|---|---|---|---|
| 33600625_c1_426 | 3514 | 8736 | 134 | 405 | 217 | 8.9e−18 |

| Protein name | Locus Name | Acc# |
|---|---|---|
| | sp:YBAN_ECOLI | |

Description

HYPOTHETICAL 14.8 KD PROTEIN IN PRIC-APT INTERGENIC REGION

| ORF Name | NTID | AAID | NT Length | AA Length | Score | Probability |
|---|---|---|---|---|---|---|
| 33767187_f2_191 | 3515 | 8737 | 404 | 1215 | 96 | 0.016 |

| Protein name | Locus Name | Acc# |
|---|---|---|
| probable glycine-rich secreted protein | pir:T36291 | T36291 |

Description

| ORF Name | NTID | AAID | NT Length | AA Length | Score | Probability |
|---|---|---|---|---|---|---|
| 33789067_c2_486 | 3516 | 8738 | 777 | 2334 | 95 | 4.6e−06 |

| Protein name | Locus Name | Acc# |
|---|---|---|
| conserved hypothetical protein AF1017 | pir:A69377 | A69377 |

Description

| ORF Name | NTID | AAID | NT Length | AA Length | Score | Probability |
|---|---|---|---|---|---|---|
| 33875826_c3_609 | 3517 | 8739 | 316 | 951 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 34173188_c3_577 | 3518 | 8740 | 170 | 513 | 149 | 1.4e−14 |

| Protein name | Locus Name | Acc# |
|---|---|---|
| methylmalonyl-coa decarboxylase gamma chain PAB1771 | pir:F75135 | F75135 |

Description

-continued

| ORF Name | NTID | AAID | NT Length | AA Length | Score | Probability |
|---|---|---|---|---|---|---|
| 34179812_c1_436 | 3519 | 8741 | 449 | 1350 | 2234 | 1.6e−231 |

| Protein name | | | | Locus Name | | Acc# |
|---|---|---|---|---|---|---|
| | | | | sp:DHE4_BACTN | | P94598 |

Description (NAD(P)H-DEPENDENT GLUTAMATE DEHYDROGENASE)

| ORF Name | NTID | AAID | NT Length | AA Length | Score | Probability |
|---|---|---|---|---|---|---|
| 34254662_c2_488 | 3520 | 8742 | 294 | 885 | 129 | 1.2e−05 |

| Protein name | | | | Locus Name | | Acc# |
|---|---|---|---|---|---|---|
| microfilarial sheath protein SHP3 | | | | gp:LSU54556 | | U54556 |

Description

*Litomosoides sigmodontis* microfilarial sheath protein SHP3a (shp3a) and microfilarial sheath protein SHP3 (shp3) genes, complete cds.

| ORF Name | NTID | AAID | NT Length | AA Length | Score | Probability |
|---|---|---|---|---|---|---|
| 34495216_c1_355 | 3521 | 8743 | 936 | 2811 | 1593 | 1.4e−163 |

| Protein name | | | | Locus Name | | Acc# |
|---|---|---|---|---|---|---|
| acriflavin resistance protein acrF:protein slr2131:protein slr2131 | | | | pir:S75508 | | S75508 |

Description

| ORF Name | NTID | AAID | NT Length | AA Length | Score | Probability |
|---|---|---|---|---|---|---|
| 36132761_f2_115 | 3522 | 8744 | 102 | 309 | 83 | 0.0014 |

| Protein name | | | | Locus Name | | Acc# |
|---|---|---|---|---|---|---|
| | | | | sp:YGFE_ECOLI | | P45580 |

Description

HYPOTHETICAL 12.6 KD PROTEIN IN PEPP-SSR INTERGENIC REGION (O109)

| ORF Name | NTID | AAID | NT Length | AA Length | Score | Probability |
|---|---|---|---|---|---|---|
| 36445812_c3_605 | 3523 | 8745 | 185 | 558 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 36525343_f3_309 | 3524 | 8746 | 96 | 291 | | |

| Protein name | | | | Locus Name | | Acc# |
|---|---|---|---|---|---|---|

Description

NO-HIT

-continued

| ORF Name | NTID | AAID | NT Length | AA Length | Score | Probability |
|---|---|---|---|---|---|---|
| 3928885_c1_354 | 3525 | 8747 | 142 | 429 | 336 | 3.7e−29 |

| Protein name | Locus Name | Acc# |
|---|---|---|
| CeoB | gp:BCU97042 | U97042 |

Description

*Burkholderia cepacia* CeoA (ceoA) and CeoB (ceoB) genes, complete cds.

| ORF Name | NTID | AAID | NT Length | AA Length | Score | Probability |
|---|---|---|---|---|---|---|
| 3946052_c3_586 | 3526 | 8748 | 374 | 1125 | 392 | 2.5e−36 |

| Protein name | Locus Name | Acc# |
|---|---|---|
| SmeA | gp:AF173226 | AF173226 |

Description

*Stenotrophomonas maltophilia* multidrug efflux system SmeR (smeR), SmeS (smeS), SmeA (smeA), SmeB (smeB), and SmeC (smeC) genes, complete cds.

| ORF Name | NTID | AAID | NT Length | AA Length | Score | Probability |
|---|---|---|---|---|---|---|
| 3949052_f1_35 | 3527 | 8749 | 61 | 186 | 95 | 7.5e−05 |

| Protein name | Locus Name | Acc# |
|---|---|---|
| histone H1-like protein | pir:JH0658 | JH0658 |

Description

| ORF Name | NTID | AAID | NT Length | AA Length | Score | Probability |
|---|---|---|---|---|---|---|
| 3961641_f3_308 | 3528 | 8750 | 226 | 681 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 4064375_f2_190 | 3529 | 8751 | 411 | 1236 | 157 | 2.4e−08 |

| Protein name | Locus Name | Acc# |
|---|---|---|
| transposase | gp:AF038866 | AF038866 |

Description

*Bacteroides fragilis* transposon Tn5520 transposase (bipH) and mobilization protein BmpH (bmpH) genes, complete cds.

| ORF Name | NTID | AAID | NT Length | AA Length | Score | Probability |
|---|---|---|---|---|---|---|
| 4100342_f2_193 | 3530 | 8752 | 65 | 198 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 4100917_c2_537 | 3531 | 8753 | 393 | 1182 | 144 | 8.7e−14 |

| Protein name | | | | Locus Name | | Acc# |
|---|---|---|---|---|---|---|
| hypothetical protein RP338 | | | | pir:D71690 | | D71690 |

Description

| ORF Name | NTID | AAID | NT Length | AA Length | Score | Probability |
|---|---|---|---|---|---|---|
| 4103438_c2_465 | 3532 | 8754 | 507 | 1524 | 1314 | 5.0e−134 |

| Protein name | | | | Locus Name | | Acc# |
|---|---|---|---|---|---|---|
| | | | | sp:ACCC_METJA | | Q58626 |

Description

CARBOXYLASE,) (ACC)

| ORF Name | NTID | AAID | NT Length | AA Length | Score | Probability |
|---|---|---|---|---|---|---|
| 4105152_c3_583 | 3533 | 8755 | 110 | 333 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 4115925_c1_405 | 3534 | 8756 | 462 | 1389 | 1234 | 1.5e−125 |

| Protein name | | | | Locus Name | | Acc# |
|---|---|---|---|---|---|---|
| | | | | sp:ALST_BACSU | | Q45068 |

Description

AMINO ACID CARRIER PROTEIN ALST

| ORF Name | NTID | AAID | NT Length | AA Length | Score | Probability |
|---|---|---|---|---|---|---|
| 4116561_c2_485 | 3535 | 8757 | 63 | 192 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 4144005_f1_44 | 3536 | 8758 | 1255 | 3768 | 957 | 2.8e−173 |

| Protein name | | | | Locus Name | | Acc# |
|---|---|---|---|---|---|---|
| cation efflux system (AcrB/AcrD/AcrF family) | | | | pir:G70396 | | G70396 |

Description

-continued

| ORF Name | NTID | AAID | NT Length | AA Length | Score | Probability |
|---|---|---|---|---|---|---|
| 4151510_f3_226 | 3537 | 8759 | 293 | 882 | 414 | 1.2e−38 |

| Protein name | Locus Name | Acc# |
|---|---|---|
| pyridoxal kinase (pdxK) homolog | pir:G70195 | G70195 |

Description

| ORF Name | NTID | AAID | NT Length | AA Length | Score | Probability |
|---|---|---|---|---|---|---|
| 422962_c1_361 | 3538 | 8760 | 377 | 1134 | 145 | 1.0e−06 |

| Protein name | Locus Name | Acc# |
|---|---|---|
| N-acetylmuramoyl-alanine amidase homolog | pir:H70177 | H70177 |

Description

| ORF Name | NTID | AAID | NT Length | AA Length | Score | Probability |
|---|---|---|---|---|---|---|
| 4337540_f1_57 | 3539 | 8761 | 106 | 321 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4345932_c1_331 | 3540 | 8762 | 62 | 189 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4494016_c2_501 | 3541 | 8763 | 348 | 1047 | 308 | 2.0e−27 |

| Protein name | Locus Name | Acc# |
|---|---|---|
| conserved hypothetical protein aq_1420 | pir:D70423 | D70423 |

Description

| ORF Name | NTID | AAID | NT Length | AA Length | Score | Probability |
|---|---|---|---|---|---|---|
| 4509682_c2_524 | 3542 | 8764 | 197 | 594 | 136 | 3.4e−09 |

| Protein name | Locus Name | Acc# |
|---|---|---|
| unknown | gp:AF088897 | |

Description

*Zymomonas mobilis* cosmid clone 65G3, partial sequence.

| ORF Name | NTID | AAID | NT Length | AA Length | Score | Probability |
|---|---|---|---|---|---|---|
| 4572126_c2_520 | 3543 | 8765 | 213 | 642 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4725056_f3_224 | 3544 | 8766 | 117 | 354 | 176 | 2.0e-13 |

| Protein name | | Locus Name | | Acc# |
|---|---|---|---|---|
| conserved hypothetical protein aq_853 | | pir:A70374 | | A70374 |

Description

| ORF Name | NTID | AAID | NT Length | AA Length | Score | Probability |
|---|---|---|---|---|---|---|
| 506502_c1_443 | 3545 | 8767 | 551 | 1656 | | |

| Protein name | | Locus Name | | Acc# |
|---|---|---|---|---|
| | | | | |

Description

NO-HIT

| ORF Name | NTID | AAID | NT Length | AA Length | Score | Probability |
|---|---|---|---|---|---|---|
| 5273588_f3_235 | 3546 | 8768 | 226 | 681 | 142 | 1.4e-08 |

| Protein name | | Locus Name | | Acc# |
|---|---|---|---|---|
| 2-acylglycerophosphoethanolamine acyltransferase | | pir:E70476 | | E70476 |

Description

| ORF Name | NTID | AAID | NT Length | AA Length | Score | Probability |
|---|---|---|---|---|---|---|
| 5937505_c1_345 | 3547 | 8769 | 76 | 231 | | |

| Protein name | | Locus Name | | Acc# |
|---|---|---|---|---|
| | | | | |

Description

NO-HIT

| ORF Name | NTID | AAID | NT Length | AA Length | Score | Probability |
|---|---|---|---|---|---|---|
| 594753_f3_245 | 3548 | 8770 | 532 | 1599 | 552 | 3.4e-52 |

| Protein name | | Locus Name | | Acc# |
|---|---|---|---|---|
| DNA helicase related protein | | pir:H69163 | | H69163 |

Description

| ORF Name | NTID | AAID | NT Length | AA Length | Score | Probability |
|---|---|---|---|---|---|---|
| 6145427_f2_186 | 3549 | 8771 | 69 | 210 | | |

| Protein name | | Locus Name | | Acc# |
|---|---|---|---|---|
| | | | | |

Description

NO-HIT

-continued

| ORF Name | NTID | AAID | NT Length | AA Length | Score | Probability |
|---|---|---|---|---|---|---|
| 6845262_c2_527 | 3550 | 8772 | 614 | 1845 | 1053 | 2.3e−106 |

| Protein name | Locus Name | Acc# |
|---|---|---|
| | sp:YFBK_ECOLI | P76481 |

Description

HYPOTHETICAL 63.6 KD PROTEIN IN ELAD-NUON INTERGENIC REGION

| ORF Name | NTID | AAID | NT Length | AA Length | Score | Probability |
|---|---|---|---|---|---|---|
| 7034587_f3_305 | 3551 | 8773 | 104 | 315 | 81 | 0.0058 |

| Protein name | Locus Name | Acc# |
|---|---|---|
| | sp:ZN90_HUMAN | Q03938 |

Description

ZINC FINGER PROTEIN 90 (ZINC FINGER PROTEIN HTF9) (FRAGMENT)

| ORF Name | NTID | AAID | NT Length | AA Length | Score | Probability |
|---|---|---|---|---|---|---|
| 9452_f3_236 | 3552 | 8774 | 191 | 576 | 174 | 3.2e−13 |

| Protein name | Locus Name | Acc# |
|---|---|---|
| | sp:RPSH_PSEAE | Q06198 |

Description

RNA POLYMERASE SIGMA-H FACTOR (SIGMA-30)

| ORF Name | NTID | AAID | NT Length | AA Length | Score | Probability |
|---|---|---|---|---|---|---|
| 10238542_c3_212 | 3553 | 8775 | 107 | 324 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 11744515_f2_54 | 3554 | 8776 | 577 | 1734 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 1270751_c2_173 | 3555 | 8777 | 64 | 195 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 13675401_c3_218 | 3556 | 8778 | 161 | 486 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 13875343_f1_29 | 3557 | 8779 | 400 | 1203 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 156662_f3_62 | 3558 | 8780 | 107 | 324 | 201 | 4.4e−16 |

| Protein name | | | | Locus Name | | Acc# |
|---|---|---|---|---|---|---|
| | | | | sp:DBH_BACST | | |

Description

DNA-BINDING PROTEIN II (HB) (HU)

| ORF Name | NTID | AAID | NT Length | AA Length | Score | Probability |
|---|---|---|---|---|---|---|
| 18891_f3_74 | 3559 | 8781 | 612 | 1839 | 1158 | 1.7e−117 |

| Protein name | | | | Locus Name | | Acc# |
|---|---|---|---|---|---|---|
| | | | | sp:SYR_TREPA | | O83803 |

Description

ARGINYL-TRNA SYNTHETASE, (ARGININE--TRNA LIGASE) (ARGRS)

| ORF Name | NTID | AAID | NT Length | AA Length | Score | Probability |
|---|---|---|---|---|---|---|
| 19633590_f3_94 | 3560 | 8782 | 450 | 1353 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 20360282_c1_111 | 3561 | 8783 | 68 | 207 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 22853411_c1_127 | 3562 | 8784 | 366 | 1101 | 75 | 0.037 |

| Protein name | Locus Name | Acc# |
|---|---|---|
| hypothetical protein SC6E10.19c | pir:T35506 | T35506 |

Description

| ORF Name | NTID | AAID | NT Length | AA Length | Score | Probability |
|---|---|---|---|---|---|---|
| 23555312_c2_169 | 3563 | 8785 | 85 | 258 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 23625188_f1_34 | 3564 | 8786 | 608 | 1827 | 1638 | 2.3e−168 |

| Protein name | Locus Name | Acc# |
|---|---|---|
| hemolysin erythrocyte lysis protein 2 | gp:AF052516 | AF052516 |

Description

*Prevotella intermedia* hemolysin hemolytic protein, hemolysinerythrocyte lysis protein 1, and hemolysin erythrocyte lysisprotein 2 genes, complete cds.

| ORF Name | NTID | AAID | NT Length | AA Length | Score | Probability |
|---|---|---|---|---|---|---|
| 2364687_c2_175 | 3565 | 8787 | 154 | 465 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 23710877_c2_174 | 3566 | 8788 | 1011 | 3036 | 942 | 1.3e−94 |

| Protein name | Locus Name | Acc# |
|---|---|---|
| protein-export membrane protein | gp:AB022865 | AB022865 |

Description

*Prevotella ruminicola* genes for polygalacturonase, xylosidase, protein-export membrane protein, complete cds.

| ORF Name | NTID | AAID | NT Length | AA Length | Score | Probability |
|---|---|---|---|---|---|---|
| 23925627_c3_195 | 3567 | 8789 | 82 | 249 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 24023500_f1_33 | 3568 | 8790 | 493 | 1482 | 193 | 5.2e−13 |

| Protein name | Locus Name | Acc# |
|---|---|---|
| | sp:Y907_METJA | Q58317 |

Description

HYPOTHETICAL PROTEIN MJ0907

| ORF Name | NTID | AAID | NT Length | AA Length | Score | Probability |
|---|---|---|---|---|---|---|
| 24298390_f2_56 | 3569 | 8791 | 126 | 381 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24398412_c3_207 | 3570 | 8792 | 334 | 1005 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24415877_c1_119 | 3571 | 8793 | 1003 | 3012 | 152 | 2.2e−07 |

| Protein name | Locus Name | Acc# |
|---|---|---|
| conserved hypothetical protein aq_1896 | pir:E70463 | E70463 |

Description

*Zymomonas mobilis* fosmid clone 42C11, complete sequence.

| ORF Name | NTID | AAID | NT Length | AA Length | Score | Probability |
|---|---|---|---|---|---|---|
| 24429643_c3_206 | 3572 | 8794 | 801 | 2406 | 1069 | 2.5e−141 |

| Protein name | Locus Name | Acc# |
|---|---|---|
| topoisomerase I | gp:AF088896 | AF088896 |

Description

*Zymomonas mobilis* fosmid clone 42C11, complete sequence.

| ORF Name | NTID | AAID | NT Length | AA Length | Score | Probability |
|---|---|---|---|---|---|---|
| 24642836_c1_120 | 3573 | 8795 | 569 | 1710 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 24650377_f1_31 | 3574 | 8796 | 436 | 1311 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 24650377_f2_57 | 3575 | 8797 | 436 | 1311 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 29346012_f3_97 | 3576 | 8798 | 411 | 1236 | 105 | 0.011 |
| Protein name | | | Locus Name | | | Acc# |
| rRNA methylase (SpoU family) (OO, TP) PFB0855c | | | pir:B71604 | | | B71604 |
| Description | | | | | | |

| ORF Name | NTID | AAID | NT Length | AA Length | Score | Probability |
|---|---|---|---|---|---|---|
| 29406680_c1_109 | 3577 | 8799 | 126 | 381 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 29695387_f3_93 | 3578 | 8800 | 399 | 1200 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 30084687_f2_59 | 3579 | 8801 | 428 | 1287 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 30507138_f1_2 | 3580 | 8802 | 561 | 1686 | 112 | 0.038 |
| Protein name | | | Locus Name | | | Acc# |
| submaxillary mucin 1 | | | pir:T42233 | | | T42233 |
| Description | | | | | | |

-continued

| ORF Name | NTID | AAID | NT Length | AA Length | Score | Probability |
|---|---|---|---|---|---|---|
| 34256561_c3_213 | 3581 | 8803 | 228 | 687 | 146 | 1.5e−21 |
| Protein name | | | | Locus Name | | Acc# |
| probable glpG protein | | | | pir:D71258 | | D71258 |
| Description | | | | | | |

| ORF Name | NTID | AAID | NT Length | AA Length | Score | Probability |
|---|---|---|---|---|---|---|
| 35267555_c1_126 | 3582 | 8804 | 309 | 930 | 177 | 3.2e−13 |
| Protein name | | | | Locus Name | | Acc# |
| probable glpG protein | | | | pir:D71258 | | D71258 |
| Description | | | | | | |

| ORF Name | NTID | AAID | NT Length | AA Length | Score | Probability |
|---|---|---|---|---|---|---|
| 35582908_c2_182 | 3583 | 8805 | 77 | 234 | | |
| Protein name | | | | Locus Name | | Acc# |
| Description | | | | | | |
| NO-HIT | | | | | | |

| ORF Name | NTID | AAID | NT Length | AA Length | Score | Probability |
|---|---|---|---|---|---|---|
| 36207937_f1_1 | 3584 | 8806 | 489 | 1470 | | |
| Protein name | | | | Locus Name | | Acc# |
| Description | | | | | | |
| NO-HIT | | | | | | |

| ORF Name | NTID | AAID | NT Length | AA Length | Score | Probability |
|---|---|---|---|---|---|---|
| 395662_c1_118 | 3585 | 8807 | 189 | 570 | 151 | 8.8e−11 |
| Protein name | | | | Locus Name | | Acc# |
| mutator protein mutT | | | | pir:D64443 | | D64443 |
| Description | | | | | | |

| ORF Name | NTID | AAID | NT Length | AA Length | Score | Probability |
|---|---|---|---|---|---|---|
| 4103377_f3_98 | 3586 | 8808 | 207 | 621 | 177 | 4.6e−20 |
| Protein name | | | | Locus Name | | Acc# |
| lic-1 protein D | | | | pir:E64128 | | E64128 |
| Description | | | | | | |

| ORF Name | NTID | AAID | NT Length | AA Length | Score | Probability |
|---|---|---|---|---|---|---|
| 441500_f2_42 | 3587 | 8809 | 77 | 234 | | |
| Protein name | | | | Locus Name | | Acc# |
| Description | | | | | | |
| NO-HIT | | | | | | |

-continued

| ORF Name | NTID | AAID | NT Length | AA Length | Score | Probability |
|---|---|---|---|---|---|---|
| 4694011_f3_73 | 3588 | 8810 | 99 | 300 | 272 | 1.3e−23 |
| Protein name | | | | Locus Name | | Acc# |
| | | | | sp:DBH_BACST | | |

Description

DNA-BINDING PROTEIN II (HB) (HU)

| ORF Name | NTID | AAID | NT Length | AA Length | Score | Probability |
|---|---|---|---|---|---|---|
| 5260952_f1_32 | 3589 | 8811 | 426 | 1281 | | |
| Protein name | | | | Locus Name | | Acc# |

Description

NO-HIT

| ORF Name | NTID | AAID | NT Length | AA Length | Score | Probability |
|---|---|---|---|---|---|---|
| 5860750_f1_27 | 3590 | 8812 | 100 | 303 | 73 | 0.023 |
| Protein name | | | | Locus Name | | Acc# |
| | | | | sp:YM25_YEAST | | P40219 |

Description

HYPOTHETICAL 16.4 KD PROTEIN IN TIF34-SWP1 INTERGENIC REGION

| ORF Name | NTID | AAID | NT Length | AA Length | Score | Probability |
|---|---|---|---|---|---|---|
| 5937825_f2_38 | 3591 | 8813 | 107 | 324 | | |
| Protein name | | | | Locus Name | | Acc# |

Description

NO-HIT

| ORF Name | NTID | AAID | NT Length | AA Length | Score | Probability |
|---|---|---|---|---|---|---|
| 6914530_c3_202 | 3592 | 8814 | 69 | 210 | | |
| Protein name | | | | Locus Name | | Acc# |

Description

NO-HIT

| ORF Name | NTID | AAID | NT Length | AA Length | Score | Probability |
|---|---|---|---|---|---|---|
| 7134587_f2_36 | 3593 | 8815 | 1022 | 3069 | | |
| Protein name | | | | Locus Name | | Acc# |

Description

NO-HIT

-continued

| ORF Name | NTID | AAID | NT Length | AA Length | Score | Probability |
|---|---|---|---|---|---|---|
| 10555337_f1_16 | 3594 | 8816 | 233 | 702 | 202 | 5.1e-16 |

| Protein name | | | Locus Name | | | Acc# |
|---|---|---|---|---|---|---|
| glycosyl transferase | | | gp:SPAJ6986 | | | AJ006986 |

Description

*Streptococcus pneumoniae* type 33F DNA, capsular gene cluster.

| ORF Name | NTID | AAID | NT Length | AA Length | Score | Probability |
|---|---|---|---|---|---|---|
| 10572281_c1_271 | 3595 | 8817 | 254 | 765 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 10599062_f2_97 | 3596 | 8818 | 94 | 285 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 10740936_f3_233 | 3597 | 8819 | 627 | 1884 | 292 | 7.6e-24 |

| Protein name | | | Locus Name | | | Acc# |
|---|---|---|---|---|---|---|
| serine/threonine protein kinase related protein | | | pir:H69064 | | | H69064 |

Description

| ORF Name | NTID | AAID | NT Length | AA Length | Score | Probability |
|---|---|---|---|---|---|---|
| 11723437_f2_138 | 3598 | 8820 | 307 | 924 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 11984410_c3_488 | 3599 | 8821 | 258 | 777 | 460 | 1.6e-43 |

| Protein name | | | Locus Name | | | Acc# |
|---|---|---|---|---|---|---|
| hypothetical protein | | | gp:SAURED | | | Y09927 |

Description

*Staphylococcus aureus* glmM gene cluster.

-continued

| ORF Name | NTID | AAID | NT Length | AA Length | Score | Probability |
|---|---|---|---|---|---|---|
| 1250280__f1__25 | 2600 | 8822 | 157 | 474 | 203 | 2.7e−16 |

| Protein name | Locus Name | Acc# |
|---|---|---|
| | sp:YOHJ__ECOLI | P33372 |

Description

HYPOTHETICAL 14.6 KD PROTEIN IN PBPG-CDD INTERGENIC REGION

| ORF Name | NTID | AAID | NT Length | AA Length | Score | Probability |
|---|---|---|---|---|---|---|
| 12538406__f3__242 | 3601 | 8823 | 633 | 1902 | 454 | 6.8e−43 |

| Protein name | Locus Name | Acc# |
|---|---|---|
| | sp:YFEW__ECOLI | P77619 |

Description

HYPOTHETICAL 47.8 KD PROTEIN IN UCPA-AMIA INTERGENIC REGION PRECURSOR

| ORF Name | NTID | AAID | NT Length | AA Length | Score | Probability |
|---|---|---|---|---|---|---|
| 12673751__f2__171 | 3602 | 8824 | 110 | 330 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 1351375__c3__464 | 3603 | 8825 | 82 | 249 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 13709431__c2__416 | 3604 | 8826 | 137 | 414 | 150 | 1.1e−10 |

| Protein name | Locus Name | Acc# |
|---|---|---|
| hypothetical protein | pir:S76920 | S76920 |

Description

| ORF Name | NTID | AAID | NT Length | AA Length | Score | Probability |
|---|---|---|---|---|---|---|
| 13808507__f1__45 | 3605 | 8827 | 307 | 924 | 177 | 3.1e−13 |

| Protein name | Locus Name | Acc# |
|---|---|---|
| comEA protein-related protein | pir:F72301 | F72301 |

Description

-continued

| ORF Name | NTID | AAID | NT Length | AA Length | Score | Probability |
|---|---|---|---|---|---|---|
| 14257802_f3_240 | 3606 | 8828 | 391 | 1176 | 127 | 2.1e−13 |

| Protein name | Locus Name | Acc# |
|---|---|---|
| hypothetical protein | pir:G75375 | G75375 |

Description

| ORF Name | NTID | AAID | NT Length | AA Length | Score | Probability |
|---|---|---|---|---|---|---|
| 14459691_c2_408 | 3607 | 8829 | 237 | 714 | 106 | 0.0065 |

| Protein name | Locus Name | Acc# |
|---|---|---|
| triadin isoform 3 | gp:AF165917 | AF165917 |

Description

*Canis familiaris* triadin isoform 3 mRNA, complete cds.

| ORF Name | NTID | AAID | NT Length | AA Length | Score | Probability |
|---|---|---|---|---|---|---|
| 14500800_c2_415 | 3608 | 8830 | 399 | 1200 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 15681530_c3_444 | 3609 | 8831 | 295 | 888 | 246 | 5.7e−31 |

| Protein name | Locus Name | Acc# |
|---|---|---|
| | sp:CCSA_TOBAC | P12216 |

Description

CYTOCHROME C BIOGENESIS PROTEIN CCSA

| ORF Name | NTID | AAID | NT Length | AA Length | Score | Probability |
|---|---|---|---|---|---|---|
| 15713262_c3_456 | 3610 | 8832 | 71 | 216 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 157788_f2_91 | 3611 | 8833 | 263 | 792 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 16289086_f3_259 | 3612 | 8834 | 309 | 930 | 129 | 3.4e−05 |

| Protein name | | | | Locus Name | | Acc# |
|---|---|---|---|---|---|---|
| interphotoreceptor retinoid-binding protein | | | | gp:DRRNAIRBP | | X85957 |

Description

*Danio rerio* mRNA for interphotoreceptor retinoid-binding protein.

| ORF Name | NTID | AAID | NT Length | AA Length | Score | Probability |
|---|---|---|---|---|---|---|
| 16804510_c3_471 | 3613 | 8835 | 79 | 240 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 19547890_f1_5 | 3614 | 8836 | 370 | 1113 | 188 | 8.2e−17 |

| Protein name | | | | Locus Name | | Acc# |
|---|---|---|---|---|---|---|
| | | | | sp:OTC_ARCFU | | O29013 |

Description

ORNITHINE CARBAMOYLTRANSFERASE, (OTCASE)

| ORF Name | NTID | AAID | NT Length | AA Length | Score | Probability |
|---|---|---|---|---|---|---|
| 19727333_c3_491 | 3615 | 8837 | 208 | 627 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 20134428_f3_255 | 3616 | 8838 | 139 | 420 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 20312527_f2_165 | 3617 | 8839 | 297 | 894 | | |

| Protein name | | | | Locus Name | | Acc# |
|---|---|---|---|---|---|---|

Description

NO-HIT

-continued

| ORF Name | NTID | AAID | NT Length | AA Length | Score | Probability |
|---|---|---|---|---|---|---|
| 21913177_c3_446 | 3618 | 8840 | 255 | 768 | 153 | 7.6e−11 |

| Protein name | Locus Name | Acc# |
|---|---|---|
| transcription regulator, crp family | pir:F72285 | F72285 |

Description

| ORF Name | NTID | AAID | NT Length | AA Length | Score | Probability |
|---|---|---|---|---|---|---|
| 21961513_f2_145 | 3619 | 8841 | 456 | 1371 | 861 | 5.1e−86 |

| Protein name | Locus Name | Acc# |
|---|---|---|
|  | sp:YBBC_BACSU | P40407 |

Description (ORF2)

| ORF Name | NTID | AAID | NT Length | AA Length | Score | Probability |
|---|---|---|---|---|---|---|
| 21989375_f2_128 | 3620 | 8842 | 443 | 1332 | 619 | 2.2e−60 |

| Protein name | Locus Name | Acc# |
|---|---|---|
|  | sp:MURF_BACSU | P96613 |

Description (D-ALANYL-D-ALANINE-ADDING ENZYME)

| ORF Name | NTID | AAID | NT Length | AA Length | Score | Probability |
|---|---|---|---|---|---|---|
| 22062501_f3_175 | 3621 | 8843 | 287 | 864 | 414 | 1.2e−38 |

| Protein name | Locus Name | Acc# |
|---|---|---|
| glutamate racemase | pir:B70329 | B70329 |

Description

| ORF Name | NTID | AAID | NT Length | AA Length | Score | Probability |
|---|---|---|---|---|---|---|
| 22136_f2_129 | 3622 | 8844 | 459 | 1380 | 948 | 3.1e−95 |

| Protein name | Locus Name | Acc# |
|---|---|---|
| sodium-dependent transporter homolog yocR | pir:D69902 | D69902 |

Description

| ORF Name | NTID | AAID | NT Length | AA Length | Score | Probability |
|---|---|---|---|---|---|---|
| 22460312_f1_54 | 3623 | 8845 | 1121 | 3366 | 461 | 1.5e−66 |

| Protein name | Locus Name | Acc# |
|---|---|---|
| 115K outer membrane protein precursor:SusC protein | pir:JC6027 | JC6027 |

Description

-continued

| ORF Name | NTID | AAID | NT Length | AA Length | Score | Probability |
|---|---|---|---|---|---|---|
| 22900257_c2_355 | 3624 | 8846 | 175 | 528 | | |

| Protein name | | Locus Name | Acc# |
|---|---|---|---|
| | | | |

Description

NO-HIT

| ORF Name | NTID | AAID | NT Length | AA Length | Score | Probability |
|---|---|---|---|---|---|---|
| 23484750_f3_257 | 3625 | 8847 | 893 | 2682 | 1179 | 1.0e−119 |

| Protein name | | Locus Name | Acc# |
|---|---|---|---|
| | | sp:PARC_BORBU | O51066 |

Description

TOPOISOMERASE IV SUBUNIT A,

| ORF Name | NTID | AAID | NT Length | AA Length | Score | Probability |
|---|---|---|---|---|---|---|
| 23721906_c3_472 | 3626 | 8848 | 111 | 336 | | |

| Protein name | | Locus Name | Acc# |
|---|---|---|---|
| | | | |

Description

NO-HIT

| ORF Name | NTID | AAID | NT Length | AA Length | Score | Probability |
|---|---|---|---|---|---|---|
| 23930318_f3_172 | 3627 | 8849 | 839 | 2520 | 407 | 1.9e−38 |

| Protein name | | Locus Name | Acc# |
|---|---|---|---|
| outer membrane protein Omp85 | | gp:AF021245 | AF021245 |

Description

*Neisseria meningitidis* outer membrane protein Omp85 (omp85) gene, complete cds.

| ORF Name | NTID | AAID | NT Length | AA Length | Score | Probability |
|---|---|---|---|---|---|---|
| 23932786_f3_258 | 3628 | 8850 | 297 | 894 | | |

| Protein name | | Locus Name | Acc# |
|---|---|---|---|
| | | | |

Description

NO-HIT

| ORF Name | NTID | AAID | NT Length | AA Length | Score | Probability |
|---|---|---|---|---|---|---|
| 23957950_f1_38 | 3629 | 8851 | 702 | 2109 | 353 | 1.0e−28 |

| Protein name | | Locus Name | Acc# |
|---|---|---|---|
| two component sensor | | gp:AF030352 | AF030352 |

Description

*Pseudomonas aeruginosa* two component sensor (lemA) gene, partialcds.

-continued

| ORF Name | NTID | AAID | NT Length | AA Length | Score | Probability |
|---|---|---|---|---|---|---|
| 24019053_f2_101 | 3630 | 8852 | 89 | 270 | 169 | 1.1e−12 |
| Protein name | | | | Locus Name | | Acc# |
| DNA repair protein | | | | pir:H72239 | | H72239 |

Description

| ORF Name | NTID | AAID | NT Length | AA Length | Score | Probability |
|---|---|---|---|---|---|---|
| 24025277_f2_100 | 3631 | 8853 | 141 | 426 | 189 | 8.2e−15 |
| Protein name | | | | Locus Name | | Acc# |
| | | | | sp:RADC_BACSU | | Q02170 |

Description

DNA REPAIR PROTEIN RADC HOMOLOG (ORFB)

| ORF Name | NTID | AAID | NT Length | AA Length | Score | Probability |
|---|---|---|---|---|---|---|
| 24025316_c3_439 | 3632 | 8854 | 184 | 555 | 171 | 1.1e−15 |
| Protein name | | | | Locus Name | | Acc# |
| immunoreactive 30 kD antigen PG44 | | | | gp:AF175717 | | AF175717 |

Description

*Porphyromonas gingivalis* strain W50 immunoreactive 30 kD antigenPG44 gene, complete cds.

| ORF Name | NTID | AAID | NT Length | AA Length | Score | Probability |
|---|---|---|---|---|---|---|
| 24026552_f1_67 | 3633 | 8855 | 286 | 861 | 607 | 4.2e−59 |
| Protein name | | | | Locus Name | | Acc# |
| | | | | sp:YFEU_HAEIN | | P44862 |

Description

HYPOTHETICAL PROTEIN HI0754

| ORF Name | NTID | AAID | NT Length | AA Length | Score | Probability |
|---|---|---|---|---|---|---|
| 24270327_c3_498 | 3634 | 8856 | 265 | 798 | 98 | 0.019 |
| Protein name | | | | Locus Name | | Acc# |
| unknown | | | | gp:AF049236 | | AF049236 |

Description

*Arabidopsis thaliana* putative transmembrane protein Glp (AtG1), putative nuclear DNA-binding protein G2p (AtG2), Em1 protein (ATEM1), putative chlorophyll synthetase (AtG4), putative transmembrane protein G5p (AtG5), putative acyl-coA dehydrogenase (AtG6), and calcium dependent protein kinase genes, complete cds; and unknown genes.

| ORF Name | NTID | AAID | NT Length | AA Length | Score | Probability |
|---|---|---|---|---|---|---|
| 24415892_c3_489 | 3635 | 8857 | 76 | 231 | | |
| Protein name | | | | Locus Name | | Acc# |

Description

NO-HIT

-continued

| ORF Name | NTID | AAID | NT Length | AA Length | Score | Probability |
|---|---|---|---|---|---|---|
| 24470300_c3_500 | 3636 | 8858 | 404 | 1215 | 1234 | 1.5e−125 |

| Protein name | Locus Name | Acc# |
|---|---|---|
| acetate kinase | pir:H72397 | H72397 |

Description

| ORF Name | NTID | AAID | NT Length | AA Length | Score | Probability |
|---|---|---|---|---|---|---|
| 24641933_f2_142 | 3637 | 8859 | 490 | 1473 | 167 | 9.9e−10 |

| Protein name | Locus Name | Acc# |
|---|---|---|
| glycosyl transferase PAB0772 | pir:B75096 | B75096 |

Description

| ORF Name | NTID | AAID | NT Length | AA Length | Score | Probability |
|---|---|---|---|---|---|---|
| 24648257_f3_205 | 3638 | 8860 | 233 | 702 | 449 | 2.3e−42 |

| Protein name | Locus Name | Acc# |
|---|---|---|
| | sp:YOHK_ECOLI | P33373 |

Description

HYPOTHETICAL 24.5 KD PROTEIN IN PBPG-CDD INTERGENIC REGION

| ORF Name | NTID | AAID | NT Length | AA Length | Score | Probability |
|---|---|---|---|---|---|---|
| 24804562_f3_229 | 3639 | 8861 | 341 | 1026 | 968 | 2.3e−97 |

| Protein name | Locus Name | Acc# |
|---|---|---|
| aspartate−semialdehyde dehydrogenase, | pir:B70461 | B70461 |

Description

| ORF Name | NTID | AAID | NT Length | AA Length | Score | Probability |
|---|---|---|---|---|---|---|
| 25494017_f3_235 | 3640 | 8862 | 470 | 1413 | 259 | 2.1e−24 |

| Protein name | Locus Name | Acc# |
|---|---|---|
| amidase enhancer | gp:AB017194 | AB017194 |

Description

*Plectonema boryanum* ORF270, proline iminopeptidase, ferredoxin andamidase enhancer genes, complete and partial cds.

| ORF Name | NTID | AAID | NT Length | AA Length | Score | Probability |
|---|---|---|---|---|---|---|
| 26359827_c3_476 | 3641 | 8863 | 242 | 729 | 365 | 1.8e−33 |

| Protein name | Locus Name | Acc# |
|---|---|---|
| | sp:YGDL_ECOLI | Q46927 |

Description

HYPOTHETICAL 28.6 KD PROTEIN IN GCVA-MLTA INTERGENIC REGION

-continued

| ORF Name | NTID | AAID | NT Length | AA Length | Score | Probability |
|---|---|---|---|---|---|---|
| 26364591_c3_512 | 3642 | 8864 | 61 | 186 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 26594061_c2_354 | 3643 | 8865 | 495 | 1488 | 814 | 4.2e−122 |

| Protein name | | | | Locus Name | | Acc# |
|---|---|---|---|---|---|---|
| | | | | sp:NRFA_HAEIN | | P45017 |

Description

CYTOCHROME C552 PRECURSOR

| ORF Name | NTID | AAID | NT Length | AA Length | Score | Probability |
|---|---|---|---|---|---|---|
| 26595877_c3_487 | 3644 | 8866 | 323 | 972 | 707 | 1.1e−69 |

| Protein name | | | | Locus Name | | Acc# |
|---|---|---|---|---|---|---|
| | | | | sp:YBAS_ECOLI | | P77454 |

Description

HYPOTHETICAL 32.9 KD PROTEIN IN USHA-TESA INTERGENIC REGION

| ORF Name | NTID | AAID | NT Length | AA Length | Score | Probability |
|---|---|---|---|---|---|---|
| 26601586_c2_395 | 3645 | 8867 | 288 | 867 | 553 | 2.2e−53 |

| Protein name | | | | Locus Name | | Acc# |
|---|---|---|---|---|---|---|
| dihydropteroate synthase | | | | pir:E72425 | | E72425 |

Description

| ORF Name | NTID | AAID | NT Length | AA Length | Score | Probability |
|---|---|---|---|---|---|---|
| 29414003_f2_118 | 3646 | 8868 | 70 | 213 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 29478385_c1_297 | 3647 | 8869 | 712 | 2139 | 703 | 3.0e−79 |

| Protein name | | | | Locus Name | | Acc# |
|---|---|---|---|---|---|---|
| hypothetical protein | | | | pir:S76532 | | S76532 |

Description

-continued

| ORF Name | NTID | AAID | NT Length | AA Length | Score | Probability |
|---|---|---|---|---|---|---|
| 29882802_f1_65 | 3648 | 8870 | 969 | 2910 | 1636 | 3.8e−168 |
| Protein name | | | Locus Name | | | Acc# |
| d-lactate dehydrogenase | | | pir:A71843 | | | A71843 |
| Description | | | | | | |

| ORF Name | NTID | AAID | NT Length | AA Length | Score | Probability |
|---|---|---|---|---|---|---|
| 30120267_c1_316 | 3649 | 8871 | 385 | 1158 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 30261425_f3_231 | 3650 | 8872 | 600 | 1803 | 96 | 1.3e−05 |
| Protein name | | | Locus Name | | | Acc# |
| unknown | | | gp:U96771 | | | U96771 |
| Description | | | | | | |

*Prevotella bryantii* putative polygalacturonase, B-1,4-endoglucanase, and mannanase genes, complete cds; and unknown genes.

| ORF Name | NTID | AAID | NT Length | AA Length | Score | Probability |
|---|---|---|---|---|---|---|
| 3156927_c3_499 | 3651 | 8873 | 341 | 1026 | 859 | 8.3e−86 |
| Protein name | | | Locus Name | | | Acc# |
| phosphotransacetylase | | | gp:TTAJ4870 | | | AJ004870 |
| Description | | | | | | |

*Thermoanaerobacterium thermosaccharolyticum* ptaA and ackA genes, orf1, orf2, orf3, orf4.

| ORF Name | NTID | AAID | NT Length | AA Length | Score | Probability |
|---|---|---|---|---|---|---|
| 31881508_c1_298 | 3652 | 8874 | 237 | 714 | 541 | 4.1e−52 |
| Protein name | | | Locus Name | | | Acc# |
| ABC transporter | | | pir:B70327 | | | B70327 |
| Description | | | | | | |

| ORF Name | NTID | AAID | NT Length | AA Length | Score | Probability |
|---|---|---|---|---|---|---|
| 33211586_c3_506 | 3653 | 8875 | 328 | 987 | 429 | 6.3e−45 |
| Protein name | | | Locus Name | | | Acc# |
| | | | sp:DDL_HAEIN | | | P44405 |
| Description | | | | | | |

D-ALANINE--D-ALANINE LIGASE, (D-ALANYLALANINE SYNTHETASE)

-continued

| ORF Name | NTID | AAID | NT Length | AA Length | Score | Probability |
|---|---|---|---|---|---|---|
| 33406262_c3_440 | 3654 | 8876 | 171 | 516 | 238 | 5.3e−20 |

| Protein name | Locus Name | Acc# |
|---|---|---|
| nimB protein | pir:I40183 | |

Description

| ORF Name | NTID | AAID | NT Length | AA Length | Score | Probability |
|---|---|---|---|---|---|---|
| 33675253_f2_127 | 3655 | 8877 | 450 | 1353 | 186 | 1.4e−11 |

| Protein name | Locus Name | Acc# |
|---|---|---|
| NorA | gp:AB019536 | AB019536 |

Description

*Staphylococcus aureus* norA23 gene for NorA, complete cds.

| ORF Name | NTID | AAID | NT Length | AA Length | Score | Probability |
|---|---|---|---|---|---|---|
| 34023425_c3_486 | 3656 | 8878 | 486 | 1461 | 1130 | 1.6e−114 |

| Protein name | Locus Name | Acc# |
|---|---|---|
| glutamate decarboxylase:protein sll1641:protein sll1641 | pir:S75150 | S75150 |

Description

| ORF Name | NTID | AAID | NT Length | AA Length | Score | Probability |
|---|---|---|---|---|---|---|
| 34069067_f2_98 | 3657 | 8879 | 192 | 579 | 929 | 3.2e−93 |

| Protein name | Locus Name | Acc# |
|---|---|---|
| | sp:EFP_BACFR | P70889 |

Description

ELONGATION FACTOR P (EF-P)

| ORF Name | NTID | AAID | NT Length | AA Length | Score | Probability |
|---|---|---|---|---|---|---|
| 34095887_c3_501 | 3658 | 8880 | 470 | 1413 | 487 | 5.7e−58 |

| Protein name | Locus Name | Acc# |
|---|---|---|
| alkaline phosphatase | pir:B72410 | B72410 |

Description

| ORF Name | NTID | AAID | NT Length | AA Length | Score | Probability |
|---|---|---|---|---|---|---|
| 34632811_f3_178 | 3659 | 8881 | 376 | 1131 | 93 | 0.038 |

| Protein name | Locus Name | Acc# |
|---|---|---|
| hypothetical protein sll0670 | pir:S77054 | S77054 |

Description

-continued

| ORF Name | NTID | AAID | NT Length | AA Length | Score | Probability |
|---|---|---|---|---|---|---|
| 35348812_f3_176 | 3660 | 8882 | 413 | 1242 | 549 | 5.9e−53 |

| Protein name | Locus Name | Acc# |
|---|---|---|
| glutamate 5-kinase proJ | pir:F69682 | F69682 |

Description

| ORF Name | NTID | AAID | NT Length | AA Length | Score | Probability |
|---|---|---|---|---|---|---|
| 36345282_c1_330 | 3661 | 8883 | 175 | 528 | 364 | 2.4e−33 |

| Protein name | Locus Name | Acc# |
|---|---|---|
| | sp:YBC5_CHLVI | O50310 |

Description

HYPOTHETICAL 36.7 KD PROTEIN IN BCHI 5'REGION

| ORF Name | NTID | AAID | NT Length | AA Length | Score | Probability |
|---|---|---|---|---|---|---|
| 36365942_c2_400 | 3662 | 8884 | 297 | 894 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 3923751_c1_324 | 3663 | 8885 | 114 | 345 | 237 | 6.8e−20 |

| Protein name | Locus Name | Acc# |
|---|---|---|
| conserved hypothetical protein | pir:C75306 | C75306 |

Description

| ORF Name | NTID | AAID | NT Length | AA Length | Score | Probability |
|---|---|---|---|---|---|---|
| 3937680_c2_409 | 3664 | 8886 | 521 | 1566 | 129 | 0.0015 |

| Protein name | Locus Name | Acc# |
|---|---|---|
| elastic titin | pir:I38346 | I38346 |

Description

| ORF Name | NTID | AAID | NT Length | AA Length | Score | Probability |
|---|---|---|---|---|---|---|
| 3939462_c3_492 | 3665 | 8887 | 103 | 312 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 3961412_c2_358 | 3666 | 8888 | 424 | 1275 | 83 | 0.013 |

| Protein name | Locus Name | Acc# |
|---|---|---|
| polyprotein | gp:AF206441 | AF206441 |

Description

Hepatitis C virus isolate 28B polyprotein gene, E1/E2 region, partial cds.

| ORF Name | NTID | AAID | NT Length | AA Length | Score | Probability |
|---|---|---|---|---|---|---|
| 4063932_f1_2 | 3667 | 8889 | 85 | 258 | 68 | 0.047 |

| Protein name | Locus Name | Acc# |
|---|---|---|
| conserved hypothetical protein aq_340 | pir:C70330 | C70330 |

Description

| ORF Name | NTID | AAID | NT Length | AA Length | Score | Probability |
|---|---|---|---|---|---|---|
| 4101502_c3_494 | 3668 | 8890 | 376 | 1131 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4101563_f2_150 | 3669 | 8891 | 285 | 858 | 106 | 0.0082 |

| Protein name | Locus Name | Acc# |
|---|---|---|
| hypothetical protein W06B4.2 | pir:T34482 | T34482 |

Description

| ORF Name | NTID | AAID | NT Length | AA Length | Score | Probability |
|---|---|---|---|---|---|---|
| 4109777_f2_164 | 3670 | 8892 | 599 | 1800 | 176 | 1.5e−09 |

| Protein name | Locus Name | Acc# |
|---|---|---|
| hypothetical protein | pir:S75991 | S75991 |

Description

| ORF Name | NTID | AAID | NT Length | AA Length | Score | Probability |
|---|---|---|---|---|---|---|
| 4410807_f3_236 | 3671 | 8893 | 437 | 1314 | 252 | 4.1e−19 |

| Protein name | Locus Name | Acc# |
|---|---|---|
| | gp:HILIC3 | X57315 |

Description

*Haemophilus influenzae* lic3 locus, containing galE and adk genes for UDP-galactose-4-epimerase and adenylate kinase.

-continued

| ORF Name | NTID | AAID | NT Length | AA Length | Score | Probability |
|---|---|---|---|---|---|---|
| 4535957_f3_177 | 3672 | 8894 | 419 | 1260 | 867 | 1.2e−86 |

| Protein name | | | | Locus Name | | Acc# |
|---|---|---|---|---|---|---|
| gamma-glutamyl phosphate reductase | | | | gp:STPROBA | | X92418 |

Description

*S. thermophilus* proB and proA genes.

| ORF Name | NTID | AAID | NT Length | AA Length | Score | Probability |
|---|---|---|---|---|---|---|
| 4554687_c1_329 | 3673 | 8895 | 184 | 555 | 382 | 2.9e−35 |

| Protein name | | | | Locus Name | | Acc# |
|---|---|---|---|---|---|---|
| | | | | sp:YBC5_CHLVI | | O50310 |

Description

HYPOTHETICAL 36.7 KD PROTEIN IN BCHI 5′REGION

| ORF Name | NTID | AAID | NT Length | AA Length | Score | Probability |
|---|---|---|---|---|---|---|
| 4563927_c3_441 | 3674 | 8896 | 202 | 609 | 338 | 1.3e−30 |

| Protein name | | | | Locus Name | | Acc# |
|---|---|---|---|---|---|---|
| small subunit of cytochrome c nitrite reductase | | | | gp:WSU245540 | | AJ245540 |

Description

*Wolinella succinogenes* mreB gene (partial), nrfH, nrfA, nrfI, and nrfJ genes.

| ORF Name | NTID | AAID | NT Length | AA Length | Score | Probability |
|---|---|---|---|---|---|---|
| 46933_c3_495 | 3675 | 8897 | 642 | 1929 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 4718961_c2_413 | 3676 | 8898 | 217 | 654 | 151 | 1.3e−08 |

| Protein name | | | | Locus Name | | Acc# |
|---|---|---|---|---|---|---|
| protein kinase homolog | | | | pir:T42077 | | T42077 |

Description

| ORF Name | NTID | AAID | NT Length | AA Length | Score | Probability |
|---|---|---|---|---|---|---|
| 4723376_f1_59 | 3677 | 8899 | 1027 | 3084 | | |

| Protein name | | | | Locus Name | | Acc# |
|---|---|---|---|---|---|---|

Description

NO-HIT

-continued

| ORF Name | NTID | AAID | NT Length | AA Length | Score | Probability |
|---|---|---|---|---|---|---|
| 4744062_c2_397 | 3678 | 8900 | 87 | 264 | | |
| Protein name | | | Locus Name | | Acc# | |
| Description | | | | | | |
| NO-HIT | | | | | | |

| ORF Name | NTID | AAID | NT Length | AA Length | Score | Probability |
|---|---|---|---|---|---|---|
| 4782761_f3_207 | 3679 | 8901 | 342 | 1029 | 109 | 0.0020 |
| Protein name | | | Locus Name | | Acc# | |
| hypothetical protein PAB0896 | | | pir:G75045 | | G75045 | |
| Description | | | | | | |

| ORF Name | NTID | AAID | NT Length | AA Length | Score | Probability |
|---|---|---|---|---|---|---|
| 4876563_c2_403 | 3680 | 8902 | 105 | 318 | | |
| Protein name | | | Locus Name | | Acc# | |
| Description | | | | | | |
| NO-HIT | | | | | | |

| ORF Name | NTID | AAID | NT Length | AA Length | Score | Probability |
|---|---|---|---|---|---|---|
| 5272813_f1_63 | 3681 | 8903 | 313 | 942 | | |
| Protein name | | | Locus Name | | Acc# | |
| Description | | | | | | |
| NO-HIT | | | | | | |

| ORF Name | NTID | AAID | NT Length | AA Length | Score | Probability |
|---|---|---|---|---|---|---|
| 5907312_c1_332 | 3682 | 8904 | 249 | 750 | | |
| Protein name | | | Locus Name | | Acc# | |
| Description | | | | | | |
| NO-HIT | | | | | | |

| ORF Name | NTID | AAID | NT Length | AA Length | Score | Probability |
|---|---|---|---|---|---|---|
| 6022312_c2_388 | 3683 | 8905 | 164 | 495 | 92 | 0.0068 |
| Protein name | | | Locus Name | | Acc# | |
| hypothetical protein SPAC11E3.10 | | | pir:T37538 | | T37538 | |
| Description | | | | | | |

| ORF Name | NTID | AAID | NT Length | AA Length | Score | Probability |
|---|---|---|---|---|---|---|
| 6109552_c1_317 | 3684 | 8906 | 63 | 192 | | |
| Protein name | | | Locus Name | | Acc# | |
| Description | | | | | | |
| NO-HIT | | | | | | |

-continued

| ORF Name | NTID | AAID | NT Length | AA Length | Score | Probability |
|---|---|---|---|---|---|---|
| 657811_f3_206 | 3685 | 8907 | 323 | 972 | 451 | 1.4e-42 |

| Protein name | Locus Name | Acc# |
|---|---|---|
| hypothetical protein jhp0277 | pir:H71950 | H71950 |

Description

| ORF Name | NTID | AAID | NT Length | AA Length | Score | Probability |
|---|---|---|---|---|---|---|
| 6754515_f1_77 | 3686 | 8908 | 455 | 1368 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 677088_c2_412 | 3687 | 8909 | 112 | 339 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 683393_f2_162 | 3688 | 8910 | 64 | 195 | 58 | 0.0087 |

| Protein name | Locus Name | Acc# |
|---|---|---|
| NADH dehydrogenase 1 | gp:AF069183 | AF069183 |

Description

*Lipolexis gracilis* NADH dehydrogenase 1 gene, mitochondrial gene encoding mitochondrial protein, partial cds.

| ORF Name | NTID | AAID | NT Length | AA Length | Score | Probability |
|---|---|---|---|---|---|---|
| 6917183_c2_378 | 3689 | 8911 | 62 | 189 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 797255_f3_173 | 3690 | 8912 | 168 | 507 | 160 | 9.7e-12 |

| Protein name | Locus Name | Acc# |
|---|---|---|
| automembrane protein H | gp:YEOMPH | Y12468 |

Description

*Y. enterocolitica* ompH gene.

-continued

| ORF Name | NTID | AAID | NT Length | AA Length | Score | Probability |
|---|---|---|---|---|---|---|
| 815626_f2_104 | 3691 | 8913 | 447 | 1344 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 84812_f1_56 | 3692 | 8914 | 404 | 1215 | 632 | 9.4e−62 |

| Protein name | | | | Locus Name | | Acc# |
|---|---|---|---|---|---|---|
| | | | | sp:YBBC_BACSU | | P40407 |

Description (ORF2)

| ORF Name | NTID | AAID | NT Length | AA Length | Score | Probability |
|---|---|---|---|---|---|---|
| 859637_f2_140 | 3693 | 8915 | 494 | 1485 | 411 | 2.5e−38 |

| Protein name | | | | Locus Name | | Acc# |
|---|---|---|---|---|---|---|
| hypothetical protein | | | | pir:S75887 | | S75887 |

Description

| ORF Name | NTID | AAID | NT Length | AA Length | Score | Probability |
|---|---|---|---|---|---|---|
| 892000_f3_174 | 3694 | 8916 | 188 | 567 | 117 | 1.8e−06 |

| Protein name | | | | Locus Name | | Acc# |
|---|---|---|---|---|---|---|
| periplasmic protein | | | | gp:PLU236920 | | AJ236920 |

Description

*Photorhabdus luminescens* yaeL (partial), firA (partial), oma and ompH genes.

| ORF Name | NTID | AAID | NT Length | AA Length | Score | Probability |
|---|---|---|---|---|---|---|
| 969077_c1_264 | 3695 | 8917 | 521 | 1566 | 873 | 4.8e−121 |

| Protein name | | | | Locus Name | | Acc# |
|---|---|---|---|---|---|---|
| glycine-tRNA ligase, glyS:glycyl-tRNA synthetase:glycyl-tRNA synthetase | | | | pir:B70146 | | B70146 |

Description

| ORF Name | NTID | AAID | NT Length | AA Length | Score | Probability |
|---|---|---|---|---|---|---|
| 978432_c1_314 | 3696 | 8918 | 357 | 1074 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 9843876_f2_99 | 3697 | 8919 | 196 | 591 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 9940957_c1_325 | 3698 | 8920 | 260 | 783 | 233 | 1.8e−19 |
| Protein name | | | Locus Name | | | Acc# |
| | | | sp:YBBF_HAEIN | | | P44046 |
| Description | | | | | | |
| HYPOTHETICAL PROTEIN HI0735 | | | | | | |

| ORF Name | NTID | AAID | NT Length | AA Length | Score | Probability |
|---|---|---|---|---|---|---|
| 10337833_c2_266 | 3699 | 8921 | 123 | 372 | 116 | 7.8e−06 |
| Protein name | | | Locus Name | | | Acc# |
| | | | sp:FAS_PNECA | | | P29251 |
| Description | | | | | | |

| ORF Name | NTID | AAID | NT Length | AA Length | Score | Probability |
|---|---|---|---|---|---|---|
| 10625043_c3_280 | 3700 | 8922 | 336 | 1011 | 329 | 1.2e−29 |
| Protein name | | | Locus Name | | | Acc# |
| hemin permease | | | gp:YEHEMSTUV | | | X77867 |
| Description | | | | | | |
| *Y. enterocolitica* hemS, hemT, hemU and hemV genes. | | | | | | |

| ORF Name | NTID | AAID | NT Length | AA Length | Score | Probability |
|---|---|---|---|---|---|---|
| 12616700_c2_253 | 3701 | 8923 | 70 | 213 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 12629665_c1_202 | 3702 | 8924 | 350 | 1053 | | |
| Protein name | | | Locus Name | | | Acc# |
| Description | | | | | | |
| NO-HIT | | | | | | |

-continued

| ORF Name | NTID | AAID | NT Length | AA Length | Score | Probability |
|---|---|---|---|---|---|---|
| 12713383_f1_3 | 3703 | 8925 | 69 | 210 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 13102149_c1_172 | 3704 | 8926 | 199 | 600 | 421 | 2.1e−39 |

| Protein name | | | | Locus Name | | Acc# |
|---|---|---|---|---|---|---|
| | | | | sp:YLCA_ECOLI | | P77380 |

Description

PROBABLE TRANSCRIPTIONAL REGULATORY PROTEIN YLCA

| ORF Name | NTID | AAID | NT Length | AA Length | Score | Probability |
|---|---|---|---|---|---|---|
| 1360942_f1_20 | 3705 | 8927 | 90 | 273 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 14179057_f1_44 | 3706 | 8928 | 60 | 183 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 14494061_f3_166 | 3707 | 8929 | 236 | 711 | 228 | 6.1e−19 |

| Protein name | | | | Locus Name | | Acc# |
|---|---|---|---|---|---|---|
| precorrin-2 methyltransferase,:protein slr1879:protein slr1879 | | | | pir:S77131 | | S77131 |

Description

| ORF Name | NTID | AAID | NT Length | AA Length | Score | Probability |
|---|---|---|---|---|---|---|
| 14502316_c2_234 | 3708 | 8930 | 60 | 183 | 49 | 0.046 |

| Protein name | | | | Locus Name | | Acc# |
|---|---|---|---|---|---|---|
| | | | | sp:Y031_TREPA | | O83074 |

Description

HYPOTHETICAL PROTEIN TP0031

-continued

| ORF Name | NTID | AAID | NT Length | AA Length | Score | Probability |
|---|---|---|---|---|---|---|
| 15078450_c2_270 | 3709 | 8931 | 492 | 1479 | 829 | 1.2e−82 |

| Protein name | Locus Name | Acc# |
|---|---|---|
| putative efflux pump component MtrF | gp:AF176820 | AF176820 |

Description

*Neisseria gonorrhoeae* strain FA19 putative efflux pump component MtrF (mtrF) gene, complete cds.

| ORF Name | NTID | AAID | NT Length | AA Length | Score | Probability |
|---|---|---|---|---|---|---|
| 16839502_c2_250 | 3710 | 8932 | 240 | 723 | 251 | 2.2e−21 |

| Protein name | Locus Name | Acc# |
|---|---|---|
| hypothetical protein PAB0910 | pir:B75048 | B75048 |

Description

| ORF Name | NTID | AAID | NT Length | AA Length | Score | Probability |
|---|---|---|---|---|---|---|
| 16853403_c3_279 | 3711 | 8933 | 73 | 222 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 19553813_f2_91 | 3712 | 8934 | 163 | 492 | 376 | 1.3e−34 |

| Protein name | Locus Name | Acc# |
|---|---|---|
| | sp:PYRI_PYRAB | P77919 |

Description

ASPARTATE CARBAMOYLTRANSFERASE REGULATORY CHAIN

| ORF Name | NTID | AAID | NT Length | AA Length | Score | Probability |
|---|---|---|---|---|---|---|
| 20428526_f3_152 | 3713 | 8935 | 198 | 597 | 186 | 1.7e−14 |

| Protein name | Locus Name | Acc# |
|---|---|---|
| hypothetical protein PH0856 | pir:D71136 | D71136 |

Description

| ORF Name | NTID | AAID | NT Length | AA Length | Score | Probability |
|---|---|---|---|---|---|---|
| 20839062_f3_157 | 3714 | 8936 | 682 | 2049 | 310 | 7.4e−25 |

| Protein name | Locus Name | Acc# |
|---|---|---|
| histidine kinase sensor protein (barA) RP229 | pir:B71677 | B71677 |

Description

-continued

| ORF Name | NTID | AAID | NT Length | AA Length | Score | Probability |
|---|---|---|---|---|---|---|
| 21978425_f3_150 | 3715 | 8937 | 310 | 933 | 92 | 0.00087 |
| Protein name | | | | Locus Name | | Acc# |
| | | | | gp:D42067 | | D42067 |

Description

*Porphyromonas gingivalis* DNA for Fimbrilin, ORF1–4, complete cds.

| ORF Name | NTID | AAID | NT Length | AA Length | Score | Probability |
|---|---|---|---|---|---|---|
| 22272061_f3_131 | 3716 | 8938 | 317 | 954 | 783 | 9.4e−78 |
| Protein name | | | | Locus Name | | Acc# |
| | | | | sp:KPRS_HELPY | | P56184 |

Description (PYROPHOSPHATE SYNTHETASE)

| ORF Name | NTID | AAID | NT Length | AA Length | Score | Probability |
|---|---|---|---|---|---|---|
| 22375437_f2_90 | 3717 | 8939 | 94 | 285 | | |
| Protein name | | | | Locus Name | | Acc# |

Description

NO-HIT

| ORF Name | NTID | AAID | NT Length | AA Length | Score | Probability |
|---|---|---|---|---|---|---|
| 22539002_c1_177 | 3718 | 8940 | 388 | 1167 | 269 | 9.3e−22 |
| Protein name | | | | Locus Name | | Acc# |
| | | | | sp:Y878_METJA | | Q58288 |

Description

HYPOTHETICAL PROTEIN MJ0878

| ORF Name | NTID | AAID | NT Length | AA Length | Score | Probability |
|---|---|---|---|---|---|---|
| 22656925_c1_218 | 3719 | 8941 | 789 | 2370 | 459 | 5.7e−76 |
| Protein name | | | | Locus Name | | Acc# |
| penicillin binding protein 1A | | | | pir:F70355 | | F70355 |

Description

| ORF Name | NTID | AAID | NT Length | AA Length | Score | Probability |
|---|---|---|---|---|---|---|
| 23456506_f1_22 | 3720 | 8942 | 60 | 183 | | |
| Protein name | | | | Locus Name | | Acc# |

Description

NO-HIT

-continued

| ORF Name | NTID | AAID | NT Length | AA Length | Score | Probability |
|---|---|---|---|---|---|---|
| 23473387_f1_2 | 3721 | 8943 | 208 | 627 | 115 | 0.00026 |

| Protein name | Locus Name | Acc# |
|---|---|---|
| hypothetical protein BBI16 | pir:G70241 | G70241 |

Description

| ORF Name | NTID | AAID | NT Length | AA Length | Score | Probability |
|---|---|---|---|---|---|---|
| 23652250_c3_301 | 3722 | 8944 | 198 | 597 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24410937_f3_118 | 3723 | 8945 | 137 | 414 | 169 | 1.1e−12 |

| Protein name | Locus Name | Acc# |
|---|---|---|
| structural protein P5 | gp:AF155037 | AF155037 |

Description

*Alteromonas phage*, complete genome.

| ORF Name | NTID | AAID | NT Length | AA Length | Score | Probability |
|---|---|---|---|---|---|---|
| 24495875_f2_93 | 3724 | 8946 | 259 | 780 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24626325_c3_315 | 3725 | 8947 | 1496 | 4491 | 157 | 5.2e−08 |

| Protein name | Locus Name | Acc# |
|---|---|---|
| putative histidine kinase | gp:AF036964 | AF036964 |

Description

*Lactobacillus sake* putative response regulator (rrp1) and putative histidine kinase (hpk1) genes, complete cds.

| ORF Name | NTID | AAID | NT Length | AA Length | Score | Probability |
|---|---|---|---|---|---|---|
| 24640875_c1_219 | 3726 | 8948 | 329 | 990 | 234 | 5.4e−18 |

| Protein name | Locus Name | Acc# |
|---|---|---|
| processing proteinase sll2009:protein sll2009:protein sll2009 | pir:S77156 | S77156 |

Description

-continued

| ORF Name | NTID | AAID | NT Length | AA Length | Score | Probability |
|---|---|---|---|---|---|---|
| 24640938_f2_85 | 3727 | 8949 | 318 | 957 | 829 | 1.2e−82 |

| Protein name | Locus Name | Acc# |
|---|---|---|
| hypothetical protein | gp:AF088897 | |

Description

*Zymomonas mobilis* cosmid clone 65G3, partial sequence.

| ORF Name | NTID | AAID | NT Length | AA Length | Score | Probability |
|---|---|---|---|---|---|---|
| 24642257_f1_35 | 3728 | 8950 | 238 | 717 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24644067_c1_180 | 3729 | 8951 | 344 | 1035 | 469 | 1.8e−44 |

| Protein name | Locus Name | Acc# |
|---|---|---|
| ferric enterobactin transport ATP-binding | gp:U67531 | |

Description

*Methanococcus jannaschii* section 73 of 150 of the complete genome.

| ORF Name | NTID | AAID | NT Length | AA Length | Score | Probability |
|---|---|---|---|---|---|---|
| 24647032_c3_294 | 3730 | 8952 | 725 | 2178 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24647186_f1_34 | 3731 | 8953 | 428 | 1287 | 1159 | 1.3e−117 |

| Protein name | Locus Name | Acc# |
|---|---|---|
| | sp:GLYA_ECOLI | P00477 |

Description (SHMT)

| ORF Name | NTID | AAID | NT Length | AA Length | Score | Probability |
|---|---|---|---|---|---|---|
| 2519010_f1_31 | 3732 | 8954 | 467 | 1404 | 110 | 0.0040 |

| Protein name | Locus Name | Acc# |
|---|---|---|
| 53 kDa major outer membrane protein | gp:D31835 | D31835 |

Description

*Porphyromonas gingivalis* DNA for 53 kDa major outer membrane protein, complete cds.

-continued

| ORF Name | NTID | AAID | NT Length | AA Length | Score | Probability |
|---|---|---|---|---|---|---|
| 25429811_c3_274 | 3733 | 8955 | 468 | 1407 | 334 | 1.5e−31 |

| Protein name | Locus Name | Acc# |
|---|---|---|
| LisK | gp:AF139908 | AF139908 |

Description

*Listeria monocytogenes* lisR/lisK gene locus, complete sequence.

| ORF Name | NTID | AAID | NT Length | AA Length | Score | Probability |
|---|---|---|---|---|---|---|
| 25970057_f1_33 | 3734 | 8956 | 312 | 939 | 838 | 1.4e−83 |

| Protein name | Locus Name | Acc# |
|---|---|---|
| | sp:PYRB_VIBS2 | P96174 |

Description (TRANSCARBAMYLASE) (ATCASE)

| ORF Name | NTID | AAID | NT Length | AA Length | Score | Probability |
|---|---|---|---|---|---|---|
| 26370312_f3_162 | 3735 | 8957 | 300 | 903 | 345 | 2.4e−31 |

| Protein name | Locus Name | Acc# |
|---|---|---|
| probable dTDP-4-dehydrorhamnose reductase APE1179 | pir:G72588 | G72588 |

Description

| ORF Name | NTID | AAID | NT Length | AA Length | Score | Probability |
|---|---|---|---|---|---|---|
| 26595887_c1_224 | 3736 | 8958 | 244 | 735 | 166 | 2.3e−12 |

| Protein name | Locus Name | Acc# |
|---|---|---|
| probable two-component system response transcription regulator | pir:T36499 | T36499 |

Description

| ORF Name | NTID | AAID | NT Length | AA Length | Score | Probability |
|---|---|---|---|---|---|---|
| 26680261_f3_161 | 3737 | 8959 | 181 | 546 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 27175_c2_236 | 3738 | 8960 | 69 | 210 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 287518_f2_87 | 3739 | 8961 | 75 | 228 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 29789211_f3_146 | 3740 | 8962 | 72 | 219 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 3008468_f3_116 | 3741 | 8963 | 318 | 957 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 31439062_f1_21 | 3742 | 8964 | 447 | 1344 | 97 | 0.010 |

| Protein name | | | | Locus Name | | Acc# |
|---|---|---|---|---|---|---|
| VirM | | | | gp:ATTIA6NC1 | | AF039888 |

Description

*Agrobacterium tumefaciens* plasmid pTiA6NC VirM (virM) and VirL (virL) genes, complete cds.

| ORF Name | NTID | AAID | NT Length | AA Length | Score | Probability |
|---|---|---|---|---|---|---|
| 31667587_f2_81 | 3743 | 8965 | 451 | 1356 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 32228437_c3_285 | 3744 | 8966 | 706 | 2121 | 171 | 2.4e−15 |

| Protein name | | | | Locus Name | | Acc# |
|---|---|---|---|---|---|---|
| unknown | | | | gp:AF007381 | | AF007381 |

Description

*Flavobacterium johnsoniae* gliding motility protein (gldA) gene, complete cds; and unknown genes.

-continued

| ORF Name | NTID | AAID | NT Length | AA Length | Score | Probability |
|---|---|---|---|---|---|---|
| 32229687_c1_217 | 3745 | 8967 | 160 | 483 | 91 | 0.00022 |

| Protein name | Locus Name | Acc# |
|---|---|---|
| | sp:IHFA_HAEIN | P43723 |

Description

INTEGRATION HOST FACTOR ALPHA-SUBUNIT (IHF-ALPHA)

| ORF Name | NTID | AAID | NT Length | AA Length | Score | Probability |
|---|---|---|---|---|---|---|
| 33465_c3_275 | 3746 | 8968 | 233 | 702 | 187 | 1.3e−14 |

| Protein name | Locus Name | Acc# |
|---|---|---|
| | sp:YVBG_BACSU | O32244 |

Description

HYPOTHETICAL 22.6 KD PROTEIN IN OPUCA-ENO INTERGENIC REGION

| ORF Name | NTID | AAID | NT Length | AA Length | Score | Probability |
|---|---|---|---|---|---|---|
| 34163936_f1_43 | 3747 | 8969 | 536 | 1611 | 440 | 2.1e−41 |

| Protein name | Locus Name | Acc# |
|---|---|---|
| RprX | gp:S59000 | S59000 |

Description

| ORF Name | NTID | AAID | NT Length | AA Length | Score | Probability |
|---|---|---|---|---|---|---|
| 34275760_c3_310 | 3748 | 8970 | 135 | 408 | 147 | 2.2e−09 |

| Protein name | Locus Name | Acc# |
|---|---|---|
| processing proteinase:protein slr1331:protein slr1331 | pir:S75528 | S75528 |

Description

| ORF Name | NTID | AAID | NT Length | AA Length | Score | Probability |
|---|---|---|---|---|---|---|
| 36040712_c3_292 | 3749 | 8971 | 107 | 324 | 101 | 8.5e−05 |

| Protein name | Locus Name | Acc# |
|---|---|---|
| Hypothetical protein HI1452 | gp:D90724 | |

Description

*Escherichia coli* genomic DNA. (19.4–19.8 min).

| ORF Name | NTID | AAID | NT Length | AA Length | Score | Probability |
|---|---|---|---|---|---|---|
| 37575_c2_244 | 3750 | 8972 | 570 | 1713 | 1579 | 4.2e−162 |

| Protein name | Locus Name | Acc# |
|---|---|---|
| | sp:FTHS_CLOAC | P13419 |

Description (SYNTHETASE) (FHS) (FTHFS)

-continued

| ORF Name | NTID | AAID | NT Length | AA Length | Score | Probability |
|---|---|---|---|---|---|---|
| 4007776_f2_84 | 3751 | 8973 | 1095 | 3288 | 475 | 9.6e−78 |

| Protein name | Locus Name | Acc# |
|---|---|---|
| 115K outer membrane protein precursor:SusC protein | pir:JC6027 | JC6027 |

Description

| ORF Name | NTID | AAID | NT Length | AA Length | Score | Probability |
|---|---|---|---|---|---|---|
| 4409550_c2_249 | 3752 | 8974 | 74 | 225 | 125 | 5.0e−08 |

| Protein name | Locus Name | Acc# |
|---|---|---|
| hypothetical protein PH0719 | pir:H71118 | H71118 |

Description

| ORF Name | NTID | AAID | NT Length | AA Length | Score | Probability |
|---|---|---|---|---|---|---|
| 4484812_c2_267 | 3753 | 8975 | 407 | 1224 | 549 | 5.9e−53 |

| Protein name | Locus Name | Acc# |
|---|---|---|
| hypothetical protein slr1485 | pir:S74454 | S74454 |

Description

| ORF Name | NTID | AAID | NT Length | AA Length | Score | Probability |
|---|---|---|---|---|---|---|
| 4727126_f3_117 | 3754 | 8976 | 112 | 339 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4860263_f2_113 | 3755 | 8977 | 154 | 465 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4882187_c3_316 | 3756 | 8978 | 390 | 1173 | 276 | 7.8e−23 |

| Protein name | Locus Name | Acc# |
|---|---|---|
| transposase | gp:AF038866 | AF038866 |

Description

*Bacteroides fragilis* transposon Tn5520 transposase (bipH) and mobilization protein BmpH (bmpH) genes, complete cds.

| ORF Name | NTID | AAID | NT Length | AA Length | Score | Probability |
|---|---|---|---|---|---|---|
| 4957677_f3_160 | 3757 | 8979 | 266 | 801 | | |
| Protein name | | | Locus Name | | | Acc# |

Description

NO-HIT

| ORF Name | NTID | AAID | NT Length | AA Length | Score | Probability |
|---|---|---|---|---|---|---|
| 5116285_f2_112 | 3758 | 8980 | 585 | 1758 | 258 | 2.8e−21 |
| Protein name | | | Locus Name | | | Acc# |
| | | | sp:PA1G_HUMAN | | | Q15102 |

Description (SUBUNIT) (PAF-AH GAMMA SUBUNIT)

| ORF Name | NTID | AAID | NT Length | AA Length | Score | Probability |
|---|---|---|---|---|---|---|
| 546942_c3_293 | 3759 | 8981 | 79 | 240 | | |
| Protein name | | | Locus Name | | | Acc# |

Description

NO-HIT

| ORF Name | NTID | AAID | NT Length | AA Length | Score | Probability |
|---|---|---|---|---|---|---|
| 6538182_c1_179 | 3760 | 8982 | 106 | 321 | 183 | 8.2e−14 |
| Protein name | | | Locus Name | | | Acc# |
| | | | sp:BTUC_ECOLI | | | |

Description

VITAMIN B12 TRANSPORT SYSTEM PERMEASE PROTEIN BTUC

| ORF Name | NTID | AAID | NT Length | AA Length | Score | Probability |
|---|---|---|---|---|---|---|
| 6679652_f2_78 | 3761 | 8983 | 288 | 867 | 338 | 1.3e−30 |
| Protein name | | | Locus Name | | | Acc# |
| | | | sp:KDSB_HAEIN | | | P44490 |

Description (SYNTHETASE) (CMP-2-KETO-3-DEOXYOCTULOSONIC ACID SYNTHETASE) (CKS)

| ORF Name | NTID | AAID | NT Length | AA Length | Score | Probability |
|---|---|---|---|---|---|---|
| 9881327_f3_145 | 3762 | 8984 | 704 | 2115 | | |
| Protein name | | | Locus Name | | | Acc# |

Description

NO-HIT

-continued

| ORF Name | NTID | AAID | NT Length | AA Length | Score | Probability |
|---|---|---|---|---|---|---|
| 191552_f1_2 | 3763 | 8985 | 159 | 477 | 222 | 1.2e-17 |

| Protein name | Locus Name | Acc# |
|---|---|---|
| probable phospho-sugar mutase 2 | pir:E71082 | E71082 |

Description

| ORF Name | NTID | AAID | NT Length | AA Length | Score | Probability |
|---|---|---|---|---|---|---|
| 19812812_c1_4 | 3764 | 8986 | 136 | 408 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 3957142_f1_1 | 3765 | 8987 | 76 | 231 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 10322187_f1_86 | 3766 | 8988 | 219 | 660 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 1054553_c2_428 | 3767 | 8989 | 360 | 1083 | 368 | 8.9e-34 |

| Protein name | Locus Name | Acc# |
|---|---|---|
| conserved hypothetical protein aq_1630 | pir:F70440 | F70440 |

Description

| ORF Name | NTID | AAID | NT Length | AA Length | Score | Probability |
|---|---|---|---|---|---|---|
| 10557192_f1_32 | 3768 | 8990 | 78 | 237 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 11726391_c3_547 | 3769 | 8991 | 154 | 465 | 538 | 8.6e-52 |

| Protein name | Locus Name | Acc# |
|---|---|---|
| putative UDP-GlcNAc:undecaprenylphosphate | gp:AF048749 | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 1178127_f1_9 | 3770 | 8992 | 374 | 1125 | 972 | 8.8e−98 |

| Protein name | | Locus Name | Acc# |
|---|---|---|---|
| | | sp:AROC_SYNY3 | P23353 |

Description (PHOSPHOLYASE)

| ORF Name | NTID | AAID | NT Length | AA Length | Score | Probability |
|---|---|---|---|---|---|---|
| 1226412_f2_170 | 3771 | 8993 | 370 | 1113 | 160 | 6.6e−09 |

| Protein name | | Locus Name | Acc# |
|---|---|---|---|
| GumF protein | | pir:S67855 | S67855 |

Description

| ORF Name | NTID | AAID | NT Length | AA Length | Score | Probability |
|---|---|---|---|---|---|---|
| 12363467_f2_195 | 3772 | 8994 | 158 | 477 | | |

| Protein name | | Locus Name | Acc# |
|---|---|---|---|

Description

NO-HIT

| ORF Name | NTID | AAID | NT Length | AA Length | Score | Probability |
|---|---|---|---|---|---|---|
| 13009675_c3_590 | 3773 | 8995 | 913 | 2742 | | |

| Protein name | | Locus Name | Acc# |
|---|---|---|---|

Description

NO-HIT

| ORF Name | NTID | AAID | NT Length | AA Length | Score | Probability |
|---|---|---|---|---|---|---|
| 14548187_c2_452 | 3774 | 8996 | 376 | 1131 | 136 | 2.0e−08 |

| Protein name | | Locus Name | Acc# |
|---|---|---|---|
| | | sp:VAPI_BACNO | Q46560 |

Description

VIRULENCE-ASSOCIATED PROTEIN I

| ORF Name | NTID | AAID | NT Length | AA Length | Score | Probability |
|---|---|---|---|---|---|---|
| 14645152_f1_111 | 3775 | 8997 | 64 | 195 | | |

| Protein name | | Locus Name | Acc# |
|---|---|---|---|

Description

NO-HIT

| ORF Name | NTID | AAID | NT Length | AA Length | Score | Probability |
|---|---|---|---|---|---|---|
| 14728887__f2__213 | 3776 | 8998 | 412 | 1239 | 835 | 2.9e−83 |

| Protein name | Locus Name | Acc# |
|---|---|---|
| conserved hypothetical protein | pir:H72377 | H72377 |

Description

| ORF Name | NTID | AAID | NT Length | AA Length | Score | Probability |
|---|---|---|---|---|---|---|
| 14938777__c2__427 | 3777 | 8999 | 213 | 642 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 156500__c1__372 | 3778 | 9000 | 122 | 369 | 205 | 1.7e−16 |

| Protein name | Locus Name | Acc# |
|---|---|---|
| ribosomal protein S06 | pir:G70305 | G70305 |

Description

| ORF Name | NTID | AAID | NT Length | AA Length | Score | Probability |
|---|---|---|---|---|---|---|
| 15650915__f2__210 | 3779 | 9001 | 510 | 1533 | 311 | 4.2e−36 |

| Protein name | Locus Name | Acc# |
|---|---|---|
| hypothetical protein TM1421 | pir:B72256 | B72256 |

Description

| ORF Name | NTID | AAID | NT Length | AA Length | Score | Probability |
|---|---|---|---|---|---|---|
| 16446002__c3__545 | 3780 | 9002 | 801 | 2406 | 901 | 1.0e−101 |

| Protein name | Locus Name | Acc# |
|---|---|---|
| hypothetical protein Rv0584 | pir:G70934 | G70934 |

Description

| ORF Name | NTID | AAID | NT Length | AA Length | Score | Probability |
|---|---|---|---|---|---|---|
| 16603388__c2__447 | 3781 | 9003 | 181 | 546 | 402 | 2.2e−37 |

| Protein name | Locus Name | Acc# |
|---|---|---|
| BsaA | gp:AB013377 | AB013377 |

Description

*Bacillus halodurans* C-125 comGB and bsaA genes and tRNA-His, Ala, Arg, Gly and Tyr genes, complete and partial cds.

| ORF Name | NTID | AAID | NT Length | AA Length | Score | Probability |
|---|---|---|---|---|---|---|
| 17010942_c1_337 | 3782 | 9004 | 787 | 2364 | 1111 | 1.6e−112 |

| Protein name | Locus Name | Acc# |
|---|---|---|
| beta-galactosidase,:lactase | pir:JC5618 | JC5618 |

Description

| ORF Name | NTID | AAID | NT Length | AA Length | Score | Probability |
|---|---|---|---|---|---|---|
| 176561_c1_416 | 3783 | 9005 | 359 | 1080 | 600 | 2.3e−58 |

| Protein name | Locus Name | Acc# |
|---|---|---|
| hypothetical protein slr1772 | pir:S74628 | S74628 |

Description

| ORF Name | NTID | AAID | NT Length | AA Length | Score | Probability |
|---|---|---|---|---|---|---|
| 191552_c3_532 | 3784 | 9006 | 471 | 1416 | 687 | 1.4e−67 |

| Protein name | Locus Name | Acc# |
|---|---|---|
| probable phospho-sugar mutase 2 | pir:E71082 | E71082 |

Description

| ORF Name | NTID | AAID | NT Length | AA Length | Score | Probability |
|---|---|---|---|---|---|---|
| 20192257_f1_105 | 3785 | 9007 | 304 | 915 | 281 | 1.5e−24 |

| Protein name | Locus Name | Acc# |
|---|---|---|
|  | gp:STALYTS | L42945 |

Description

*Staphylococcus aureus* lytS and lytR genes, complete cds.

| ORF Name | NTID | AAID | NT Length | AA Length | Score | Probability |
|---|---|---|---|---|---|---|
| 2031317_f1_99 | 3786 | 9008 | 85 | 258 |  |  |

| Protein name | Locus Name | Acc# |
|---|---|---|
|  |  |  |

Description

NO-HIT

| ORF Name | NTID | AAID | NT Length | AA Length | Score | Probability |
|---|---|---|---|---|---|---|
| 20509682_f1_82 | 3787 | 9009 | 293 | 882 | 162 | 1.3e−09 |

| Protein name | Locus Name | Acc# |
|---|---|---|
| transmembrane sensor | gp:AF051691 | AF051691 |

Description

*Pseudomonas aeruginosa* stress factor A (psfA), ECF sigma factor (fiuI), transmembrane sensor (fiuR), and hydroxamate-typeferrisiderophore receptor (fiuA) genes, complete cds.

-continued

| ORF Name | NTID | AAID | NT Length | AA Length | Score | Probability |
|---|---|---|---|---|---|---|
| 20523966_f2_208 | 3788 | 9010 | 369 | 1110 | 240 | 9.8e−18 |

| Protein name | Locus Name | Acc# |
|---|---|---|
| | sp:YEHU_ECOLI | |

Description

HYPOTHETICAL 62.1 KD PROTEIN IN MOLR-BGLX INTERGENIC REGION PRECURSOR

| ORF Name | NTID | AAID | NT Length | AA Length | Score | Probability |
|---|---|---|---|---|---|---|
| 20704802_c1_402 | 3789 | 9011 | 465 | 1398 | 465 | 4.7e−44 |

| Protein name | Locus Name | Acc# |
|---|---|---|
| conserved hypothetical protein | pir:G72220 | G72220 |

Description

| ORF Name | NTID | AAID | NT Length | AA Length | Score | Probability |
|---|---|---|---|---|---|---|
| 2110137_c1_359 | 3790 | 9012 | 118 | 357 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 22114756_f1_31 | 3791 | 9013 | 532 | 1599 | 512 | 4.9e−49 |

| Protein name | Locus Name | Acc# |
|---|---|---|
| hypothetical protein jhp1110 | pir:A71849 | A71849 |

Description

| ORF Name | NTID | AAID | NT Length | AA Length | Score | Probability |
|---|---|---|---|---|---|---|
| 22300006_f1_33 | 3792 | 9014 | 169 | 510 | 81 | 0.0040 |

| Protein name | Locus Name | Acc# |
|---|---|---|
| DbhB | gp:AF110185 | AF110185 |

Description

*Burkholderia pseudomallei* strain 1026b DbhB (dbhB), general secretory pathway protein D (gspD), general secretory pathway protein E (gspE), general secretory pathway protein F (gspF), GspC (gspC), general secretory pathway protein G (gspG), general secretory pathway protein H (gspH), general secretory pathway protein I (gspI), general secretory pathway protein J

| ORF Name | NTID | AAID | NT Length | AA Length | Score | Probability |
|---|---|---|---|---|---|---|
| 22910052_f3_310 | 3793 | 9015 | 145 | 438 | 290 | 3.2e−24 |

| Protein name | Locus Name | Acc# |
|---|---|---|
| | sp:HELA_LEGPN | Q48815 |

Description

HELA PROTEIN

-continued

| ORF Name | NTID | AAID | NT Length | AA Length | Score | Probability |
|---|---|---|---|---|---|---|
| 22915938_c1_408 | 3794 | 9016 | 240 | 723 | 86 | 0.0040 |

| Protein name | Locus Name | Acc# |
|---|---|---|
| hypothetical protein APE0978 | pir:B72695 | B72695 |

Description

| ORF Name | NTID | AAID | NT Length | AA Length | Score | Probability |
|---|---|---|---|---|---|---|
| 23470135_f3_270 | 3795 | 9017 | 779 | 2340 | 695 | 7.6e−108 |

| Protein name | Locus Name | Acc# |
|---|---|---|
| | sp:HEXA_PORGI | P49008 |

Description (BETA-NAHASE)

| ORF Name | NTID | AAID | NT Length | AA Length | Score | Probability |
|---|---|---|---|---|---|---|
| 23538425_f3_285 | 3796 | 9018 | 580 | 1743 | 561 | 1.4e−62 |

| Protein name | Locus Name | Acc# |
|---|---|---|
| long-chain-fatty-acid CoA ligase | pir:D70386 | D70386 |

Description

| ORF Name | NTID | AAID | NT Length | AA Length | Score | Probability |
|---|---|---|---|---|---|---|
| 23601701_f3_289 | 3797 | 9019 | 69 | 210 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 23625912_f3_280 | 3798 | 9020 | 477 | 1434 | 127 | 2.8e−07 |

| Protein name | Locus Name | Acc# |
|---|---|---|
| | gp:YP102KB | AL031866 |

Description

*Yersinia pestis* 102 kbases unstable region: from 1 to 119443.

| ORF Name | NTID | AAID | NT Length | AA Length | Score | Probability |
|---|---|---|---|---|---|---|
| 23627187_c1_420 | 3799 | 9021 | 423 | 1272 | 158 | 1.0e−08 |

| Protein name | Locus Name | Acc# |
|---|---|---|
| | sp:FECR_ECOLI | P23485 |

Description

FECR PROTEIN

-continued

| ORF Name | NTID | AAID | NT Length | AA Length | Score | Probability |
|---|---|---|---|---|---|---|
| 23945430_c3_604 | 3800 | 9022 | 743 | 2232 | 228 | 1.0e−27 |
| Protein name | | | Locus Name | | | Acc# |
| conserved hypothetical protein ylbK | | | pir:H69874 | | | H69874 |
| Description | | | | | | |

| ORF Name | NTID | AAID | NT Length | AA Length | Score | Probability |
|---|---|---|---|---|---|---|
| 24072712_c3_613 | 3801 | 9023 | 196 | 591 | 138 | 2.1e−09 |
| Protein name | | | Locus Name | | | Acc# |
| hypothetical protein sll0687 | | | pir:S74416 | | | S74416 |
| Description | | | | | | |

| ORF Name | NTID | AAID | NT Length | AA Length | Score | Probability |
|---|---|---|---|---|---|---|
| 24391562_f3_272 | 3802 | 9024 | 437 | 1314 | 327 | 2.0e−29 |
| Protein name | | | Locus Name | | | Acc# |
| N-acetylmuramoyl-L-alanine amidase | | | pir:G70445 | | | G70445 |
| Description | | | | | | |

| ORF Name | NTID | AAID | NT Length | AA Length | Score | Probability |
|---|---|---|---|---|---|---|
| 24398402_c3_564 | 3803 | 9025 | 98 | 297 | 225 | 1.3e−18 |
| Protein name | | | Locus Name | | | Acc# |
| | | | sp:RS18_BACST | | | P10806 |
| Description | | | | | | |

30S RIBOSOMAL PROTEIN S18 (BS21)

| ORF Name | NTID | AAID | NT Length | AA Length | Score | Probability |
|---|---|---|---|---|---|---|
| 24407802_c3_617 | 3804 | 9026 | 447 | 1344 | 164 | 1.0e−08 |
| Protein name | | | Locus Name | | | Acc# |
| | | | sp:NANH_MICVI | | | Q02834 |
| Description | | | | | | |

SIALIDASE PRECURSOR, (NEURAMINIDASE)

| ORF Name | NTID | AAID | NT Length | AA Length | Score | Probability |
|---|---|---|---|---|---|---|
| 24615811_f1_10 | 3805 | 9027 | 458 | 1377 | 1028 | 1.0e−103 |
| Protein name | | | Locus Name | | | Acc# |
| ArgE/DapE/Acyl family protein | | | pir:E75324 | | | E75324 |
| Description | | | | | | |

-continued

| ORF Name | NTID | AAID | NT Length | AA Length | Score | Probability |
|---|---|---|---|---|---|---|
| 24645311_f1_52 | 3806 | 9028 | 299 | 900 | 147 | 6.9e−08 |

| Protein name | Locus Name | Acc# |
|---|---|---|
| hypothetical protein aq_1533 | pir:A70433 | A70433 |

Description

| ORF Name | NTID | AAID | NT Length | AA Length | Score | Probability |
|---|---|---|---|---|---|---|
| 24648437_f1_103 | 3807 | 9029 | 297 | 894 | 211 | 1.0e−15 |

| Protein name | Locus Name | Acc# |
|---|---|---|
| acriflavin resistance protein AcrE | pir:A70361 | A70361 |

Description

| ORF Name | NTID | AAID | NT Length | AA Length | Score | Probability |
|---|---|---|---|---|---|---|
| 24650287_c3_534 | 3808 | 9030 | 400 | 1203 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24660412_f3_325 | 3809 | 9031 | 350 | 1053 | 609 | 2.6e−59 |

| Protein name | Locus Name | Acc# |
|---|---|---|
| hypothetical protein TM1269 | pir:D72274 | D72274 |

Description

| ORF Name | NTID | AAID | NT Length | AA Length | Score | Probability |
|---|---|---|---|---|---|---|
| 24706575_c2_496 | 3810 | 9032 | 63 | 192 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24707287_c1_376 | 3811 | 9033 | 349 | 1050 | 894 | 1.6e−89 |

| Protein name | Locus Name | Acc# |
|---|---|---|
| | gp:PGU60208 | U60208 |

Description

*Porphyromonas gingivalis* orf1, orf2 and orf3 genes, complete cds.

-continued

| ORF Name | NTID | AAID | NT Length | AA Length | Score | Probability |
|---|---|---|---|---|---|---|
| 24804187_f2_179 | 3812 | 9034 | 76 | 231 | 91 | 0.0011 |
| Protein name | | | Locus Name | | | Acc# |
| sodium channel protein | | | gp:DVU26718 | | | U26718 |

Description

*Drosophila virilis* sodium channel protein (para) gene, exons 1, 2, 3, 4, and optional segment i, partial cds.

| ORF Name | NTID | AAID | NT Length | AA Length | Score | Probability |
|---|---|---|---|---|---|---|
| 24806501_f2_190 | 3813 | 9035 | 146 | 441 | 71 | 0.038 |
| Protein name | | | Locus Name | | | Acc# |
| hypothetical protein BBA32 | | | pir:H70210 | | | H70210 |

Description

| ORF Name | NTID | AAID | NT Length | AA Length | Score | Probability |
|---|---|---|---|---|---|---|
| 2533590_f2_196 | 3814 | 9036 | 82 | 249 | 68 | 0.034 |
| Protein name | | | Locus Name | | | Acc# |
| cellulose synthase | | | pir:I39714 | | | I39714 |

Description

| ORF Name | NTID | AAID | NT Length | AA Length | Score | Probability |
|---|---|---|---|---|---|---|
| 25431562_c1_371 | 3815 | 9037 | 237 | 714 | 1212 | 3.2e−123 |
| Protein name | | | Locus Name | | | Acc# |
| rprY protein | | | pir:S33662 | | | S33662 |

Description

| ORF Name | NTID | AAID | NT Length | AA Length | Score | Probability |
|---|---|---|---|---|---|---|
| 25520626_c1_375 | 3816 | 9038 | 449 | 1350 | 776 | 5.2e−77 |
| Protein name | | | Locus Name | | | Acc# |
| | | | sp:YQEV_BACSU | | | P54462 |

Description

HYPOTHETICAL 51.7 KD PROTEIN IN DNAJ-RPSU INTERGENIC REGION

| ORF Name | NTID | AAID | NT Length | AA Length | Score | Probability |
|---|---|---|---|---|---|---|
| 25674157_c1_378 | 3817 | 9039 | 81 | 246 | | |
| Protein name | | | Locus Name | | | Acc# |

Description

NO-HIT

-continued

| ORF Name | NTID | AAID | NT Length | AA Length | Score | Probability |
|---|---|---|---|---|---|---|
| 25975012_c1_393 | 3818 | 9040 | 311 | 936 | 158 | 4.8e−09 |

| Protein name | Locus Name | Acc# |
|---|---|---|
| sodium-dependent transporter homolog yocS | pir:E69902 | E69902 |

Description

| ORF Name | NTID | AAID | NT Length | AA Length | Score | Probability |
|---|---|---|---|---|---|---|
| 2626655_c2_462 | 3819 | 9041 | 159 | 480 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 26306507_c3_607 | 3820 | 9042 | 633 | 1902 | 1817 | 2.5e−187 |

| Protein name | Locus Name | Acc# |
|---|---|---|
| | sp:MUTB_PORGI | Q59676 |

Description

METHYLMALONYL-COA MUTASE ALPHA-SUBUNIT, (MCM-ALPHA)

| ORF Name | NTID | AAID | NT Length | AA Length | Score | Probability |
|---|---|---|---|---|---|---|
| 26366555_f3_326 | 3821 | 9043 | 476 | 1431 | 1177 | 1.7e−119 |

| Protein name | Locus Name | Acc# |
|---|---|---|
| hypothetical protein TM1267 | Pir:B72274 | B72274 |

Description

| ORF Name | NTID | AAID | NT Length | AA Length | Score | Probability |
|---|---|---|---|---|---|---|
| 26370302_f2_152 | 3822 | 9044 | 449 | 1350 | 1232 | 2.5e−125 |

| Protein name | Locus Name | Acc# |
|---|---|---|
| | sp:G6PA_BACST | P13375 |

Description

ISOMERASE A)

| ORF Name | NTID | AAID | NT Length | AA Length | Score | Probability |
|---|---|---|---|---|---|---|
| 26642932_c2_450 | 3823 | 9045 | 50 | 183 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 2864693_f3_306 | 3824 | 9046 | 442 | 1329 | 340 | 3.5e−62 |

| Protein name | | | Locus Name | | | Acc# |
|---|---|---|---|---|---|---|
| | | | sp:QUEA_ECOLI | | | P21516 |

Description (QUEUOSINE BIOSYNTHESIS PROTEIN QUEA)

| ORF Name | NTID | AAID | NT Length | AA Length | Score | Probability |
|---|---|---|---|---|---|---|
| 29423910_c2_522 | 3825 | 9047 | 81 | 246 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 31260938_f3_261 | 3826 | 9048 | 591 | 1776 | 1242 | 2.1e−126 |

| Protein name | | | Locus Name | | | Acc# |
|---|---|---|---|---|---|---|
| | | | sp:SYK_BACSU | | | P37477 |

Description

LYSYL-TRNA SYNTHETASE, (LYSINE-TRNA LIGASE) (LYSRS)

| ORF Name | NTID | AAID | NT Length | AA Length | Score | Probability |
|---|---|---|---|---|---|---|
| 31289536_f2_164 | 3827 | 9049 | 110 | 333 | 83 | 0.0014 |

| Protein name | | | Locus Name | | | Acc# |
|---|---|---|---|---|---|---|
| cytochrome oxidase I | | | gp:AF072662 | | | AF072662 |

Description

*Exoneurella eremophila* cytochrome oxidase I gene, mitochondrial gene encoding mitochondrial protein, partial cds.

| ORF Name | NTID | AAID | NT Length | AA Length | Score | Probability |
|---|---|---|---|---|---|---|
| 31428541_f3_292 | 3828 | 9050 | 183 | 552 | 126 | 5.7e−06 |

| Protein name | | | Locus Name | | | Acc# |
|---|---|---|---|---|---|---|
| | | | sp:YHA2_EIKCO | | | P35649 |

Description

HYPOTHETICAL 66.3 KD PROTEIN IN HAG2 5' REGION

| ORF Name | NTID | AAID | NT Length | AA Length | Score | Probability |
|---|---|---|---|---|---|---|
| 31755000_f1_29 | 3829 | 9051 | 567 | 1704 | 1079 | 4.0e−109 |

| Protein name | | | Locus Name | | | Acc# |
|---|---|---|---|---|---|---|
| | | | sp:YIDE_HAEIN | | | P44472 |

Description

HYPOTHETICAL PROTEIN HI0035

-continued

| ORF Name | NTID | AAID | NT Length | AA Length | Score | Probability |
|---|---|---|---|---|---|---|
| 31808567_c3_568 | 3830 | 9052 | 311 | 936 | 160 | 3.1e−09 |

| Protein name | Locus Name | Acc# |
|---|---|---|
| probable lipid A biosynthesis acyltransferase | pir:H71954 | H71954 |

Description

| ORF Name | NTID | AAID | NT Length | AA Length | Score | Probability |
|---|---|---|---|---|---|---|
| 33397175_c2_529 | 3831 | 9053 | 633 | 1902 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 33787877_c1_358 | 3832 | 9054 | 354 | 1065 | 122 | 0.00032 |

| Protein name | Locus Name | Acc# |
|---|---|---|
| MutS-like protein | gp:SATRXA | AJ223480 |

Description

*Staphylococcus aureus* trxA and uvrC genes and partial mutS and dhsC genes.

| ORF Name | NTID | AAID | NT Length | AA Length | Score | Probability |
|---|---|---|---|---|---|---|
| 3385890_c3_587 | 3833 | 9055 | 161 | 486 | 99 | 0.0018 |

| Protein name | Locus Name | Acc# |
|---|---|---|
| hypothetical protein C56G2.15 | pir:T15873 | T15873 |

Description

| ORF Name | NTID | AAID | NT Length | AA Length | Score | Probability |
|---|---|---|---|---|---|---|
| 34165912_f3_307 | 3834 | 9056 | 177 | 534 | 175 | 2.5e−13 |

| Protein name | Locus Name | Acc# |
|---|---|---|
| probable isomerase | pir:B70986 | B70986 |

Description

| ORF Name | NTID | AAID | NT Length | AA Length | Score | Probability |
|---|---|---|---|---|---|---|
| 34406303_f1_87 | 3835 | 9057 | 191 | 576 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 34411051_f3_300 | 3836 | 9058 | 728 | 2187 | 134 | 5.3e−07 |

| Protein name | | | | Locus Name | | Acc# |
|---|---|---|---|---|---|---|
| | | | | gp:PGU60208 | | U60208 |

Description

*Porphyromonas gingivalis* orf1, orf2 and orf3 genes, complete cds.

| ORF Name | NTID | AAID | NT Length | AA Length | Score | Probability |
|---|---|---|---|---|---|---|
| 34417142_c1_414 | 3837 | 9059 | 717 | 2154 | 3088 | 0.0 |

| Protein name | | | | Locus Name | | Acc# |
|---|---|---|---|---|---|---|
| | | | | sp:MUTA_PORGI | | Q59677 |

Description

METHYLMALONYL-COA MUTASE BETA-SUBUNIT, (MCB-BETA)

| ORF Name | NTID | AAID | NT Length | AA Length | Score | Probability |
|---|---|---|---|---|---|---|
| 35661441_f3_251 | 3838 | 9060 | 72 | 219 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 36134657_f1_90 | 3839 | 9061 | 201 | 606 | 300 | 1.4e−26 |

| Protein name | | | | Locus Name | | Acc# |
|---|---|---|---|---|---|---|
| hypothetical protein PAB0910 | | | | pir:B75048 | | B75048 |

Description

| ORF Name | NTID | AAID | NT Length | AA Length | Score | Probability |
|---|---|---|---|---|---|---|
| 37562_c2_530 | 3840 | 9062 | 912 | 2736 | 506 | 5.4e−56 |

| Protein name | | | | Locus Name | | Acc# |
|---|---|---|---|---|---|---|
| 115K outer membrane protein precursor:SusC protein | | | | pir:JC6027 | | JC6027 |

Description

| ORF Name | NTID | AAID | NT Length | AA Length | Score | Probability |
|---|---|---|---|---|---|---|
| 37785_c3_611 | 3841 | 9063 | 264 | 795 | 107 | 0.00081 |

| Protein name | | | | Locus Name | | Acc# |
|---|---|---|---|---|---|---|
| hypothetical protein SCE39.30 | | | | pir:T36240 | | T36240 |

Description

-continued

| ORF Name | NTID | AAID | NT Length | AA Length | Score | Probability |
|---|---|---|---|---|---|---|
| 3944087_c2_451 | 3842 | 9064 | 392 | 1179 | 153 | 4.9e−10 |

| Protein name | Locus Name | Acc# |
|---|---|---|
| hypothetical protein c0115 | pir:S74051 | S74051 |

Description

| ORF Name | NTID | AAID | NT Length | AA Length | Score | Probability |
|---|---|---|---|---|---|---|
| 4068777_c2_463 | 3843 | 9065 | 578 | 1737 | 801 | 6.8e−84 |

| Protein name | Locus Name | Acc# |
|---|---|---|
| | sp:EFG_THETH | P13551 |

Description

ELONGATION FACTOR G (EF-G)

| ORF Name | NTID | AAID | NT Length | AA Length | Score | Probability |
|---|---|---|---|---|---|---|
| 4078910_c3_614 | 3844 | 9066 | 1175 | 3528 | 519 | 8.8e−60 |

| Protein name | Locus Name | Acc# |
|---|---|---|
| receptor antigen (RagA) | gp:PGI130872 | AJ130872 |

Description

*Porphyromonas gingivalis* W50 receptor antigen (rag) locus encoding a major immunodominant 55 kDa antigen.

| ORF Name | NTID | AAID | NT Length | AA Length | Score | Probability |
|---|---|---|---|---|---|---|
| 41562_c3_571 | 3845 | 9067 | 66 | 201 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 426657_c3_612 | 3846 | 9068 | 144 | 435 | 268 | 8.6e−22 |

| Protein name | Locus Name | Acc# |
|---|---|---|
| proline/pyrroline-5-carboxylate dehydrogenase | pir:B71980 | B71980 |

Description

| ORF Name | NTID | AAID | NT Length | AA Length | Score | Probability |
|---|---|---|---|---|---|---|
| 4329428_f3_265 | 3847 | 9069 | 245 | 738 | 255 | 8.4e−22 |

| Protein name | Locus Name | Acc# |
|---|---|---|
| | sp:YFBT_ECOLI | P77625 |

Description

HYPOTHETICAL 23.7 KD PROTEIN IN LRHA-ACKA INTERGENIC REGION

-continued

| ORF Name | NTID | AAID | NT Length | AA Length | Score | Probability |
|---|---|---|---|---|---|---|
| 4378530_f1_21 | 3848 | 9070 | 485 | 1458 | 468 | 2.2e−44 |

| Protein name | Locus Name | Acc# |
|---|---|---|
| probable glycosyl hydrolase | pir:T36467 | T36467 |

Description

| ORF Name | NTID | AAID | NT Length | AA Length | Score | Probability |
|---|---|---|---|---|---|---|
| 4532885_c3_593 | 3849 | 9071 | 171 | 516 | 96 | 0.0057 |

| Protein name | Locus Name | Acc# |
|---|---|---|
| putative outer surface protein | gp:BBU80960 | |

Description

*Borrelia burgdorferi* strain CA12 putative outer membrane protein (ospE) gene, complete cds and putative outer surface protein (ospF) gene, partial cds.

| ORF Name | NTID | AAID | NT Length | AA Length | Score | Probability |
|---|---|---|---|---|---|---|
| 4551635_f1_102 | 3850 | 9072 | 1285 | 3858 | 1850 | 1.7e−192 |

| Protein name | Locus Name | Acc# |
|---|---|---|
| czrA protein | gp:PACZR | Y14018 |

Description

*Pseudomonas aeruginosa* czrR, czrC, czrB, czrA genes, ORF5 and partial ORF6.

| ORF Name | NTID | AAID | NT Length | AA Length | Score | Probability |
|---|---|---|---|---|---|---|
| 4698910_f3_275 | 3851 | 9073 | 892 | 2679 | 476 | 3.4e−78 |

| Protein name | Locus Name | Acc# |
|---|---|---|
| ribonucleoside-diphosphate reductase, large chain nrd | pir:G69457 | G69457 |

Description

| ORF Name | NTID | AAID | NT Length | AA Length | Score | Probability |
|---|---|---|---|---|---|---|
| 4704675_f2_169 | 3852 | 9074 | 905 | 2718 | 1036 | 2.4e−145 |

| Protein name | Locus Name | Acc# |
|---|---|---|
| 4-alpha-glucanotransferase homolog T20B5.4 | pir:T00748 | T00748 |

Description

| ORF Name | NTID | AAID | NT Length | AA Length | Score | Probability |
|---|---|---|---|---|---|---|
| 4804537_f1_65 | 3853 | 9075 | 149 | 450 | 197 | 1.2e−15 |

| Protein name | Locus Name | Acc# |
|---|---|---|
| | sp:FOLB_BACSU | P28823 |

Description

DIHYDRONEOPTERIN ALDOLASE, (DHNA)

-continued

| ORF Name | NTID | AAID | NT Length | AA Length | Score | Probability |
|---|---|---|---|---|---|---|
| 4867188_c1_415 | 3854 | 9076 | 719 | 2160 | 883 | 2.4e−88 |

| Protein name | Locus Name | Acc# |
|---|---|---|
| | sp:TOP3_HAEIN | P43704 |

Description

DNA TOPOISOMERASE III,

| ORF Name | NTID | AAID | NT Length | AA Length | Score | Probability |
|---|---|---|---|---|---|---|
| 4882287_f2_188 | 3855 | 9077 | 385 | 1158 | 599 | 2.9e−58 |

| Protein name | Locus Name | Acc# |
|---|---|---|
| coproporphyrinogen oxidase, III, oxygen-independent hemN | pir:B69640 | B69640 |

Description

| ORF Name | NTID | AAID | NT Length | AA Length | Score | Probability |
|---|---|---|---|---|---|---|
| 4892261_c2_466 | 3856 | 9078 | 155 | 468 | 271 | 1.7e−23 |

| Protein name | Locus Name | Acc# |
|---|---|---|
| ribosomal protein L09 | pir:B70475 | B70475 |

Description

| ORF Name | NTID | AAID | NT Length | AA Length | Score | Probability |
|---|---|---|---|---|---|---|
| 4897125_f3_262 | 3857 | 9079 | 334 | 1005 | 403 | 1.7e−37 |

| Protein name | Locus Name | Acc# |
|---|---|---|
| | sp:GPDA_BACSU | P46919 |

Description

DEPENDENT DIHYDROXYACETONE-PHOSPHATE REDUCTASE)

| ORF Name | NTID | AAID | NT Length | AA Length | Score | Probability |
|---|---|---|---|---|---|---|
| 4975625_f1_91 | 3858 | 9080 | 128 | 387 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 5117763_c1_389 | 3859 | 9081 | 261 | 786 | 287 | 3.4e−25 |

| Protein name | Locus Name | Acc# |
|---|---|---|
| probable reductase APE1044 | pir:E72703 | E72703 |

Description

-continued

| ORF Name | NTID | AAID | NT Length | AA Length | Score | Probability |
|---|---|---|---|---|---|---|
| 5859380_f3_288 | 3860 | 9082 | 173 | 522 | 136 | 3.4e-09 |

| Protein name | | | | Locus Name | | Acc# |
|---|---|---|---|---|---|---|
| unknown | | | | gp:AF095748 | | AF095748 |

Description

*Burkholderia cepacia* principal sigma factor (sigA), phthalate dioxygenase reductase (ophA1), putative phthalate permease N-terminal region, putative phathalate permease C-terminal region (ophD), 4,5-dihydroxyphthalate decarboxylase (ophC), phthalate-inducible quinolinate phosphoribosyl transferase (ophE), transposase (tnp), phthalate dihydrodiol dehydrogenase

| ORF Name | NTID | AAID | NT Length | AA Length | Score | Probability |
|---|---|---|---|---|---|---|
| 5866512_c3_531 | 3861 | 9083 | 226 | 681 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 6031717_c1_370 | 3862 | 9084 | 154 | 465 | 321 | 6.3e-28 |

| Protein name | | | | Locus Name | | Acc# |
|---|---|---|---|---|---|---|
| translation elongation factor G | | | | pir:H72227 | | H72227 |

Description

| ORF Name | NTID | AAID | NT Length | AA Length | Score | Probability |
|---|---|---|---|---|---|---|
| 6136675_c3_561 | 3863 | 9085 | 527 | 1584 | 2624 | 7.7e-273 |

| Protein name | | | | Locus Name | | Acc# |
|---|---|---|---|---|---|---|
| RprX | | | | gp:S59000 | | S59000 |

Description

| ORF Name | NTID | AAID | NT Length | AA Length | Score | Probability |
|---|---|---|---|---|---|---|
| 625087_f1_53 | 3864 | 9086 | 488 | 1467 | 700 | 8.9e-78 |

| Protein name | | | | Locus Name | | Acc# |
|---|---|---|---|---|---|---|
| | | | | sp:DNAA_BACSU | | P05648 |

Description

CHROMOSOMAL REPLICATION INITIATOR PROTEIN DNAA

| ORF Name | NTID | AAID | NT Length | AA Length | Score | Probability |
|---|---|---|---|---|---|---|
| 6447131_f1_44 | 3865 | 9087 | 221 | 666 | 669 | 1.1e-65 |

| Protein name | | | | Locus Name | | Acc# |
|---|---|---|---|---|---|---|
| | | | | sp:UNG_HUMAN | | P13051 |

Description

URACIL-DNA GLYCOSYLASE PRECURSOR, (UDG)

-continued

| ORF Name | NTID | AAID | NT Length | AA Length | Score | Probability |
|---|---|---|---|---|---|---|
| 6454837_c2_477 | 3866 | 9088 | 176 | 531 | 352 | 4.4e−32 |

| Protein name | Locus Name | Acc# |
|---|---|---|
| methylglyoxal synthase | pir:G72284 | G72284 |

Description

| ORF Name | NTID | AAID | NT Length | AA Length | Score | Probability |
|---|---|---|---|---|---|---|
| 6829387_f2_189 | 3867 | 9089 | 189 | 570 | 176 | 2.0e−13 |

| Protein name | Locus Name | Acc# |
|---|---|---|
| probable RNA polymerase sigma-24 factor (rpoE) | pir:E71368 | E71368 |

Description

| ORF Name | NTID | AAID | NT Length | AA Length | Score | Probability |
|---|---|---|---|---|---|---|
| 6837762_c2_502 | 3868 | 9090 | 179 | 540 | 167 | 1.8e−12 |

| Protein name | Locus Name | Acc# |
|---|---|---|
| | sp:Y778_METJA | Q58188 |

Description

HYPOTHETICAL PROTEIN MJ0778

| ORF Name | NTID | AAID | NT Length | AA Length | Score | Probability |
|---|---|---|---|---|---|---|
| 954787_f1_43 | 3869 | 9091 | 375 | 1128 | 828 | 1.6e−82 |

| Protein name | Locus Name | Acc# |
|---|---|---|
| | sp:ASNA_HAEIN | P44338 |

Description

ASPARTATE-AMMONIA LIGASE, (ASPARAGINE SYNTHETASE A)

| ORF Name | NTID | AAID | NT Length | AA Length | Score | Probability |
|---|---|---|---|---|---|---|
| 9782217_f2_145 | 3870 | 9092 | 211 | 636 | 84 | 0.047 |

| Protein name | Locus Name | Acc# |
|---|---|---|
| | sp:Y804_HAEIN | P44053 |

Description

HYPOTHETICAL PROTEIN HI0804

| ORF Name | NTID | AAID | NT Length | AA Length | Score | Probability |
|---|---|---|---|---|---|---|
| 11720063_c3_96 | 3871 | 9093 | 519 | 1560 | 695 | 2.0e−68 |

| Protein name | Locus Name | Acc# |
|---|---|---|
| alpha galactosidase precursor | gp:AF061331 | AF061331 |

Description

*Saccharopolyspora erythraea* alpha galactosidase precursor (melA) gene, complete cds.

-continued

| ORF Name | NTID | AAID | NT Length | AA Length | Score | Probability |
|---|---|---|---|---|---|---|
| 12688787_f3_50 | 3872 | 9094 | 167 | 504 | 215 | 1.4e-17 |
| Protein name | | | Locus Name | | Acc# | |
| cytidine deaminase | | | gp:BCA237979 | | AJ237979 | |
| Description | | | | | | |

*Bacillus caldolyticus* cdd gene for cytidine deaminase.

| ORF Name | NTID | AAID | NT Length | AA Length | Score | Probability |
|---|---|---|---|---|---|---|
| 12773337_c1_77 | 3873 | 9095 | 426 | 1281 | 142 | 1.1e-06 |
| Protein name | | | Locus Name | | Acc# | |
| conserved hypothetical protein yknZ | | | pir:E69858 | | E69858 | |
| Description | | | | | | |

| ORF Name | NTID | AAID | NT Length | AA Length | Score | Probability |
|---|---|---|---|---|---|---|
| 13845217_f3_57 | 3874 | 9096 | 81 | 246 | | |
| Protein name | | | Locus Name | | Acc# | |
| Description | | | | | | |

NO-HIT

| ORF Name | NTID | AAID | NT Length | AA Length | Score | Probability |
|---|---|---|---|---|---|---|
| 14569175_f3_55 | 3875 | 9097 | 329 | 990 | 401 | 2.8e-37 |
| Protein name | | | Locus Name | | Acc# | |
| unknown | | | gp:AF083252 | | AF083252 | |
| Description | | | | | | |

*Pseudomonas aeruginosa* enoyl-CoA hydratase gene, partial cds; pilinbiosynthetic protein (fimL) gene, complete cds; and unknown gene.

| ORF Name | NTID | AAID | NT Length | AA Length | Score | Probability |
|---|---|---|---|---|---|---|
| 21665630_f2_34 | 3876 | 9098 | 213 | 642 | 448 | 3.0e-42 |
| Protein name | | | Locus Name | | Acc# | |
| | | | sp:YKGB_HAEIN | | P44577 | |
| Description | | | | | | |

HYPOTHETICAL PROTEIN HI0219

| ORF Name | NTID | AAID | NT Length | AA Length | Score | Probability |
|---|---|---|---|---|---|---|
| 22144041_f2_33 | 3877 | 9099 | 287 | 864 | 233 | 1.8e-19 |
| Protein name | | | Locus Name | | Acc# | |
| pobR protein | | | gp:PPU251792 | | AJ251792 | |
| Description | | | | | | |

*Pseudomonas putida* pobR gene for PobR protein and pobA gene for PobA protein

-continued

| ORF Name | NTID | AAID | NT Length | AA Length | Score | Probability |
|---|---|---|---|---|---|---|
| 22305443_c3_94 | 3878 | 9100 | 478 | 1437 | 123 | 0.00026 |

| Protein name | | | | Locus Name | | Acc# |
|---|---|---|---|---|---|---|
| unknown | | | | gp:U96771 | | U96771 |

Description

*Prevotella bryantii* putative polygalacturonase, B-1,4-endoglucanase, and mannanase genes, complete cds; and unknown genes.

| ORF Name | NTID | AAID | NT Length | AA Length | Score | Probability |
|---|---|---|---|---|---|---|
| 2379442_f1_13 | 3879 | 9101 | 467 | 1404 | 970 | 1.4e−97 |

| Protein name | | | | Locus Name | | Acc# |
|---|---|---|---|---|---|---|
| | | | | s:YKGC_ECOLI | | P77212 |

Description

INTERGENIC REGION

| ORF Name | NTID | AAID | NT Length | AA Length | Score | Probability |
|---|---|---|---|---|---|---|
| 24095327_c3_106 | 3880 | 9102 | 299 | 900 | 627 | 3.2e−61 |

| Protein name | | | | Locus Name | | Acc# |
|---|---|---|---|---|---|---|
| hemagglutinin | | | | gp:AF017417 | | AF017417 |

Description

*Prevotella intermedia* hemagglutinin (phg) gene, complete cds.

| ORF Name | NTID | AAID | NT Length | AA Length | Score | Probability |
|---|---|---|---|---|---|---|
| 24642687_c1_66 | 3881 | 9103 | 300 | 903 | 547 | 9.5e−53 |

| Protein name | | | | Locus Name | | Acc# |
|---|---|---|---|---|---|---|
| | | | | sp:DCHS_CLOPE | | P04194 |

Description

HISTIDINE DECARBOXYLASE PROENZYME PRECURSOR, (PI CHAIN)

| ORF Name | NTID | AAID | NT Length | AA Length | Score | Probability |
|---|---|---|---|---|---|---|
| 24719017_c3_95 | 3882 | 9104 | 156 | 471 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 2587908_c3_109 | 3883 | 9105 | 430 | 1293 | 182 | 4.2e−11 |

| Protein name | | | | Locus Name | | Acc# |
|---|---|---|---|---|---|---|
| YvrN protein | | | | gp:BS43KBDNA | | AJ223978 |

Description

*Bacillus subtilis* 42.7 kB DNA fragment from yvsA to yvqA.

-continued

| ORF Name | NTID | AAID | NT Length | AA Length | Score | Probability |
|---|---|---|---|---|---|---|
| 26595051_c3_108 | 3884 | 9106 | 417 | 1254 | 184 | 1.7e−11 |

| Protein name | Locus Name | Acc# |
|---|---|---|
| hypothetical protein aq_294 | pir:H70326 | H70326 |

Description

| ORF Name | NTID | AAID | NT Length | AA Length | Score | Probability |
|---|---|---|---|---|---|---|
| 30504157_f2_35 | 3885 | 9107 | 531 | 1596 | 779 | 2.5e−77 |

| Protein name | Locus Name | Acc# |
|---|---|---|
| putative ABC transporter ATP-binding protein | gp:SCF56 | AL133424 |

Description

*Streptomyces coelicolor* cosmid F56.

| ORF Name | NTID | AAID | NT Length | AA Length | Score | Probability |
|---|---|---|---|---|---|---|
| 36462776_c1_64 | 3886 | 9108 | 112 | 339 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4306268_f3_61 | 3887 | 9109 | 63 | 192 | 72 | 0.020 |

| Protein name | Locus Name | Acc# |
|---|---|---|
| ORF MSV147 hypothetical protein | gp:AF063866 | AF063866 |

Description

*Melanoplus sanguinipes* entomopoxvirus, complete genome.

| ORF Name | NTID | AAID | NT Length | AA Length | Score | Probability |
|---|---|---|---|---|---|---|
| 676677_c3_93 | 3888 | 9110 | 194 | 585 | 159 | 3.0e−10 |

| Protein name | Locus Name | Acc# |
|---|---|---|
| receptor antigen (RagA) | gp:PGI130872 | AJ130872 |

Description

*Porphyromonas gingivalis* W50 receptor antigen (rag) locus encoding a major immunodominant 55 kDa antigen.

| ORF Name | NTID | AAID | NT Length | AA Length | Score | Probability |
|---|---|---|---|---|---|---|
| 975050_c1_78 | 3889 | 9111 | 160 | 480 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 1197324_c1_98 | 3890 | 9112 | 155 | 468 | 267 | 8.0e-23 |

| Protein name | Locus Name | Acc# |
|---|---|---|
| endo-beta-galactosidase | gp:AF083896 | AF083896 |

Description

*Flavobacterium keratolyticus* endo-beta-galactosidase gene, complete cds.

| ORF Name | NTID | AAID | NT Length | AA Length | Score | Probability |
|---|---|---|---|---|---|---|
| 11975307_c3_184 | 3891 | 9113 | 71 | 216 | 230 | 3.7e-19 |

| Protein name | Locus Name | Acc# |
|---|---|---|
| rubredoxin | pir:H72348 | H72348 |

Description

| ORF Name | NTID | AAID | NT Length | AA Length | Score | Probability |
|---|---|---|---|---|---|---|
| 14354208_c3_195 | 3892 | 9114 | 423 | 1272 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 15712683_f2_69 | 3893 | 9115 | 66 | 201 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 16617135_c3_177 | 3894 | 9116 | 70 | 213 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 16914077_f3_94 | 3895 | 9117 | 262 | 789 | 147 | 4.3e-10 |

| Protein name | Locus Name | Acc# |
|---|---|---|
| ORF8 | gp:D78257 | D78257 |

Description

*Enterococcus faecalis* plasmid pYI17 genes for BacA, BacB, ORF3, ORF4, ORF5, ORF6, ORF7, ORF8, ORF9, ORF10, ORF11, partial cds.

-continued

| ORF Name | NTID | AAID | NT Length | AA Length | Score | Probability |
|---|---|---|---|---|---|---|
| 21660966_c2_163 | 3896 | 9118 | 140 | 423 | 112 | 2.4e−05 |

| Protein name | | | Locus Name | | | Acc# |
|---|---|---|---|---|---|---|
| unknown | | | gp:AF116463 | | | AF116463 |

Description

*Streptomyces lincolnensis* putative regulatory protein WdlA (wdLA) gene, complete cds; and unknown gene.

| ORF Name | NTID | AAID | NT Length | AA Length | Score | Probability |
|---|---|---|---|---|---|---|
| 21756552_f2_67 | 3897 | 9119 | 217 | 654 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 22270327_c2_130 | 3898 | 9120 | 304 | 915 | 332 | 5.8e−30 |

| Protein name | | | Locus Name | | | Acc# |
|---|---|---|---|---|---|---|
| hypothetical protein slr1534 | | | pir:S75855 | | | S75855 |

Description

| ORF Name | NTID | AAID | NT Length | AA Length | Score | Probability |
|---|---|---|---|---|---|---|
| 22360900_c1_124 | 3899 | 9121 | 64 | 195 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 23446055_c1_116 | 3900 | 9122 | 610 | 1833 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 23697132_f2_49 | 3901 | 9123 | 646 | 1941 | | |

| Protein name | | | Locus Name | | | Acc# |
|---|---|---|---|---|---|---|

Description

NO-HIT

-continued

| ORF Name | NTID | AAID | NT Length | AA Length | Score | Probability |
|---|---|---|---|---|---|---|
| 24275380_c2_167 | 3902 | 9124 | 188 | 567 | 483 | 5.8e−46 |

| Protein name | Locus Name | Acc# |
|---|---|---|
| phosphoribosylaminoimidazole carboxylase (pure) PAB1077 | pir:B75013 | B75013 |

Description

| ORF Name | NTID | AAID | NT Length | AA Length | Score | Probability |
|---|---|---|---|---|---|---|
| 24407530_f1_8 | 3903 | 9125 | 157 | 474 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24409383_f1_31 | 3904 | 9126 | 214 | 645 | 234 | 1.4e−19 |

| Protein name | Locus Name | Acc# |
|---|---|---|
| hypothetical 23.5 K protein (glnA-fdhE intergenic region):hypothetical protein o206 | pir:S40829 | |

Description

| ORF Name | NTID | AAID | NT Length | AA Length | Score | Probability |
|---|---|---|---|---|---|---|
| 2461693_f1_18 | 3905 | 9127 | 612 | 1839 | 127 | 1.6e−13 |

| Protein name | Locus Name | Acc# |
|---|---|---|
| hypothetical protein SC6C5.12c SC6C5.12c | pir:T35483 | T35483 |

Description

| ORF Name | NTID | AAID | NT Length | AA Length | Score | Probability |
|---|---|---|---|---|---|---|
| 24648516_c1_114 | 3906 | 9128 | 559 | 1680 | 1192 | 4.3e−121 |

| Protein name | Locus Name | Acc# |
|---|---|---|
| uridine kinase-related protein | pir:B72341 | B72341 |

Description

| ORF Name | NTID | AAID | NT Length | AA Length | Score | Probability |
|---|---|---|---|---|---|---|
| 24666412_f2_64 | 3908 | 9129 | 333 | 1002 | 527 | 1.3e−50 |

| Protein name | Locus Name | Acc# |
|---|---|---|
| riboflavin kinase | pir:D70313 | D70313 |

Description

| ORF Name | NTID | AAID | NT Length | AA Length | Score | Probability |
|---|---|---|---|---|---|---|
| 25682030_f1_1 | 3908 | 9130 | 185 | 558 | 310 | 1.2e−27 |

| Protein name | Locus Name | Acc# |
|---|---|---|
| hypothetical protein | pir:F72424 | F72424 |

Description

-continued

| ORF Name | NTID | AAID | NT Length | AA Length | Score | Probability |
|---|---|---|---|---|---|---|
| 29861251_c1_115 | 3909 | 9131 | 526 | 1581 | 224 | 1.1e−15 |
| Protein name | | | Locus Name | | | Acc# |
| sensor histidine kinase | | | pir:A72383 | | | A72383 |

Description

| ORF Name | NTID | AAID | NT Length | AA Length | Score | Probability |
|---|---|---|---|---|---|---|
| 30126500_f2_63 | 3910 | 9132 | 562 | 1689 | 664 | 2.4e−64 |
| Protein name | | | Locus Name | | | Acc# |
| | | | sp:ATC1_DICDI | | | P54678 |

Description

CATION-TRANSPORTING ATPASE PAT1,

| ORF Name | NTID | AAID | NT Length | AA Length | Score | Probability |
|---|---|---|---|---|---|---|
| 30509632_f1_28 | 3911 | 9133 | 575 | 1728 | 568 | 3.1e−54 |
| Protein name | | | Locus Name | | | Acc# |
| sensory transduction histidine kinase slr2104:protein slr2104:protein slr2104 | | | pir:S75136 | | | S75136 |

Description

| ORF Name | NTID | AAID | NT Length | AA Length | Score | Probability |
|---|---|---|---|---|---|---|
| 31674158_f1_17 | 3912 | 9134 | 90 | 273 | | |
| Protein name | | | Locus Name | | | Acc# |

Description

NO-HIT

| ORF Name | NTID | AAID | NT Length | AA Length | Score | Probability |
|---|---|---|---|---|---|---|
| 31835967_f2_47 | 3913 | 9135 | 515 | 1548 | 411 | 1.1e−50 |
| Protein name | | | Locus Name | | | Acc# |
| aminopeptidase | | | gp:AF041033 | | | AF041033 |

Description

*Shigella flexneri* aminopeptidase (pepP) gene, complete cds.

| ORF Name | NTID | AAID | NT Length | AA Length | Score | Probability |
|---|---|---|---|---|---|---|
| 32219042_c3_196 | 3914 | 9136 | 496 | 1491 | 496 | 2.4e−47 |
| Protein name | | | Locus Name | | | Acc# |
| | | | sp:RP54_ACICA | | | P33983 |

Description

RNA POLYMERASE SIGMA-54 FACTOR

-continued

| ORF Name | NTID | AAID | NT Length | AA Length | Score | Probability |
|---|---|---|---|---|---|---|
| 33390937_f3_95 | 3915 | 9137 | 80 | 243 | 267 | 4.5e−23 |

| Protein name | | | | Locus Name | | Acc# |
|---|---|---|---|---|---|---|
| transcription regulator homolog yozG | | | | pir:C69931 | | C69931 |

Description

| ORF Name | NTID | AAID | NT Length | AA Length | Score | Probability |
|---|---|---|---|---|---|---|
| 33992212_c3_199 | 3916 | 9138 | 490 | 1473 | 665 | 3.0e−65 |

| Protein name | | | | Locus Name | | Acc# |
|---|---|---|---|---|---|---|
| gcpe protein | | | | pir:E72087 | | E72087 |

Description

| ORF Name | NTID | AAID | NT Length | AA Length | Score | Probability |
|---|---|---|---|---|---|---|
| 34486592_f2_51 | 3917 | 9139 | 224 | 675 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 35441251_c1_99 | 3918 | 9140 | 389 | 1170 | 190 | 2.6e−12 |

| Protein name | | | | Locus Name | | Acc# |
|---|---|---|---|---|---|---|
| | | | | sp:QPCT_HUMAN | | |

Description (GLUTAMINYL-TRNA CYCLOTRANSFERASE) (GLUTAMINYL CYCLASE)

| ORF Name | NTID | AAID | NT Length | AA Length | Score | Probability |
|---|---|---|---|---|---|---|
| 36413327_f1_30 | 3919 | 9141 | 348 | 1047 | 538 | 2.7e−64 |

| Protein name | | | | Locus Name | | Acc# |
|---|---|---|---|---|---|---|
| calcium motive P-type ATPase | | | | gp:AF145282 | | AF145282 |

Description

*Trichomonas vaginalis* calcium motive P-type ATPase (CA-2) gene, partial cds.

| ORF Name | NTID | AAID | NT Length | AA Length | Score | Probability |
|---|---|---|---|---|---|---|
| 4328175_c1_100 | 3920 | 9142 | 145 | 438 | 251 | 2.2e−21 |

| Protein name | | | | Locus Name | | Acc# |
|---|---|---|---|---|---|---|
| | | | | sp:YE19_SYNY3 | | P74523 |

Description

HYPOTHETICAL 17.7 KD PROTEIN SLR1419

-continued

| ORF Name | NTID | AAID | NT Length | AA Length | Score | Probability |
|---|---|---|---|---|---|---|
| 4334562_c3_198 | 3921 | 9143 | 130 | 393 | 339 | 1.0e-30 |

| Protein name | Locus Name | Acc# |
|---|---|---|
| | sp:GCSH_ECOLI | P23884 |

Description

GLYCINE CLEAVAGE SYSTEM H PROTEIN

| ORF Name | NTID | AAID | NT Length | AA Length | Score | Probability |
|---|---|---|---|---|---|---|
| 4475705_f1_14 | 3922 | 9144 | 180 | 543 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4724062_c3_197 | 3923 | 9145 | 235 | 708 | 157 | 2.0e-11 |

| Protein name | Locus Name | Acc# |
|---|---|---|
| | sp:Y61A_METJA | P81310 |

Description

HYPOTHETICAL PROTEIN MJ0611.1

| ORF Name | NTID | AAID | NT Length | AA Length | Score | Probability |
|---|---|---|---|---|---|---|
| 81887_c1_128 | 3924 | 9146 | 230 | 695 | 356 | 4.6e-36 |

| Protein name | Locus Name | Acc# |
|---|---|---|
| hypothetical protein gcpE | pir:E71562 | E71562 |

Description

| ORF Name | NTID | AAID | NT Length | AA Length | Score | Probability |
|---|---|---|---|---|---|---|
| 9782828_f2_52 | 3925 | 9147 | 145 | 438 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 9929832_f3_89 | 3926 | 9148 | 565 | 1698 | 739 | 4.3e-73 |

| Protein name | Locus Name | Acc# |
|---|---|---|
| conserved hypothetical integral membrane protein TP0771 | pir:H71283 | H71283 |

Description

-continued

| ORF Name | NTID | AAID | NT Length | AA Length | Score | Probability |
|---|---|---|---|---|---|---|
| 10003452_c3_632 | 3927 | 9149 | 551 | 1656 | 338 | 1.2e−27 |

| Protein name | Locus Name | Acc# |
|---|---|---|
| | sp:YICI_ECOLI | |

Description

HYPOTHETICAL 88.1 KD PROTEIN IN GLTS-SELC INTERGENIC REGION

| ORF Name | NTID | AAID | NT Length | AA Length | Score | Probability |
|---|---|---|---|---|---|---|
| 100400_c2_481 | 3928 | 9150 | 108 | 327 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 10188427_f3_266 | 3929 | 9151 | 72 | 219 | 103 | 8.7e−05 |

| Protein name | Locus Name | Acc# |
|---|---|---|
| transposase | gp:AF038866 | AF038866 |

Description

*Bacteroides fragilis* transposon Tn5520 transposase (bipH) and mobilization Protein BmpH (bmpH) genes, complete cds.

| ORF Name | NTID | AAID | NT Length | AA Length | Score | Probability |
|---|---|---|---|---|---|---|
| 10291393_f1_12 | 3930 | 9152 | 464 | 1395 | 800 | 1.5e−79 |

| Protein name | Locus Name | Acc# |
|---|---|---|
| | sp:Y260_SYNY3 | P74409 |

Description

HYPOTHETICAL 49.2 KD PROTEIN SLL0260

| ORF Name | NTID | AAID | NT Length | AA Length | Score | Probability |
|---|---|---|---|---|---|---|
| 10719385_f3_318 | 3931 | 9153 | 97 | 294 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 10739387_f3_330 | 3932 | 9154 | 469 | 1410 | 263 | 2.1e−20 |

| Protein name | Locus Name | Acc# |
|---|---|---|
| transposase | gp:AF038866 | AF038866 |

Description

*Bacteroides fragilis* transposon Tn5520 transposase (bipH) and mobilization protein BmpH (bmpH) genes, complete cds.

-continued

| ORF Name | NTID | AAID | NT Length | AA Length | Score | Probability |
|---|---|---|---|---|---|---|
| 10739526_c1_416 | 3933 | 9155 | 713 | 2142 | 837 | 2.9e−110 |
| Protein name | | | Locus Name | | | Acc# |
| alpha-glucosidase | | | gp:BTU66897 | | | U66897 |
| Description | | | | | | |

*Bacteroides thetaiotaomicron* neopullulanase (susA) and alpha-glucosidase (susB) genes, complete cds.

| ORF Name | NTID | AAID | NT Length | AA Length | Score | Probability |
|---|---|---|---|---|---|---|
| 10979675_f1_20 | 3934 | 9156 | 620 | 1863 | 174 | 2.4e−09 |
| Protein name | | | Locus Name | | | Acc# |
| probable purine NTPase PAB0812 | | | pir:F75103 | | | F75103 |
| Description | | | | | | |

| ORF Name | NTID | AAID | NT Length | AA Length | Score | Probability |
|---|---|---|---|---|---|---|
| 11016386_f1_116 | 3935 | 9157 | 74 | 225 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 112686_f1_13 | 3936 | 9158 | 169 | 510 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 1209436_f2_211 | 3937 | 9159 | 391 | 1176 | 493 | 5.0e−47 |
| Protein name | | | Locus Name | | | Acc# |
| immunoreactive 42 kD antigen PG33 | | | gp:A175715 | | | AF175715 |
| Description | | | | | | |

*Porphyromonas gingivalis* strain W50 immunoreactive 42 kD antigen PG33 gene, complete cds.

| ORF Name | NTID | AAID | NT Length | AA Length | Score | Probability |
|---|---|---|---|---|---|---|
| 12316382_c2_553 | 3938 | 9160 | 167 | 504 | 477 | 2.5e−45 |
| Protein name | | | Locus Name | | | Acc# |
| O-acetylhomoserine sulfhydrylase | | | pir:D72324 | | | D72324 |
| Description | | | | | | |

-continued

| ORF Name | NTID | AAID | NT Length | AA Length | Score | Probability |
|---|---|---|---|---|---|---|
| 12516930_f3_291 | 3939 | 9161 | 60 | 183 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 12582785_f3_281 | 3940 | 9162 | 68 | 207 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 12690927_c3_555 | 3941 | 9163 | 332 | 999 | 299 | 4.2e−36 |

| Protein name | | | | Locus Name | | Acc# |
|---|---|---|---|---|---|---|
| hypothetical protein F19D11.16:hypothetical protein F14M4.29:hypothetical protein F14M4.29 | | | | pir:T02689 | | |

Description

| ORF Name | NTID | AAID | NT Length | AA Length | Score | Probability |
|---|---|---|---|---|---|---|
| 12897701_c3_642 | 3942 | 9164 | 257 | 774 | 748 | 4.8e−74 |

| Protein name | | | | Locus Name | | Acc# |
|---|---|---|---|---|---|---|
| O-acetylhomoserine sulfydrylase | | | | pir:D72324 | | D72324 |

Description

| ORF Name | NTID | AAID | NT Length | AA Length | Score | Probability |
|---|---|---|---|---|---|---|
| 13835817_f3_315 | 3943 | 9165 | 64 | 195 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 14063318_f2_207 | 3944 | 9166 | 60 | 183 | 129 | 1.9e−08 |

| Protein name | | | | Locus Name | | Acc# |
|---|---|---|---|---|---|---|
| hypothetical protein PH1147 | | | | pir:E71056 | | E71056 |

Description

-continued

| ORF Name | NTID | AAID | NT Length | AA Length | Score | Probability |
|---|---|---|---|---|---|---|
| 14156287_f3_255 | 3945 | 9167 | 445 | 1338 | 168 | 4.4e−09 |
| Protein name | | | Locus Name | | | Acc# |
| | | | gP:PGU60208 | | | U60208 |

Description

*Porphyromonas gingivalis* orf1, orf2 and orf3 genes, complete cds.

| ORF Name | NTID | AAID | NT Length | AA Length | Score | Probability |
|---|---|---|---|---|---|---|
| 14463437_c3_592 | 3946 | 9168 | 234 | 705 | 200 | 5.6e−16 |
| Protein name | | | Locus Name | | | Acc# |
| hypothetical protein ycgF | | | pir:A69758 | | | A69758 |

Description

| ORF Name | NTID | AAID | NT Length | AA Length | Score | Probability |
|---|---|---|---|---|---|---|
| 14745312_f3_290 | 3947 | 9169 | 103 | 312 | 77 | 0.013 |
| Protein name | | | Locus Name | | | Acc# |
| NADH dehydrogenase subunit 2 | | | gp:AF160864 | | | AF160864 |

Description

*Tetrahymena pyriformis* mitochondrial DNA, complete genome.

| ORF Name | NTID | AAID | NT Length | AA Length | Score | Probability |
|---|---|---|---|---|---|---|
| 15079802_f1_100 | 3948 | 9170 | 1065 | 321 | | |
| Protein name | | | Locus Name | | | Acc# |

Description

NO-HIT

| ORF Name | NTID | AAID | NT Length | AA Length | Score | Probability |
|---|---|---|---|---|---|---|
| 15631502_f1_99 | 3949 | 9171 | 442 | 1329 | 300 | 1.2e−33 |
| Protein name | | | Locus Name | | | Acc# |
| | | | sp:YHCG_ECOLI | | | P45423 |

Description

HYPOTHETICAL 43.3 KD PROTEIN IN GLTF-NANT INTERGENIC REGION (O375)

| ORF Name | NTID | AAID | NT Length | AA Length | Score | Probability |
|---|---|---|---|---|---|---|
| 15707788_c2_535 | 3950 | 9172 | 268 | 807 | 386 | 1.1e−35 |
| Protein name | | | Locus Name | | | Acc# |
| transposase | | | gp:AF038866 | | | AF038866 |

Description

*Bacteroides fragilis* transposon Tn5520 transposase (bipH) and mobilization protein BmpH (bmpH) genes, complete cds.

-continued

| ORF Name | NTID | AAID | NT Length | AA Length | Score | Probability |
|---|---|---|---|---|---|---|
| 16229142_c2_509 | 3951 | 9173 | 75 | 228 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 16493968_c1_455 | 3952 | 9174 | 331 | 996 | 204 | 3.4e−16 |

| Protein name | | | | Locus Name | | Acc# |
|---|---|---|---|---|---|---|
| | | | | sp:XYNC_CALSA | | P23553 |

Description

ACETYL ESTERASE, (ACETYLXYLOSIDASE)

| ORF Name | NTID | AAID | NT Length | AA Length | Score | Probability |
|---|---|---|---|---|---|---|
| 16594202_f1_73 | 3953 | 9175 | 62 | 189 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 16832885_f3_339 | 3954 | 9176 | 431 | 1296 | 1723 | 2.3e−177 |

| Protein name | | | | Locus Name | | Acc# |
|---|---|---|---|---|---|---|
| hypothetical protein | | | | pir:JQ1020 | | JQ1020 |

Description

| ORF Name | NTID | AAID | NT Length | AA Length | Score | Probability |
|---|---|---|---|---|---|---|
| 187826_f3_271 | 3955 | 9177 | 746 | 2241 | 2313 | 6.9e−240 |

| Protein name | | | | Locus Name | | Acc# |
|---|---|---|---|---|---|---|
| | | | | sp:PFL_CLOPA | | Q46266 |

Description

FORMATE ACETYLTRANSFERASE, (PYRUVATE FORMATE-LYASE)

| ORF Name | NTID | AAID | NT Length | AA Length | Score | Probability |
|---|---|---|---|---|---|---|
| 1954562_c3_605 | 3956 | 9178 | 1111 | 3336 | 557 | 5.9e−55 |

| Protein name | | | | Locus Name | | Acc# |
|---|---|---|---|---|---|---|
| 115K outer membrane protein precursor:SusC protein | | | | pir:JC6027 | | JC6027 |

Description

-continued

| ORF Name | NTID | AAID | NT Length | AA Length | Score | Probability |
|---|---|---|---|---|---|---|
| 19617202_c3_559 | 3957 | 9179 | 68 | 207 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 19706258_c2_541 | 3958 | 9180 | 76 | 231 | 143 | 4.0e−09 |

| Protein name | | | | Locus Name | | Acc# |
|---|---|---|---|---|---|---|
| transposase | | | | gp:AF038866 | | AF038866 |

Description

*Bacteroides fragilis* transposon Tn5520 transposase (bipH) and mobilization protein BmpH (bmpH) genes, complete cds.

| ORF Name | NTID | AAID | NT Length | AA Length | Score | Probability |
|---|---|---|---|---|---|---|
| 1987817_c1_388 | 3959 | 9181 | 79 | 240 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 200399010_c2_537 | 3960 | 9182 | 130 | 393 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 20213303_c2_519 | 3961 | 9183 | 394 | 1185 | 161 | 7.1e−16 |

| Protein name | | | | Locus Name | | Acc# |
|---|---|---|---|---|---|---|
| ATP-dependent activating enzyme | | | | gp:PFFBSCEAB | | Y09356 |

Description

*Pseudomonas fluorescens* fbsC, fbsE, fbsA and fbsB genes.

| ORF Name | NTID | AAID | NT Length | AA Length | Score | Probability |
|---|---|---|---|---|---|---|
| 2031290_f1_25 | 3962 | 9184 | 70 | 213 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 20319132_c2_523 | 3963 | 9185 | 354 | 1065 | 159 | 3.0e−10 |

| Protein name | Locus Name | Acc# |
|---|---|---|
| transmembrane sensor | gp:AF051691 | AF051691 |

Description

*Pseudomonas aeruginosa* stress factor A (psfA), ECF sigma factor (fiuf), transmembrane sensor (fiuR), and hydroxamate-type ferrisiderophore receptor (fiuA) genes, complete cds.

| ORF Name | NTID | AAID | NT Length | AA Length | Score | Probability |
|---|---|---|---|---|---|---|
| 20353400_f1_107 | 3964 | 9186 | 833 | 2502 | 801 | 1.2e−79 |

| Protein name | Locus Name | Acc# |
|---|---|---|
|  | sp:MUS2_BACSU | P94545 |

Description

MUTS2 PROTEIN

| ORF Name | NTID | AAID | NT Length | AA Length | Score | Probability |
|---|---|---|---|---|---|---|
| 20801930_c2_505 | 3965 | 9187 | 512 | 1539 | 467 | 3.9e−51 |

| Protein name | Locus Name | Acc# |
|---|---|---|
| amidophosphoribosyltransferase | pir:H69185 | H69185 |

Description

| ORF Name | NTID | AAID | NT Length | AA Length | Score | Probability |
|---|---|---|---|---|---|---|
| 2125277_f1_113 | 3966 | 9188 | 526 | 1581 | 2616 | 5.4e−272 |

| Protein name | Locus Name | Acc# |
|---|---|---|
| alkyl hydroperoxide reductase subunit F | gp:AF129406 | AF129406 |

Description

*Bacteroides fragilis* alkyl hydroperoxide reductase subunit C (ahpC) and alkyl hydroperoxide reductase subunit F (ahpF) genes, complete cds.

| ORF Name | NTID | AAID | NT Length | AA Length | Score | Probability |
|---|---|---|---|---|---|---|
| 2146927_f1_11 | 3967 | 9189 | 282 | 849 | 410 | 3.1e−38 |

| Protein name | Locus Name | Acc# |
|---|---|---|
| transcription regulator yggG | pir:G65078 |  |

Description

| ORF Name | NTID | AAID | NT Length | AA Length | Score | Probability |
|---|---|---|---|---|---|---|
| 21605288_f2_134 | 3968 | 9190 | 874 | 2625 | 93 | 0.0019 |

| Protein name | Locus Name | Acc# |
|---|---|---|
| hypothetical protein b2228 | pir:B64993 | B64993 |

Description

-continued

| ORF Name | NTID | AAID | NT Length | AA Length | Score | Probability |
|---|---|---|---|---|---|---|
| 21722925_c2_496 | 3969 | 9191 | 95 | 288 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 2187805_c2_507 | 3970 | 9192 | 64 | 195 | 75 | 0.019 |

| Protein name | | | | Locus Name | | Acc# |
|---|---|---|---|---|---|---|
| putative transmembrane protein | | | | gp:SCU96107 | | U96107 |

Description

*Staphylococcus carnosus* N5,N10-methylenetetrahydromethanopterin reductase homolog, SceB precursor (sceB) and putative transmembrane protein genes, complete cds, and putative Na+/H+ antiporter NhaC (nhaC) gene, partial cds.

| ORF Name | NTID | AAID | NT Length | AA Length | Score | Probability |
|---|---|---|---|---|---|---|
| 2204407_f1_103 | 3971 | 9193 | 322 | 969 | 87 | 0.045 |

| Protein name | | | | Locus Name | | Acc# |
|---|---|---|---|---|---|---|
| | | | | sp:PRIM_LISMO | | P47762 |

Description

DNA PRIMASE,

| ORF Name | NTID | AAID | NT Length | AA Length | Score | Probability |
|---|---|---|---|---|---|---|
| 22289061_f2_142 | 3972 | 9194 | 106 | 321 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 22539088_c3_593 | 3973 | 9195 | 186 | 561 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 22689628_f2_204 | 3974 | 9196 | 72 | 219 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 22860128_f1_106 | 3975 | 9197 | 83 | 252 | 64 | 0.031 |

| Protein name | Locus Name | Acc# |
|---|---|---|
|  | sp:SPRC_XENLA | P36378 |

Description (OSTEONECTIN) (ON) (BASEMENT MEMBRANE PROTEIN BM-40)

| ORF Name | NTID | AAID | NT Length | AA Length | Score | Probability |
|---|---|---|---|---|---|---|
| 22928812_c1_441 | 3976 | 9198 | 65 | 198 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 23445317_c1_458 | 3977 | 9199 | 310 | 933 | 721 | 3.5e−71 |

| Protein name | Locus Name | Acc# |
|---|---|---|
| conserved hypothetical protein BB0682 | pir:A70185 | A70185 |

Description

| ORF Name | NTID | AAID | NT Length | AA Length | Score | Probability |
|---|---|---|---|---|---|---|
| 23609517_c3_613 | 3978 | 9200 | 358 | 1077 | 508 | 1.3e−48 |

| Protein name | Locus Name | Acc# |
|---|---|---|
|  | gp:A00047 | A00047 |

Description

*E. coli* mor gene.

| ORF Name | NTID | AAID | NT Length | AA Length | Score | Probability |
|---|---|---|---|---|---|---|
| 23634701_c1_424 | 3979 | 9201 | 308 | 927 | 113 | 3.4e−06 |

| Protein name | Locus Name | Acc# |
|---|---|---|
| AmpG-signal transducer | gp:ECAMPG3 | X82159 |

Description

*E. coli* ampG3 gene.

| ORF Name | NTID | AAID | NT Length | AA Length | Score | Probability |
|---|---|---|---|---|---|---|
| 23640675_c1_364 | 3980 | 9202 | 165 | 498 | 101 | 0.0025 |

| Protein name | Locus Name | Acc# |
|---|---|---|
| hypothetical protein A208R | pir:T17698 | T17698 |

Description

| ORF Name | NTID | AAID | NT Length | AA Length | Score | Probability |
|---|---|---|---|---|---|---|
| 2378150_c3_595 | 3981 | 9203 | 532 | 1599 | 1332 | 6.2e−136 |

| Protein name | Locus Name | Acc# |
|---|---|---|
| | sp:RF3_ECOLI | P33998 |

Description

PEPTIDE CHAIN RELEASE FACTOR 3 (RF-3)

| ORF Name | NTID | AAID | NT Length | AA Length | Score | Probability |
|---|---|---|---|---|---|---|
| 23945263_f3_275 | 3892 | 9204 | 257 | 774 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24093763_c1_398 | 3983 | 9205 | 417 | 1254 | 1298 | 2.5e−132 |

| Protein name | Locus Name | Acc# |
|---|---|---|
| | sp:PEPT_BACSU | P55179 |

Description

PEPTIDASE T, (AMINOTRIPEPTIDASE) (TRIPEPTIDASE)

| ORF Name | NTID | AAID | NT Length | AA Length | Score | Probability |
|---|---|---|---|---|---|---|
| 24229677_c1_375 | 3984 | 9206 | 339 | 1020 | 1381 | 4.0e−141 |

| Protein name | Locus Name | Acc# |
|---|---|---|
| class A beta-lactamase CFXA2 precursor | gp:AF118110 | AF118110 |

Description

Prevotella intermedia class A beta-lactamase CFXA2 precursor (cfxA2) gene, complete cds.

| ORF Name | NTID | AAID | NT Length | AA Length | Score | Probability |
|---|---|---|---|---|---|---|
| 24397187_c3_562 | 3985 | 9207 | 186 | 561 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24414026_f2_150 | 3986 | 9208 | 164 | 495 | 390 | 4.1e−36 |

| Protein name | Locus Name | Acc# |
|---|---|---|
| Dps | gp:AB025779 | AB025779 |

Description

*Porphyromonas gingivalis* gene for Dps, complete cds.

-continued

| ORF Name | NTID | AAID | NT Length | AA Length | Score | Probability |
|---|---|---|---|---|---|---|
| 24429050_c1_403 | 3987 | 9209 | 769 | 2310 | 465 | 1.9e−43 |

| Protein name | Locus Name | Acc# |
|---|---|---|
| | sp:YBAL_ECOLI | |

Description

HYPOTHETICAL 59.4 KD PROTEIN IN GSK-FSR INTERGENIC REGION

| ORF Name | NTID | AAID | NT Length | AA Length | Score | Probability |
|---|---|---|---|---|---|---|
| 24644637_c2_460 | 3988 | 9210 | 301 | 906 | 168 | 7.1e−10 |

| Protein name | Locus Name | Acc# |
|---|---|---|
| nucleotide pyrophosphatase homolog T16L4.210 | pir:T09933 | T09933 |

Description

| ORF Name | NTID | AAID | NT Length | AA Length | Score | Probability |
|---|---|---|---|---|---|---|
| 24782792_c3_608 | 3989 | 9211 | 395 | 1188 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24804817_c3_607 | 3990 | 9212 | 246 | 741 | 123 | 3.2e−05 |

| Protein name | Locus Name | Acc# |
|---|---|---|
| | sp:EBA2_FLAME | P36912 |

Description (ENDOGLYCOSIDASE F2)

| ORF Name | NTID | AAID | NT Length | AA Length | Score | Probability |
|---|---|---|---|---|---|---|
| 24807812_f1_108 | 3991 | 9213 | 357 | 1074 | 528 | 9.8e−51 |

| Protein name | Locus Name | Acc# |
|---|---|---|
| divalent cation transport-related protein | pir:H72360 | H72360 |

Description

| ORF Name | NTID | AAID | NT Length | AA Length | Score | Probability |
|---|---|---|---|---|---|---|
| 24822142_f2_226 | 3992 | 9214 | 190 | 573 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 24848928_c1_459 | 3993 | 9215 | 66 | 201 | | |

| Protein name | | Locus Name | | Acc# |
|---|---|---|---|---|
| | | | | |

Description

NO-HIT

| ORF Name | NTID | AAID | NT Length | AA Length | Score | Probability |
|---|---|---|---|---|---|---|
| 24849132_f3_335 | 3994 | 9216 | 374 | 1125 | | |

| Protein name | | Locus Name | | Acc# |
|---|---|---|---|---|
| | | | | |

Description

NO-HIT

| ORF Name | NTID | AAID | NT Length | AA Length | Score | Probability |
|---|---|---|---|---|---|---|
| 2500052_c2_513 | 3995 | 9217 | 423 | 1272 | 376 | 1.3e−34 |

| Protein name | | Locus Name | | Acc# |
|---|---|---|---|---|
| | | sp:YIDA_ECOLI | | |

Description

HYPOTHETICAL 29.7 KD PROTEIN IN IBPA-GYRB INTERGENIC REGION

| ORF Name | NTID | AAID | NT Length | AA Length | Score | Probability |
|---|---|---|---|---|---|---|
| 25398385_c2_461 | 3996 | 9218 | 346 | 1041 | 262 | 1.5e−22 |

| Protein name | | Locus Name | | Acc# |
|---|---|---|---|---|
| hypothetical protein F14F9.5 | | pir:T33774 | | T33774 |

Description

| ORF Name | NTID | AAID | NT Length | AA Length | Score | Probability |
|---|---|---|---|---|---|---|
| 25422162_f1_5 | 3997 | 9219 | 278 | 837 | | |

| Protein name | | Locus Name | | Acc# |
|---|---|---|---|---|
| | | | | |

Description

NO-HIT

| ORF Name | NTID | AAID | NT Length | AA Length | Score | Probability |
|---|---|---|---|---|---|---|
| 25580212_f1_97 | 3998 | 9220 | 76 | 231 | 78 | 0.034 |

| Protein name | | Locus Name | | Acc# |
|---|---|---|---|---|
| HCG-1 protein | | gp:AF044219 | | AF044219 |

Description

*Drosophila melanogaster* HCG-1 protein (HCG-1) mRNA, complete cds.

-continued

| ORF Name | NTID | AAID | NT Length | AA Length | Score | Probability |
|---|---|---|---|---|---|---|
| 25892062_c2_498 | 3999 | 9221 | 111 | 336 | 173 | 4.1e−13 |

| Protein name | Locus Name | Acc# |
|---|---|---|
| thioredoxin-like protein | gp:ATAC010718 | AC010718 |

Description

*Arabidopsis thaliana* chromosome I BAC F28O16 genomic sequence, complete sequence.

| ORF Name | NTID | AAID | NT Length | AA Length | Score | Probability |
|---|---|---|---|---|---|---|
| 25892187_c3_594 | 4000 | 9222 | 291 | 876 | 593 | 1.3e−57 |

| Protein name | Locus Name | Acc# |
|---|---|---|
| probable dTDP-L-rhamnose synthase | pir:T31087 | T31087 |

Description

| ORF Name | NTID | AAID | NT Length | AA Length | Score | Probability |
|---|---|---|---|---|---|---|
| 26359635_c1_409 | 4001 | 9223 | 373 | 1122 | 280 | 1.9e−24 |

| Protein name | Locus Name | Acc# |
|---|---|---|
| | sp:ENTC_ECOLI | P10377 |

Description

ISOCHORISMATE SYNTHASE ENTC,

| ORF Name | NTID | AAID | NT Length | AA Length | Score | Probability |
|---|---|---|---|---|---|---|
| 26460003_c3_599 | 4002 | 9224 | 579 | 1740 | 454 | 6.8e−43 |

| Protein name | Locus Name | Acc# |
|---|---|---|
| | sp:MEND_HAEIN | P44612 |

Description

| ORF Name | NTID | AAID | NT Length | AA Length | Score | Probability |
|---|---|---|---|---|---|---|
| 26461680_c3_580 | 4003 | 9225 | 351 | 1056 | 614 | 7.6e−60 |

| Protein name | Locus Name | Acc# |
|---|---|---|
| probable zinc-containing dehydrogenase | pir:T36961 | T36961 |

Description

| ORF Name | NTID | AAID | NT Length | AA Length | Score | Probability |
|---|---|---|---|---|---|---|
| 26600327_c1_393 | 4004 | 9226 | 145 | 438 | 111 | 1.5e−06 |

| Protein name | Locus Name | Acc# |
|---|---|---|
| ferric uptake regulation protein | pir:G72213 | G72213 |

Description

-continued

| ORF Name | NTID | AAID | NT Length | AA Length | Score | Probability |
|---|---|---|---|---|---|---|
| 26601677_c1_412 | 4005 | 9227 | 276 | 831 | 1012 | 5.1e−102 |

| Protein name | | | | Locus Name | | Acc# |
|---|---|---|---|---|---|---|
| naphthoate synthase, menB:DHNA synthase dihydroxynaphthoate synthase dihydroxynapthoic acid synthetase | | | | pir:F69656 | | |

Description

| ORF Name | NTID | AAID | NT Length | AA Length | Score | Probability |
|---|---|---|---|---|---|---|
| 26604687_f2_133 | 4006 | 9228 | 134 | 405 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 26604692_c3_621 | 4007 | 9229 | 161 | 486 | 239 | 1.1e−19 |

| Protein name | | | | Locus Name | | Acc# |
|---|---|---|---|---|---|---|
| transposase | | | | gp:AF038866 | | AF038866 |

Description

*Bacteroides fragilis* transposon Tn5520 transposase (bipH) and mobilization BmpH (bmpH) genes, complete cds.

| ORF Name | NTID | AAID | NT Length | AA Length | Score | Probability |
|---|---|---|---|---|---|---|
| 26820341_c3_603 | 4008 | 9230 | 331 | 996 | 140 | 9.2e−07 |

| Protein name | | | | Locus Name | | Acc# |
|---|---|---|---|---|---|---|
| Hyp1 protein | | | | gp:HVHYP1PRO | | Y09797 |

Description

*H. vulgaris* mRNA for Hyp1 protein.

| ORF Name | NTID | AAID | NT Length | AA Length | Score | Probability |
|---|---|---|---|---|---|---|
| 29398290_f3_257 | 4009 | 9231 | 64 | 195 | 83 | 0.0053 |

| Protein name | | | | Locus Name | | Acc# |
|---|---|---|---|---|---|---|
| asparagine-rich protein (clone 28C6) | | | | pri:S14470 | | S14470 |

Description

| ORF Name | NTID | AAID | NT Length | AA Length | Score | Probability |
|---|---|---|---|---|---|---|
| 30079675_c3_583 | 4010 | 9232 | 805 | 2418 | 366 | 1.5e−31 |

| Protein name | | | | Locus Name | | Acc# |
|---|---|---|---|---|---|---|
| Sensor protein RcsC (EC 2.7.3.—). | | | | gp:D90850 | | |

Description

*E. coli* genomic DNA, Kohara clone #373 (49.5–49.9 min.).

-continued

| ORF Name | NTID | AAID | NT Length | AA Length | Score | Probability |
|---|---|---|---|---|---|---|
| 30195142_c2_536 | 4011 | 9233 | 924 | 2775 | 323 | 8.8e−25 |

| Protein name | Locus Name | Acc# |
|---|---|---|
| hypothetical protein | pir:C72285 | C72285 |

Description

| ORF Name | NTID | AAID | NT Length | AA Length | Score | Probability |
|---|---|---|---|---|---|---|
| 30502255_f2_127 | 4012 | 9234 | 344 | 1035 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 30572331_c1_430 | 4013 | 9235 | 115 | 348 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 32478803_c2_552 | 4014 | 9236 | 110 | 333 | 80 | 0.033 |

| Protein name | Locus Name | Acc# |
|---|---|---|
| | sp:CPE1_BOVIN | O18963 |

Description

CYTOCHROME P450 2E1, (CYPIIE1)

| ORF Name | NTID | AAID | NT Length | AA Length | Score | Probability |
|---|---|---|---|---|---|---|
| 32523576_f1_82 | 4015 | 9237 | 61 | 186 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 3319437_c3_628 | 4016 | 9238 | 173 | 522 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 33210936_f1_46 | 4017 | 9239 | 214 | 645 | 163 | 4.7e−12 |
| Protein name | | | Locus Name | | | Acc# |
| RNA polymerase sigma factor SigZ-like protein | | | gp:AF137263 | | | AF137263 |
| Description | | | | | | |

Bacteroides thetaiotaomicron 30S ribosomal protein S16-like protein, fucose gene cluster, and RNA polymerase sigma factor SigZ-like protein (sigZ) genes, complete cds.

| ORF Name | NTID | AAID | NT Length | AA Length | Score | Probability |
|---|---|---|---|---|---|---|
| 33400263_c1_423 | 4018 | 9240 | 338 | 1017 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 33786083_f3_338 | 4019 | 9241 | 483 | 1452 | 2084 | 1.3e−215 |
| Protein name | | | Locus Name | | | Acc# |
| NBU1 mobilization protein mob | | | pir:A49901 | | | A49901 |
| Description | | | | | | |

| ORF Name | NTID | AAID | NT Length | AA Length | Score | Probability |
|---|---|---|---|---|---|---|
| 34026558_f1_36 | 4020 | 9242 | 65 | 198 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 34509700_c1_422 | 4021 | 9243 | 137 | 414 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 35157050_f2_227 | 4022 | 9244 | 327 | 984 | 236 | 8.6e−20 |
| Protein name | | | Locus Name | | | Acc# |
| hypothetical protein PAB0040 | | | pir:B75194 | | | B75194 |
| Description | | | | | | |

-continued

| ORF Name | NTID | AAID | NT Length | AA Length | Score | Probability |
|---|---|---|---|---|---|---|
| 35161302_c2_524 | 4023 | 9245 | 211 | 636 | 158 | 1.0e−10 |

| Protein name | Locus Name | Acc# |
|---|---|---|
| | sp:Y350_HAEIN | P24326 |

Description

HYPOTHETICAL PROTEIN HI0350 (ORF3)

| ORF Name | NTID | AAID | NT Length | AA Length | Score | Probability |
|---|---|---|---|---|---|---|
| 36073591_c1_389 | 4024 | 9246 | 301 | 906 | 362 | 3.8e−33 |

| Protein name | Locus Name | Acc# |
|---|---|---|
| | sp:YZ09_MYCTU | Q10543 |

Description

HYPOTHETICAL TRNA/RRNA METHYLTRANSFERASE CY31.09,

| ORF Name | NTID | AAID | NT Length | AA Length | Score | Probability |
|---|---|---|---|---|---|---|
| 36207933_c1_413 | 4025 | 9247 | 355 | 1068 | 175 | 1.1e−10 |

| Protein name | Locus Name | Acc# |
|---|---|---|
| chloromuconate cycloisomerase homolog ykfB | pir:H69855 | H69855 |

Description

| ORF Name | NTID | AAID | NT Length | AA Length | Score | Probability |
|---|---|---|---|---|---|---|
| 36361002_f3_267 | 4026 | 9248 | 169 | 510 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 3944688_f3_349 | 4027 | 9249 | 191 | 576 | 983 | 6.0e−99 |

| Protein name | Locus Name | Acc# |
|---|---|---|
| alkyl hydroperoxide reductase subunit C | gp:AF129406 | AF129406 |

Description

*Bacteroides fragilis* alkyl hydroperoxide reductase subunit C (aphC) and alkyl hydroperoxide reductase subunit F (ahpF) genes, complete cds.

| ORF Name | NTID | AAID | NT Length | AA Length | Score | Probability |
|---|---|---|---|---|---|---|
| 3947562_c2_534 | 4028 | 9250 | 400 | 1203 | 758 | 4.2e−75 |

| Protein name | Locus Name | Acc# |
|---|---|---|
| transposase | gp:AF038866 | AF038866 |

Description

*Bacteroides fragilis* transposon Tn5520 transposase (bipH) and mobilization protein BmpH (bmpH) genes, complete cds.

| ORF Name | NTID | AAID | NT Length | AA Length | Score | Probability |
|---|---|---|---|---|---|---|
| 4094563_f2_137 | 4029 | 9251 | 445 | 1338 | 128 | 5.1e−05 |

| Protein name | Locus Name | Acc# |
|---|---|---|
| hypothetical protein PH0922 | pir:D71082 | D71082 |

Description

| ORF Name | NTID | AAID | NT Length | AA Length | Score | Probability |
|---|---|---|---|---|---|---|
| 4094687_c1_411 | 4030 | 9252 | 337 | 1014 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 4094800_f3_344 | 4031 | 9253 | 405 | 1218 | 698 | 4.8e−83 |

| Protein name | Locus Name | Acc# |
|---|---|---|
| | sp:SDHL_STRCO | O86564 |

Description

L-SERINE DEHYDRATASE, (L-SERINE DEAMINASE) (SDH) (L-SD)

| ORF Name | NTID | AAID | NT Length | AA Length | Score | Probability |
|---|---|---|---|---|---|---|
| 4504682_c1_402 | 4032 | 9254 | 250 | 753 | 131 | 1.4e−05 |

| Protein name | Locus Name | Acc# |
|---|---|---|
| intracellular hyaluronic acid binding protein | gp:AF032862 | AF032862 |

Description

*Homo sapiens* intracellular hyaluronic acid binding protein (IHABP) mRNA, complete cds.

| ORF Name | NTID | AAID | NT Length | AA Length | Score | Probability |
|---|---|---|---|---|---|---|
| 4719626_c2_508 | 4033 | 9255 | 592 | 1779 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 4800926_f3_326 | 4034 | 9256 | 512 | 1539 | 356 | 5.6e−31 |

| Protein name | Locus Name | Acc# |
|---|---|---|
| | sp:GA6S_HUMAN | P34059 |

Description (CHONDROITINASE)

| ORF Name | NTID | AAID | NT Length | AA Length | Score | Probability |
|---|---|---|---|---|---|---|
| 4939000_c2_525 | 4035 | 9257 | 336 | 1011 | 1037 | 1.1e−104 |

| Protein name | Locus Name | Acc# |
|---|---|---|
| conserved hypothetical protein | pir:B72278 | B72278 |

Description

| ORF Name | NTID | AAID | NT Length | AA Length | Score | Probability |
|---|---|---|---|---|---|---|
| 5081927_c2_504 | 4036 | 9258 | 679 | 2040 | 1451 | 1.5e−148 |

| Protein name | Locus Name | Acc# |
|---|---|---|
| cation-transporting atpase, p-type (pacs) PAB0626 | pir:E75141 | E75141 |

Description

| ORF Name | NTID | AAID | NT Length | AA Length | Score | Probability |
|---|---|---|---|---|---|---|
| 510937_c1_365 | 4037 | 9259 | 171 | 516 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 5117762_c3_616 | 4038 | 9260 | 422 | 1269 | 114 | 0.00075 |

| Protein name | Locus Name | Acc# |
|---|---|---|
| hypothetical protein F42G9.3 | pir:T16348 | T16348 |

Description

| ORF Name | NTID | AAID | NT Length | AA Length | Score | Probability |
|---|---|---|---|---|---|---|
| 5167037_c3_606 | 4039 | 9261 | 518 | 1557 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 5273552_c3_639 | 4040 | 9262 | 148 | 447 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 5363816_c1_386 | 4041 | 9623 | 380 | 1143 | 104 | 0.0047 |

| Protein name | | | | Locus Name | | Acc# |
|---|---|---|---|---|---|---|
| | | | | gp:PFMAL3P7 | | |

Description

Plasmodium falciparum MAL3P7, complete sequence.

| ORF Name | NTID | AAID | NT Length | AA Length | Score | Probability |
|---|---|---|---|---|---|---|
| 584700_f3_263 | 4042 | 9264 | 90 | 273 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 6429643_c3_615 | 4043 | 9265 | 189 | 570 | 190 | 6.5e−15 |

| Protein name | | | | Locus Name | | Acc# |
|---|---|---|---|---|---|---|
| | | | | sp:RPOE_HAEIN | | P44790 |

Description

RNA POLYMERASE SIGMA-E FACTOR (SIGMA-24)

| ORF Name | NTID | AAID | NT Length | AA Length | Score | Probability |
|---|---|---|---|---|---|---|
| 6444077_f1_27 | 4044 | 9266 | 241 | 726 | 555 | 1.4e−53 |

| Protein name | | | | Locus Name | | Acc# |
|---|---|---|---|---|---|---|
| | | | | sp:PFLA_ECOLI | | P09374 |

Description

ACTIVATING ENZYME)

| ORF Name | NTID | AAID | NT Length | AA Length | Score | Probability |
|---|---|---|---|---|---|---|
| 7084675_f1_19 | 4045 | 9267 | 387 | 1164 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 7109407_c3_586 | 4046 | 9268 | 135 | 408 | 253 | 1.4e−21 |

| Protein name | | | | Locus Name | | Acc# |
|---|---|---|---|---|---|---|
| | | | | sp:YEAO_ECOLI | | P76243 |

Description

HYPOTHETICAL 14.2 KD PROTEIN IN GAPA-RND INTERGENIC REGION

-continued

| ORF Name | NTID | AAID | NT Length | AA Length | Score | Probability |
|---|---|---|---|---|---|---|
| 860927_c2_503 | 4047 | 9269 | 348 | 1047 | 668 | 1.4e−65 |

| Protein name | Locus Name | Acc# |
|---|---|---|
| | sp:YEIH_ECOLI | P33019 |

Description

HYPOTHETICAL 36.9 KD PROTEIN IN LYSP-NFO INTERGENIC REGION

| ORF Name | NTID | AAID | NT Length | AA Length | Score | Probability |
|---|---|---|---|---|---|---|
| 975780_f3_333 | 4048 | 9270 | 351 | 1056 | 93 | 0.0034 |

| Protein name | Locus Name | Acc# |
|---|---|---|
| troponin T, cardiac muscle:troponin T2 | pir:TPHUTC | |

Description

| ORF Name | NTID | AAID | NT Length | AA Length | Score | Probability |
|---|---|---|---|---|---|---|
| 9927330_c3_627 | 4049 | 9271 | 63 | 192 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 9954757_c3_561 | 4050 | 9272 | 189 | 570 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 9959400_c1_399 | 4051 | 9273 | 367 | 1104 | 815 | 3.8e−81 |

| Protein name | Locus Name | Acc# |
|---|---|---|
| | sp:GCST_BACSU | P54378 |

Description

T PROTEIN)

| ORF Name | NTID | AAID | NT Length | AA Length | Score | Probability |
|---|---|---|---|---|---|---|
| 22438202_f2_1 | 4052 | 9274 | 74 | 222 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 10556942_f3_138 | 4053 | 9275 | 634 | 1905 | 411 | 5.6e−38 |

| Protein name | Locus Name | Acc# |
|---|---|---|
| inner membrane protein homolog | pir:A70155 | A70155 |

Description

| ORF Name | NTID | AAID | NT Length | AA Length | Score | Probability |
|---|---|---|---|---|---|---|
| 11125291_f3_146 | 4054 | 9276 | 191 | 576 | 137 | 2.7e−09 |

| Protein name | Locus Name | Acc# |
|---|---|---|
| transcriptional regulator | gp:BSUB0017 | |

Description

*Bacillus subtilis* complete genome (section 17 of 21): from 3197001 to 3414420.

| ORF Name | NTID | AAID | NT Length | AA Length | Score | Probability |
|---|---|---|---|---|---|---|
| 12931502_f3_166 | 4055 | 9277 | 143 | 432 | 222 | 2.6e−18 |

| Protein name | Locus Name | Acc# |
|---|---|---|
| heat shock protein, class I | pir:D72385 | D72385 |

Description

| ORF Name | NTID | AAID | NT Length | AA Length | Score | Probability |
|---|---|---|---|---|---|---|
| 13860625_c2_279 | 4056 | 9278 | 113 | 342 | 78 | 0.0048 |

| Protein name | Locus Name | Acc# |
|---|---|---|
| conserved hypothetical protein yulD | pir:F70014 | F70014 |

Description

| ORF Name | NTID | AAID | NT Length | AA Length | Score | Probability |
|---|---|---|---|---|---|---|
| 14564061_c1_196 | 4057 | 9279 | 438 | 1317 | 1171 | 7.2e−119 |

| Protein name | Locus Name | Acc# |
|---|---|---|
| coenzyme F390 synthetase II | pir:B69115 | B69115 |

Description

| ORF Name | NTID | AAID | NT Length | AA Length | Score | Probability |
|---|---|---|---|---|---|---|
| 14648587_c3_286 | 4058 | 9280 | 1033 | 3102 | 556 | 1.2e−50 |

| Protein name | Locus Name | Acc# |
|---|---|---|
| sensory transduction histidine kinase slr2098:protein slr2098:protein slr2098 | pir:S75130 | S75130 |

Description

-continued

| ORF Name | NTID | AAID | NT Length | AA Length | Score | Probability |
|---|---|---|---|---|---|---|
| 14667192__f2__90 | 4059 | 9281 | 737 | 2214 | 623 | 4.4e−72 |

| Protein name | Locus Name | Acc# |
|---|---|---|
| Tri r 4 allergen | gp:AF082514 | AF082514 |

Description

Trichophyton rubrum Tri r 4 allergen mRNA, complete cds.

| ORF Name | NTID | AAID | NT Length | AA Length | Score | Probability |
|---|---|---|---|---|---|---|
| 188135__c2__259 | 4060 | 9282 | 556 | 1671 | 264 | 1.0e−35 |

| Protein name | Locus Name | Acc# |
|---|---|---|
| | sp:YCLF__BACSU | P94408 |

Description

HYPOTHETICAL 53.3 KD PROTEIN IN SFP-GERKA INTERGENIC REGION

| ORF Name | NTID | AAID | NT Length | AA Length | Score | Probability |
|---|---|---|---|---|---|---|
| 19709682__c1__235 | 4061 | 9283 | 207 | 621 | 549 | 5.9e−53 |

| Protein name | Locus Name | Acc# |
|---|---|---|
| CDP-4-keto-6-deoxy-D-glucose-3-dehydrase | pir:E47070 | E47070 |

Description

| ORF Name | NTID | AAID | NT Length | AA Length | Score | Probability |
|---|---|---|---|---|---|---|
| 19742217__f1__44 | 4062 | 9284 | 189 | 570 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 19785941__c2__237 | 4063 | 9285 | 476 | 1431 | 597 | 2.6e−103 |

| Protein name | Locus Name | Acc# |
|---|---|---|
| | sp:YBHF__ECOLI | P75776 |

Description

HYPOTHETICAL ABC TRANSPORTER ATP-BINDING PROTEIN YBHF

| ORF Name | NTID | AAID | NT Length | AA Length | Score | Probability |
|---|---|---|---|---|---|---|
| 1992182__f2__107 | 4064 | 9286 | 112 | 339 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 20195302_f3_161 | 4065 | 9287 | 452 | 1359 | 83 | 0.016 |

| Protein name | | | | Locus Name | | Acc# |
|---|---|---|---|---|---|---|
| | | | | sp:YK58_YEAST | | P36158 |

Description

HYPOTHETICAL 68.3 KD PROTEIN IN SIS2-MTD1 INTERGENIC REGION

| ORF Name | NTID | AAID | NT Length | AA Length | Score | Probability |
|---|---|---|---|---|---|---|
| 20321015_c2_242 | 4066 | 9288 | 61 | 186 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 20364090_c3_324 | 4067 | 9289 | 958 | 2877 | 331 | 1.2e−25 |

| Protein name | | | | Locus Name | | Acc# |
|---|---|---|---|---|---|---|
| hypothetical protein C26D10.4 | | | | pir:T19486 | | T19486 |

Description

| ORF Name | NTID | AAID | NT Length | AA Length | Score | Probability |
|---|---|---|---|---|---|---|
| 20595050_c2_261 | 4068 | 9290 | 409 | 1230 | 385 | 1.4e−35 |

| Protein name | | | | Locus Name | | Acc# |
|---|---|---|---|---|---|---|
| hypothetical protein SC5C7.08 SC5C7.08 | | | | pir:T35215 | | T35215 |

Description

| ORF Name | NTID | AAID | NT Length | AA Length | Score | Probability |
|---|---|---|---|---|---|---|
| 21522003_c3_318 | 4069 | 9291 | 142 | 429 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 22438202_c1_233 | 4070 | 9292 | 172 | 519 | 180 | 7.4e−14 |

| Protein name | | | | Locus Name | | Acc# |
|---|---|---|---|---|---|---|
| unknown | | | | gp:AF048749 | | AF048749 |

Description

*Bacteroides fragilis* capsular polysaccharide biosynthesis operon, complete sequence.

-continued

| ORF Name | NTID | AAID | NT Length | AA Length | Score | Probability |
|---|---|---|---|---|---|---|
| 22462760_c2_239 | 4071 | 9293 | 367 | 1104 | 470 | 1.4e−44 |

| Protein name | Locus Name | Acc# |
|---|---|---|
| | sp:YBHS_ECOLI | P75775 |

Description

HYPOTHETICAL 42.1 KD PROTEIN IN MOAE-RHLE INTERGENIC REGION

| ORF Name | NTID | AAID | NT Length | AA Length | Score | Probability |
|---|---|---|---|---|---|---|
| 22930450_c2_236 | 4072 | 9294 | 179 | 540 | 146 | 1.4e−09 |

| Protein name | Locus Name | Acc# |
|---|---|---|
| | sp:YHII_ECOLI | P37626 |

Description (F355)

| ORF Name | NTID | AAID | NT Length | AA Length | Score | Probability |
|---|---|---|---|---|---|---|
| 23459636_f3_160 | 4073 | 9295 | 117 | 354 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 23516000_c1_213 | 4074 | 9296 | 93 | 282 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 23594055_c1_190 | 4075 | 9297 | 116 | 351 | 90 | 0.00026 |

| Protein name | Locus Name | Acc# |
|---|---|---|
| | sp:Y13B_BPT4 | P17308 |

Description

HYPOTHETICAL 11.5 KD PROTEIN IN GP31-CD INTERGENIC REGION (ORF B)

| ORF Name | NTID | AAID | NT Length | AA Length | Score | Probability |
|---|---|---|---|---|---|---|
| 23642175_f1_11 | 4076 | 9298 | 424 | 1275 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 23926877_c1_214 | 4077 | 9299 | 485 | 1458 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 23986057_f1_22 | 4078 | 9300 | 447 | 1344 | 363 | 6.7e−36 |

| Protein name | Locus Name | Acc# |
|---|---|---|
| damage-inducible protein PAB0243 | pir:A75151 | A75151 |

Description

| ORF Name | NTID | AAID | NT Length | AA Length | Score | Probability |
|---|---|---|---|---|---|---|
| 24225316_c1_197 | 4079 | 9301 | 150 | 453 | 284 | 7.1e−25 |

| Protein name | Locus Name | Acc# |
|---|---|---|
| hypothetical protein MTH1854 | pir:A69115 | A69115 |

Description

| ORF Name | NTID | AAID | NT Length | AA Length | Score | Probability |
|---|---|---|---|---|---|---|
| 24257937_c1_204 | 4080 | 9302 | 363 | 1092 | 117 | 2.1e−06 |

| Protein name | Locus Name | Acc# |
|---|---|---|
| hypothetical protein PAB0603 | pir:E75137 | E75137 |

Description

| ORF Name | NTID | AAID | NT Length | AA Length | Score | Probability |
|---|---|---|---|---|---|---|
| 24400285_f3_156 | 4081 | 9303 | 259 | 780 | 132 | 2.1e−06 |

| Protein name | Locus Name | Acc# |
|---|---|---|
| conserved hypothetical protein | pir:F75328 | F75328 |

Description

| ORF Name | NTID | AAID | NT Length | AA Length | Score | Probability |
|---|---|---|---|---|---|---|
| 24648876_f2_100 | 4082 | 9304 | 237 | 714 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24820300_c2_241 | 4083 | 9305 | 200 | 603 | 122 | 1.4e−05 |

| Protein name | Locus Name | Acc# |
|---|---|---|
| | sp:XERC_SALTY | P55888 |

Description

INTEGRASE/RECOMBINASE XERC

-continued

| ORF Name | NTID | AAID | NT Length | AA Length | Score | Probability |
|---|---|---|---|---|---|---|
| 25429715_c3_323 | 4084 | 9306 | 546 | 1641 | 935 | 5.8e−112 |

| Protein name | Locus Name | Acc# |
|---|---|---|
| helicase | gp:RNDNAB | Y13813 |

Description

Rhodothermus marinus dnaB gene.

| ORF Name | NTID | AAID | NT Length | AA Length | Score | Probability |
|---|---|---|---|---|---|---|
| 25601662_c1_189 | 4085 | 9307 | 105 | 318 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 26574061_f2_106 | 4086 | 9308 | 244 | 735 | 472 | 8.5e−45 |

| Protein name | Locus Name | Acc# |
|---|---|---|
| sanA protein | pir:D75549 | D75549 |

Description

| ORF Name | NTID | AAID | NT Length | AA Length | Score | Probability |
|---|---|---|---|---|---|---|
| 26594082_c1_222 | 4087 | 9309 | 192 | 579 | 559 | 5.1e−54 |

| Protein name | Locus Name | Acc# |
|---|---|---|
| Na-translocating NADH-quinone reductase, Nqr5 subunit | pir:A72399 | A72399 |

Description

| ORF Name | NTID | AAID | NT Length | AA Length | Score | Probability |
|---|---|---|---|---|---|---|
| 26744012_c1_200 | 4088 | 9310 | 943 | 2832 | 2616 | 5.4e−272 |

| Protein name | Locus Name | Acc# |
|---|---|---|
| | sp:UVRA_BACSU | O34863 |

Description

EXCINUCLEASE ABC SUBUNIT A

| ORF Name | NTID | AAID | NT Length | AA Length | Score | Probability |
|---|---|---|---|---|---|---|
| 26758427_c3_321 | 4089 | 9311 | 202 | 609 | 555 | 1.4e−53 |

| Protein name | Locus Name | Acc# |
|---|---|---|
| Na-translocating NADH-quinone reductase, Nqr4 subunit | pir:H72398 | H72398 |

Description

| ORF Name | NTID | AAID | NT Length | AA Length | Score | Probability |
|---|---|---|---|---|---|---|
| 2944087_c1_203 | 4090 | 9312 | 115 | 348 | 225 | 1.3e−18 |

| Protein name | Locus Name | Acc# |
|---|---|---|
| conserved hypothetical protein SCE20.33c. | gp:SCE20 | AL136058 |

Description

*Streptomyces coelicolor* cosmid E20.

| ORF Name | NTID | AAID | NT Length | AA Length | Score | Probability |
|---|---|---|---|---|---|---|
| 3025037_c3_287 | 4091 | 9313 | 705 | 2118 | 220 | 5.5e−21 |

| Protein name | Locus Name | Acc# |
|---|---|---|
| site-specific recombinase | gp:D86934 | D86934 |

Description

*Staphylococcus aureus* genes, mec region, partial and complete cds.

| ORF Name | NTID | AAID | NT Length | AA Length | Score | Probability |
|---|---|---|---|---|---|---|
| 33397127_c2_254 | 4092 | 9314 | 116 | 351 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 34022187_c2_272 | 4093 | 9315 | 334 | 1005 | 766 | 5.9e−76 |

| Protein name | Locus Name | Acc# |
|---|---|---|
| Na-translocating NADH-quinone reductase, Nqr2 subunit | pir:F72398 | F72398 |

Description

| ORF Name | NTID | AAID | NT Length | AA Length | Score | Probability |
|---|---|---|---|---|---|---|
| 34179712_f3_154 | 4094 | 9316 | 682 | 2049 | 1936 | 6.2e−200 |

| Protein name | Locus Name | Acc# |
|---|---|---|
| | sp:UVRB_BACSU | |

Description

EXCINUCLEASE ABC SUBUNIT B (DINA PROTEIN)

| ORF Name | NTID | AAID | NT Length | AA Length | Score | Probability |
|---|---|---|---|---|---|---|
| 35344626_c1_201 | 4095 | 9317 | 176 | 531 | 355 | 2.1e−32 |

| Protein name | Locus Name | Acc# |
|---|---|---|
| | sp:EBSC_ENTFA | P36922 |

Description

EBSC PROTEIN

| ORF Name | NTID | AAID | NT Length | AA Length | Score | Probability |
|---|---|---|---|---|---|---|
| 36129012_c2_239 | 4096 | 9318 | 275 | 828 | 312 | 7.6e−28 |

| Protein name | Locus Name | Acc# |
|---|---|---|
| | sp:YBHR_ECOLI | P75774 |

Description

HYPOTHETICAL 41.6 KD PROTEIN IN MOAE-RHLE INTERGENIC REGION

| ORF Name | NTID | AAID | NT Length | AA Length | Score | Probability |
|---|---|---|---|---|---|---|
| 36350812_f1_25 | 4097 | 9319 | 62 | 189 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 3940668_f1_45 | 4098 | 9320 | 657 | 1974 | 237 | 8.1e−32 |

| Protein name | Locus Name | Acc# |
|---|---|---|
| conserved hypothetical protein ylbK | pir:H69874 | H69874 |

Description

| ORF Name | NTID | AAID | NT Length | AA Length | Score | Probability |
|---|---|---|---|---|---|---|
| 3945187_f3_137 | 4099 | 9321 | 542 | 1629 | 1569 | 4.8e−161 |

| Protein name | Locus Name | Acc# |
|---|---|---|
| | sp:PYRG_BACSU | P13242 |

Description

CTP SYNTHASE, (UTP--AMMONIA LIGASE) (CTP SYNTHETASE)

| ORF Name | NTID | AAID | NT Length | AA Length | Score | Probability |
|---|---|---|---|---|---|---|
| 3945301_c3_319 | 4100 | 9322 | 293 | 882 | 231 | 2.9e−19 |

| Protein name | Locus Name | Acc# |
|---|---|---|
| | sp:YDGM_ECOLI | P77223 |

Description

PUTATIVE FERREDOXIN-LIKE PROTEIN IN ADD-NTH INTERGENIC REGION

| ORF Name | NTID | AAID | NT Length | AA Length | Score | Probability |
|---|---|---|---|---|---|---|
| 39642_c3_327 | 4101 | 9323 | 196 | 591 | 841 | 6.7e−84 |

| Protein name | Locus Name | Acc# |
|---|---|---|
| dTDP-6-deoxy-D-glucose-3,5 epimerase | gp:AF048749 | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 4069800_c2_246 | 4102 | 9324 | 81 | 246 | 100 | 2.2e−05 |

| Protein name | Locus Name | Acc# |
|---|---|---|
| | sp:RPC_BPPH1 | |

Description

IMMUNITY REPRESSOR PROTEIN

| ORF Name | NTID | AAID | NT Length | AA Length | Score | Probability |
|---|---|---|---|---|---|---|
| 424002_f3_165 | 4103 | 9325 | 180 | 543 | 178 | 4.7e−13 |

| Protein name | Locus Name | Acc# |
|---|---|---|
| alanine--tRNA ligase, | pir:E72216 | E72216 |

Description

| ORF Name | NTID | AAID | NT Length | AA Length | Score | Probability |
|---|---|---|---|---|---|---|
| 4328380_c2_282 | 4104 | 9326 | 298 | 897 | 1398 | 6.3e−143 |

| Protein name | Locus Name | Acc# |
|---|---|---|
| glucose-1-phosphate thymidyl transferase | gp:AF048749 | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 4455000_c1_223 | 4105 | 9327 | 364 | 1095 | 864 | 2.4e−86 |

| Protein name | Locus Name | Acc# |
|---|---|---|
| | sp:GALE_BACSU | P55180 |

Description

GALACTOSE 4-EPIMERASE)

| ORF Name | NTID | AAID | NT Length | AA Length | Score | Probability |
|---|---|---|---|---|---|---|
| 4507781_f2_73 | 4106 | 9328 | 277 | 834 | 322 | 6.6e−29 |

| Protein name | Locus Name | Acc# |
|---|---|---|
| | sp:YABH_BACSU | P37550 |

Description

HYPOTHETICAL 31.7 KD PROTEIN IN SSPF-PURR INTERGENIC REGION (ORF1)

| ORF Name | NTID | AAID | NT Length | AA Length | Score | Probability |
|---|---|---|---|---|---|---|
| 4865687_f3_150 | 4107 | 9329 | 598 | 1797 | 156 | 2.2e−08 |

| Protein name | Locus Name | Acc# |
|---|---|---|
| cell wall-binding protein homolog yocH | pir:E69901 | E69901 |

Description

-continued

| ORF Name | NTID | AAID | NT Length | AA Length | Score | Probability |
|---|---|---|---|---|---|---|
| 4876682_c3_320 | 4108 | 9330 | 452 | 1359 | 986 | 2.9e−99 |

| Protein name | Locus Name | Acc# |
|---|---|---|
| hypothetical protein TM0244 | pir:E72398 | E72398 |

Description

| ORF Name | NTID | AAID | NT Length | AA Length | Score | Probability |
|---|---|---|---|---|---|---|
| 5095262_f3_129 | 4109 | 9331 | 423 | 1272 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 6027187_c1_220 | 4110 | 9332 | 279 | 840 | 221 | 3.3e−18 |

| Protein name | Locus Name | Acc# |
|---|---|---|
| | sp:YDGP_ECOLI | P77285 |

Description

HYPOTHETICAL 21.9 KD PROTEIN IN ADD-NTH INTERGENIC REGION

| ORF Name | NTID | AAID | NT Length | AA Length | Score | Probability |
|---|---|---|---|---|---|---|
| 788125_f3_157 | 4111 | 9333 | 548 | 1647 | 122 | 0.00083 |

| Protein name | Locus Name | Acc# |
|---|---|---|
| ORF MSV198 MTG motif gene family protein | gp:AF063866 | AF063866 |

Description

Melanoplus sanguinipes entomopoxvirus, complete genome.

| ORF Name | NTID | AAID | NT Length | AA Length | Score | Probability |
|---|---|---|---|---|---|---|
| 911251_c2_253 | 4112 | 9334 | 275 | 828 | 155 | 6.0e−09 |

| Protein name | Locus Name | Acc# |
|---|---|---|
| hypothetical protein aq_1273 | pir:C70410 | C70410 |

Description

| ORF Name | NTID | AAID | NT Length | AA Length | Score | Probability |
|---|---|---|---|---|---|---|
| 9680_f3_153 | 4113 | 9335 | 71 | 216 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 9865837_c3_326 | 4114 | 9336 | 177 | 534 | 233 | 1.8e−19 |

| Protein name | Locus Name | Acc# |
|---|---|---|
| unknown | gp:AF048749 | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 9921876_c3_295 | 4115 | 9337 | 161 | 486 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 9932642_c1_183 | 4116 | 9338 | 106 | 321 | 92 | 0.00016 |

| Protein name | Locus Name | Acc# |
|---|---|---|
| | gp:D90716 | |

Description

*Escherichia coli* genomic DNA. (17.6–18.0 min).

| ORF Name | NTID | AAID | NT Length | AA Length | Score | Probability |
|---|---|---|---|---|---|---|
| 11131528_c2_62 | 4117 | 9339 | 60 | 183 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 11133437_f1_3 | 4118 | 9340 | 1168 | 3507 | 480 | 6.8e−42 |

| Protein name | Locus Name | Acc# |
|---|---|---|
| receptor antigen (RagA) | gp:GPI130872 | AJ130872 |

Description

*Porphyromonas gingivalis* W50 receptor antigen (rag) locus encoding a major immundominatn 55 kDa antigen.

| ORF Name | NTID | AAID | NT Length | AA Length | Score | Probability |
|---|---|---|---|---|---|---|
| 11719042_f1_1 | 4119 | 9341 | 810 | 2433 | 1607 | 4.5e−165 |

| Protein name | Locus Name | Acc# |
|---|---|---|
| probable polyribonucleotide nucleotidyltransferase (pnp) | pir:C71269 | C71269 |

Description

-continued

| ORF Name | NTID | AAID | NT Length | AA Length | Score | Probability |
|---|---|---|---|---|---|---|
| 13869003_f3_31 | 4120 | 9342 | 538 | 1617 | 135 | 2.9e−05 |

| Protein name | Locus Name | Acc# |
|---|---|---|
| cell surface antigen-like protein A29L | pri:T17519 | T17519 |

Description

| ORF Name | NTID | AAID | NT Length | AA Length | Score | Probability |
|---|---|---|---|---|---|---|
| 14650277_f1_7 | 4121 | 9343 | 253 | 762 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 26364040_f1_5 | 4122 | 9344 | 86 | 261 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 3907687_f3_28 | 4123 | 9345 | 313 | 942 | 115 | 0.00025 |

| Protein name | Locus Name | Acc# |
|---|---|---|
| transmembrane sensor | gp:AF051691 | AF051691 |

Description

*Pseudomonas aeruginosa* stress factor A (psfA), ECF sigma factor (fiuI), transmembrane sensor (fiuR), and hydroxamate-type ferrisiderophore receptor (fiuA) genes, complete cds.

| ORF Name | NTID | AAID | NT Length | AA Length | Score | Probability |
|---|---|---|---|---|---|---|
| 4104632_c2_56 | 4124 | 9346 | 374 | 1125 | 974 | 5.4e−08 |

| Protein name | Locus Name | Acc# |
|---|---|---|
| butyrate kinase | gp:AB016775 | AB016775 |

Description

*Clostradium perfringens* DNA for butyrate kinase and hydrogenase, complete cds.

| ORF Name | NTID | AAID | NT Length | AA Length | Score | Probability |
|---|---|---|---|---|---|---|
| 4303262_f2_13 | 4125 | 9347 | 189 | 570 | 196 | 1.5e−15 |

| Protein name | Locus Name | Acc# |
|---|---|---|
| RNA polymerase sigma factor SigZ-like protein | gp:AF137263 | AF137263 |

Description

Bacteroides thetaiotaomicron 30S ribosomal protein S16-like protein, fucose gene cluster, and RNA polymerase sigma factor SigZ-like protein (sigZ) genes, complete cds.

-continued

| ORF Name | NTID | AAID | NT Length | AA Length | Score | Probability |
|---|---|---|---|---|---|---|
| 4305337_f1_4 | 4126 | 9348 | 542 | 1629 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 4765625_c2_73 | 4127 | 9349 | 250 | 750 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 4820378_c2_61 | 4128 | 9350 | 107 | 324 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 6438187_c1_38 | 4129 | 9351 | 317 | 954 | 476 | 3.2e−45 |

| Protein name | | | | Locus Name | | Acc# |
|---|---|---|---|---|---|---|
| | | | | sp:PTB_CLOAB | | Q05624 |

Description

PHOSPHATE BUTYRYLTRANSFERASE, (PHOSPHOTRANSBUTYRYLASE)

| ORF Name | NTID | AAID | NT Length | AA Length | Score | Probability |
|---|---|---|---|---|---|---|
| 9923505_f1_6 | 4130 | 9352 | 548 | 1647 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 15834557_f1_1 | 4131 | 9353 | 88 | 267 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 831550_f1_2 | 4132 | 9354 | 388 | 1164 | 452 | 1.4e−41 |

| Protein name | Locus Name | Acc# |
|---|---|---|
| 115K outer membrane protein precursor:SusC protein | pir:JC6027 | JC6027 |

Description

| ORF Name | NTID | AAID | NT Length | AA Length | Score | Probability |
|---|---|---|---|---|---|---|
| 1959377_f2_2 | 4133 | 9355 | 71 | 216 | 93 | 0.0021 |

| Protein name | Locus Name | Acc# |
|---|---|---|
| maturase-like protein | gp:CPESPSBC | AJ222583 |

Description

Euglena spirogyra chloroplast partial psbC gene & complete internal mat2 gene.

| ORF Name | NTID | AAID | NT Length | AA Length | Score | Probability |
|---|---|---|---|---|---|---|
| 24736386_c3_3 | 4134 | 9356 | 62 | 189 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 14241518_c1_63 | 4135 | 9357 | 79 | 240 | 116 | 4.5e−07 |

| Protein name | Locus Name | Acc# |
|---|---|---|
| iron(III) transport protein A | pir:C72423 | C72423 |

Description

| ORF Name | NTID | AAID | NT Length | AA Length | Score | Probability |
|---|---|---|---|---|---|---|
| 15017517_f3_37 | 4136 | 9358 | 790 | 2373 | 912 | 2.0e−91 |

| Protein name | Locus Name | Acc# |
|---|---|---|
| | sp:PBPC_ECOLI | P76577 |

Description

BIFUNCTIONAL PENICILLIN-BINDING PROTEIN 1C PRECURSOR (PBP-1C)

| ORF Name | NTID | AAID | NT Length | AA Length | Score | Probability |
|---|---|---|---|---|---|---|
| 19692186_f1_3 | 4137 | 9359 | 442 | 1329 | 391 | 1.1e−43 |

| Protein name | Locus Name | Acc# |
|---|---|---|
| cell cycle protein homolog mesJ | pir:T31465 | T31465 |

Description

-continued

| ORF Name | NTID | AAID | NT Length | AA Length | Score | Probability |
|---|---|---|---|---|---|---|
| 24067651_f1_15 | 4138 | 9360 | 182 | 549 | 137 | 2.7e−09 |

| Protein name | Locus Name | Acc# |
|---|---|---|
| vsrD protein | pir:I40540 | I40540 |

Description

| ORF Name | NTID | AAID | NT Length | AA Length | Score | Probability |
|---|---|---|---|---|---|---|
| 31803882_f2_28 | 4139 | 9361 | 350 | 1053 | 635 | 4.5e−62 |

| Protein name | Locus Name | Acc# |
|---|---|---|
| conserved hypothetical protein | pir:H72370 | H72370 |

Description

| ORF Name | NTID | AAID | NT Length | AA Length | Score | Probability |
|---|---|---|---|---|---|---|
| 32112785_c3_93 | 4140 | 9362 | 93 | 282 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 32228163_c1_64 | 4141 | 9363 | 299 | 897 | 371 | 1.7e−40 |

| Protein name | Locus Name | Acc# |
|---|---|---|
| | sp:FEOB_METJA | Q57986 |

Description

FERROUS IRON TRANSPORT PROTEIN B HOMOLOG

| ORF Name | NTID | AAID | NT Length | AA Length | Score | Probability |
|---|---|---|---|---|---|---|
| 33785957_f1_14 | 4142 | 9364 | 208 | 627 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 34183437_f2_29 | 4143 | 9365 | 482 | 1449 | 751 | 2.3e−74 |

| Protein name | Locus Name | Acc# |
|---|---|---|
| Na+/H+ antiporter homolog yheL | pir:D69829 | D69829 |

Description

| ORF Name | NTID | AAID | NT Length | AA Length | Score | Probability |
|---|---|---|---|---|---|---|
| 4376056_c1_61 | 4144 | 9366 | 63 | 192 | | |
| Protein name | | | Locus Name | | Acc# | |
| Description | | | | | | |

NO-HIT

| ORF Name | NTID | AAID | NT Length | AA Length | Score | Probability |
|---|---|---|---|---|---|---|
| 4423751_f3_38 | 4145 | 9367 | 394 | 1185 | 572 | 2.1e−55 |
| Protein name | | | Locus Name | | Acc# | |
| antibiotic resistance protein homolog ydeR | | | pir:D69779 | | D69779 | |
| Description | | | | | | |

| ORF Name | NTID | AAID | NT Length | AA Length | Score | Probability |
|---|---|---|---|---|---|---|
| 648382_f1_4 | 4146 | 9368 | 1870 | 5613 | 644 | 1.5e−60 |
| Protein name | | | Locus Name | | Acc# | |
| hypothetical protein b2520 | | | pir:G65028 | | G65028 | |
| Description | | | | | | |

| ORF Name | NTID | AAID | NT Length | AA Length | Score | Probability |
|---|---|---|---|---|---|---|
| 10603135_f1_6 | 4147 | 9369 | 161 | 486 | 162 | 6.0e−12 |
| Protein name | | | Locus Name | | Acc# | |
| hypothetical protein CT276 | | | pir:A71535 | | A71535 | |
| Description | | | | | | |

| ORF Name | NTID | AAID | NT Length | AA Length | Score | Probability |
|---|---|---|---|---|---|---|
| 1179767_f1_7 | 4148 | 9370 | 421 | 1266 | | |
| Protein name | | | Locus Name | | Acc# | |
| Description | | | | | | |

NO-HIT

| ORF Name | NTID | AAID | NT Length | AA Length | Score | Probability |
|---|---|---|---|---|---|---|
| 1251313_c1_26 | 4149 | 9371 | 386 | 1161 | 1228 | 6.5e−125 |
| Protein name | | | Locus Name | | Acc# | |
| | | | sp:SYW_CLOLO | | Q46127 | |
| Description | | | | | | |

(TRPRS)

-continued

| ORF Name | NTID | AAID | NT Length | AA Length | Score | Probability |
|---|---|---|---|---|---|---|
| 20975051_f1_1 | 4150 | 9372 | 399 | 1200 | 396 | 9.6e−37 |

| Protein name | Locus Name | Acc# |
|---|---|---|
| immunoreactive 42 kD antigen PG33 | gp:AF175715 | AF175715 |

Description

*Porphyromonas gingivalis* strain W50 immunoreactive 42 kD antigen PG33 gene, complete cds.

| ORF Name | NTID | AAID | NT Length | AA Length | Score | Probability |
|---|---|---|---|---|---|---|
| 23595253_c1_22 | 4151 | 9373 | 62 | 189 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24494037_f3_15 | 4152 | 9374 | 304 | 915 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 25516062_f2_10 | 4153 | 9375 | 529 | 1587 | 220 | 1.1e−14 |

| Protein name | Locus Name | Acc# |
|---|---|---|
| immunogenic 75 kDa protein PG4 | gp:AF145800 | AF145800 |

Description

*Porphyromonas gingivalis* strain W50 immunogenic 75 kDa protein PG4 gene, complete cds.

| ORF Name | NTID | AAID | NT Length | AA Length | Score | Probability |
|---|---|---|---|---|---|---|
| 30210933_f3_13 | 4154 | 9376 | 332 | 999 | 144 | 4.2e−07 |

| Protein name | Locus Name | Acc# |
|---|---|---|
| transposase | gp:AF038866 | AF038866 |

Description

*Bacteroides fragilis* transposon Tn5520 transposase (bipH) and mobilization protein BmpH (bmpH) genes, complete cds.

| ORF Name | NTID | AAID | NT Length | AA Length | Score | Probability |
|---|---|---|---|---|---|---|
| 33242837_f2_9 | 4155 | 9377 | 202 | 609 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 4718936_f3_12 | 4156 | 9378 | 1081 | 3246 | 3056 | 0.0 |

| Protein name | Locus Name | Acc# |
|---|---|---|
| | sp:PYR1_DICDI | P20054 |

Description

| ORF Name | NTID | AAID | NT Length | AA Length | Score | Probability |
|---|---|---|---|---|---|---|
| 7140652_c3_50 | 4157 | 9379 | 112 | 339 | 82 | 0.032 |

| Protein name | Locus Name | Acc# |
|---|---|---|
| EntT | gp:AF099088 | AF099088 |

Description

*Enterococcus faecium* enterocin A (entA), EntI (entI), EntF (entF), EntK (entK), EntR (entR), bacteriocin-like protein, EntT (entT), EntD (entD), and protease IV homolog genes, complete cds; and unknown genes.

| ORF Name | NTID | AAID | NT Length | AA Length | Score | Probability |
|---|---|---|---|---|---|---|
| 10741300_f3_30 | 4158 | 9380 | 191 | 576 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 1210910_f2_18 | 4159 | 9381 | 389 | 1170 | 252 | 8.5e−29 |

| Protein name | Locus Name | Acc# |
|---|---|---|
| proline dipeptidase | pir:D75419 | D75419 |

Description

| ORF Name | NTID | AAID | NT Length | AA Length | Score | Probability |
|---|---|---|---|---|---|---|
| 135050_f3_22 | 4160 | 9382 | 69 | 210 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 14651386_f3_29 | 4161 | 9383 | 471 | 1416 | 2343 | 4.6e−243 |

| Protein name | Locus Name | Acc# |
|---|---|---|
| | sp:DHE4_BACFR | P94316 |

Description (NAD (P)H-DEPENDENT GLUTAMATE DEHYDROGENASE)

-continued

| ORF Name | NTID | AAID | NT Length | AA Length | Score | Probability |
|---|---|---|---|---|---|---|
| 24251553_c2_40 | 4162 | 9384 | 248 | 747 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24661587_c2_41 | 4163 | 9385 | 201 | 606 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24895037_c2_39 | 4164 | 9386 | 994 | 2985 | 152 | 8.9e−06 |

| Protein name | | | | Locus Name | | Acc# |
|---|---|---|---|---|---|---|
| probable phosphenolpyruvate synthase APE0026 | | | | pir:E72754 | | E72754 |

Description

| ORF Name | NTID | AAID | NT Length | AA Length | Score | Probability |
|---|---|---|---|---|---|---|
| 26288137_f1_7 | 4165 | 9387 | 81 | 246 | 114 | 1.2e−05 |

| Protein name | | | | Locus Name | | Acc# |
|---|---|---|---|---|---|---|
| | | | | sp:PPCE_HUMAN | | P48147 |

Description (PE)

| ORF Name | NTID | AAID | NT Length | AA Length | Score | Probability |
|---|---|---|---|---|---|---|
| 3959800_c3_48 | 4166 | 9388 | 274 | 825 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 16493766_c1_41 | 4167 | 9389 | 104 | 315 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 20510052_f3_39 | 4168 | 9390 | 63 | 192 | | |

| Protein name | | | | Locus Name | | Acc# |
|---|---|---|---|---|---|---|

Description

NO-HIT

-continued

| ORF Name | NTID | AAID | NT Length | AA Length | Score | Probability |
|---|---|---|---|---|---|---|
| 23627302_f3_40 | 4169 | 9391 | 336 | 1011 | 117 | 0.00030 |

| Protein name | Locus Name | Acc# |
|---|---|---|
| transmembrane sensor | gp:AF051691 | AF051691 |

Description

*Pseudomonas aeruginosa* stress factor A (psfA), ECF sigma factor (fiuI), transmembrane sensor (fiuR), and hydroxamate-type ferrisiderophore receptor (fiuA) genes, complete cds.

| ORF Name | NTID | AAID | NT Length | AA Length | Score | Probability |
|---|---|---|---|---|---|---|
| 24354562_c3_66 | 4170 | 9392 | 515 | 1548 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24642186_c2_55 | 4171 | 9393 | 545 | 1638 | 156 | 3.2e−07 |

| Protein name | Locus Name | Acc# |
|---|---|---|
| unknown | gp:U96771 | U96771 |

Description

*Prevotella bryantii* putative polygalacturonase, B-1,4-endoglucanase, and mannanase genes, complete cds; and unknown genes.

| ORF Name | NTID | AAID | NT Length | AA Length | Score | Probability |
|---|---|---|---|---|---|---|
| 24736386_c2_48 | 4172 | 9394 | 62 | 189 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 26376562_c2_54 | 4173 | 9395 | 452 | 1359 | 477 | 2.9e−44 |

| Protein name | Locus Name | Acc# |
|---|---|---|
| 115K outer membrane protein precursor:SusC protein | pir:JC6027 | JC6027 |

Description

| ORF Name | NTID | AAID | NT Length | AA Length | Score | Probability |
|---|---|---|---|---|---|---|
| 29462512_f1_12 | 4174 | 9396 | 201 | 606 | 182 | 4.5e−14 |

| Protein name | Locus Name | Acc# |
|---|---|---|
| RNA polymerase sigma factor SigZ-like protein | gp:AF137263 | AF137263 |

Description

Bacteroides thetaiotaomicron 30S ribosomal protein S16-like protein, fucose gene cluster, and RNA polymerase sigma factor SigZ-like protein (sigZ) genes, complete cds.

| ORF Name | NTID | AAID | NT Length | AA Length | Score | Probability |
|---|---|---|---|---|---|---|
| 34171886_c2_51 | 4175 | 9397 | 583 | 1752 | 110 | 1.2e−07 |

| Protein name | Locus Name | Acc# |
|---|---|---|
| unknown | gp:U96771 | U96771 |

Description

*Prevotella bryantii* putative polygalacturonase, B-1,4-endoglucanase, and mannanase genes, complete cds; and unknown genes.

| ORF Name | NTID | AAID | NT Length | AA Length | Score | Probability |
|---|---|---|---|---|---|---|
| 36442805_c1_43 | 4176 | 9398 | 1128 | 3387 | 561 | 2.1e−86 |

| Protein name | Locus Name | Acc# |
|---|---|---|
| receptor antigen (RagA) | gp:PGI130872 | AJ130872 |

Description

*Porphyromonas gingivalis* W50 receptor antigen (rag) locus encoding a major immunodominant 55 kDa antigen.

| ORF Name | NTID | AAID | NT Length | AA Length | Score | Probability |
|---|---|---|---|---|---|---|
| 3929183_c1_47 | 4177 | 9399 | 496 | 1491 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 831550_c1_46 | 4178 | 9400 | 648 | 1947 | 588 | 3.1e−56 |

| Protein name | Locus Name | Acc# |
|---|---|---|
| 115K outer membrane protein precursor:SusC protein | pir:JC6027 | JC6027 |

Description

| ORF Name | NTID | AAID | NT Length | AA Length | Score | Probability |
|---|---|---|---|---|---|---|
| 831550_c3_61 | 4179 | 9401 | 1140 | 3423 | 801 | 5.2e−88 |

| Protein name | Locus Name | Acc# |
|---|---|---|
| receptor antigen (RagA) | gp:PGI130872 | AJ130872 |

Description

*Porphyromonas gingivalis* W50 receptor antigen (rag) locus encoding a major immunodominant 55 kDa antigen.

| ORF Name | NTID | AAID | NT Length | AA Length | Score | Probability |
|---|---|---|---|---|---|---|
| 990937_c1_45 | 4180 | 9402 | 591 | 1776 | 121 | 0.00017 |

| Protein name | Locus Name | Acc# |
|---|---|---|
| outer membrane protein | gp:BNROMPB | L77614 |

Description

Bacteroides thetaiotaomicron outer membrane protein (susD) gene, complete cds.

-continued

| ORF Name | NTID | AAID | NT Length | AA Length | Score | Probability |
|---|---|---|---|---|---|---|
| 1208550_f2_43 | 4181 | 9403 | 169 | 510 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 12947287_f3_65 | 4182 | 9404 | 87 | 264 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 13869003_f1_15 | 4183 | 9405 | 161 | 486 | 215 | 1.4e−17 |

| Protein name | | | | Locus Name | | Acc# |
|---|---|---|---|---|---|---|
| unknown | | | | gp:AF048749 | | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 14478901_c2_102 | 4184 | 9406 | 77 | 234 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 15103800_f1_19 | 4185 | 9407 | 94 | 285 | 78 | 0.018 |

| Protein name | | | | Locus Name | | Acc# |
|---|---|---|---|---|---|---|
| response regulator | | | | gp:AF130997 | | AF130997 |

Description

*Enterococcus faecium* strain BM4339 vanD glycopeptide resistance gene cluster, complete sequence.

| ORF Name | NTID | AAID | NT Length | AA Length | Score | Probability |
|---|---|---|---|---|---|---|
| 15822833_f2_21 | 4186 | 9408 | 76 | 231 | 198 | 5.1e−15 |

| Protein name | | | | Locus Name | | Acc# |
|---|---|---|---|---|---|---|
| conserved hypothetical protein yisQ | | | | pir:H69837 | | H69837 |

Description

-continued

| ORF Name | NTID | AAID | NT Length | AA Length | Score | Probability |
|---|---|---|---|---|---|---|
| 16601633_c2_120 | 4187 | 9409 | 85 | 258 | | |
| Protein name | | | | Locus Name | | Acc# |

Description

NO-HIT

| ORF Name | NTID | AAID | NT Length | AA Length | Score | Probability |
|---|---|---|---|---|---|---|
| 16603427_f2_40 | 4188 | 9140 | 402 | 1209 | 1820 | 1.2e−187 |
| Protein name | | | | Locus Name | | Acc# |
| UDP-ManNAc dehydrogenase | | | | gp:AF125164 | | AF125164 |

Description

*Bacteroides fragilis* 638R polysaccharide B (PS B2) biosynthesis locus, sequence; and unknown genes.

| ORF Name | NTID | AAID | NT Length | AA Length | Score | Probability |
|---|---|---|---|---|---|---|
| 16832885_c2_101 | 4189 | 9411 | 431 | 1296 | 1723 | 2.3e−177 |
| Protein name | | | | Locus Name | | Acc# |
| hypothetical protein | | | | pir:JQ1020 | | JQ1020 |

Description

| ORF Name | NTID | AAID | NT Length | AA Length | Score | Probability |
|---|---|---|---|---|---|---|
| 20782802_f3_58 | 4190 | 9412 | 81 | 246 | | |
| Protein name | | | | Locus Name | | Acc# |

Description

NO-HIT

| ORF Name | NTID | AAID | NT Length | AA Length | Score | Probability |
|---|---|---|---|---|---|---|
| 21672181_c3_137 | 4191 | 9413 | 278 | 837 | | |
| Protein name | | | | Locus Name | | Acc# |

Description

NO-HIT

| ORF Name | NTID | AAID | NT Length | AA Length | Score | Probability |
|---|---|---|---|---|---|---|
| 22469452_f1_14 | 4192 | 9414 | 174 | 525 | 174 | 3.2e−13 |
| Protein name | | | | Locus Name | | Acc# |
| unknown | | | | gp:AF048749 | | AF048749 |

Description

*Bacteroides fragilis* capsular polysaccharide biosynthesis operon, complete sequence.

-continued

| ORF Name | NTID | AAID | NT Length | AA Length | Score | Probability |
|---|---|---|---|---|---|---|
| 22657551_c1_94 | 4193 | 9415 | 565 | 1698 | 539 | 7.9e−58 |

| Protein name | Locus Name | Acc# |
|---|---|---|
| long-chain-fatty-acid CoA ligase | pir:D70386 | D70386 |

Description

| ORF Name | NTID | AAID | NT Length | AA Length | Score | Probability |
|---|---|---|---|---|---|---|
| 22658450_f2_46 | 4194 | 9416 | 72 | 219 | 156 | 2.7e−10 |

| Protein name | Locus Name | Acc# |
|---|---|---|
| arylsulfotransferase | gp:AF126201 | AF126201 |

Description

*Pseudomonas putida* strain S-313 sulfate ester desulfurization gene locus, complete sequence.

| ORF Name | NTID | AAID | NT Length | AA Length | Score | Probability |
|---|---|---|---|---|---|---|
| 22736336_c2_99 | 4195 | 9417 | 103 | 312 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 22860128_c3_125 | 4196 | 9418 | 83 | 252 | 64 | 0.031 |

| Protein name | Locus Name | Acc# |
|---|---|---|
| | sp:SPRC_XENLA | P36378 |

Description (OSTEONECTIN) (ON) (BASEMENT MEMBRANE PROTEIN BM-40)

| ORF Name | NTID | AAID | NT Length | AA Length | Score | Probability |
|---|---|---|---|---|---|---|
| 22899000_f1_17 | 4197 | 9419 | 114 | 345 | 59 | 0.0024 |

| Protein name | Locus Name | Acc# |
|---|---|---|
| retinoid X receptor alpha homolog | gp:UPU31832 | U31832 |

Description

Uca pugilator retanoid X receptor alpha homolog mRNA, DNA binding domain region, partial cds.

| ORF Name | NTID | AAID | NT Length | AA Length | Score | Probability |
|---|---|---|---|---|---|---|
| 24035212_c2_110 | 4198 | 9420 | 129 | 390 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 24242700_c3_140 | 4199 | 9421 | 364 | 1095 | 569 | 6.8e−86 |

| Protein name | Locus Name | Acc# |
|---|---|---|
| GDP-L-fucose pathway enzyme | gp:AB008676 | AB008676 |

Description

*Escherichia coli* 0157 DNA, map position at 46 min., complete cds.

| ORF Name | NTID | AAID | NT Length | AA Length | Score | Probability |
|---|---|---|---|---|---|---|
| 24806501_c1_95 | 4200 | 9422 | 386 | 1161 | 153 | 9.9e−08 |

| Protein name | Locus Name | Acc# |
|---|---|---|
| probable PPE protein | pir:D70604 | D70604 |

Description

| ORF Name | NTID | AAID | NT Length | AA Length | Score | Probability |
|---|---|---|---|---|---|---|
| 2547261_f2_37 | 4201 | 9423 | 83 | 252 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 2598842_f1_18 | 4202 | 9424 | 69 | 210 | 57 | 0.041 |

| Protein name | Locus Name | Acc# |
|---|---|---|
| | gp:F23A5 | AC011713 |

Description

*Arabidopsis thaliana* chromosome 1 BAC F23A5 sequence, complete sequence.

| ORF Name | NTID | AAID | NT Length | AA Length | Score | Probability |
|---|---|---|---|---|---|---|
| 2742755_f2_47 | 4203 | 9425 | 63 | 192 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 29693877_f2_41 | 4204 | 9426 | 390 | 1173 | 1608 | 3.5e−165 |

| Protein name | Locus Name | Acc# |
|---|---|---|
| UDP-GlcNac 2-epimerase | gp:AF125164 | AF125164 |

Description

*Bacteroides fragilis* 638R polysaccharide B (PS B2) biosynthesis locus, complete sequence; and unknown genes.

-continued

| ORF Name | NTID | AAID | NT Length | AA Length | Score | Probability |
|---|---|---|---|---|---|---|
| 31444127_f3_51 | 4205 | 9427 | 673 | 2022 | 1578 | 5.3e−162 |

| Protein name | | | | Locus Name | | Acc# |
|---|---|---|---|---|---|---|
| fructose-bisphosphatase, | | | | pir:C69621 | | C69621 |

Description

| ORF Name | NTID | AAID | NT Length | AA Length | Score | Probability |
|---|---|---|---|---|---|---|
| 3314078_f3_71 | 4206 | 9428 | 133 | 402 | 125 | 3.9e−07 |

| Protein name | | | | Locus Name | | Acc# |
|---|---|---|---|---|---|---|
| probable lipopolysaccharide O-side chain biosynthesis protein (O-antigen transporter) | | | | pir:F71152 | | F71152 |

Description

| ORF Name | NTID | AAID | NT Length | AA Length | Score | Probability |
|---|---|---|---|---|---|---|
| 34266886_c3_136 | 4207 | 9429 | 122 | 369 | | |

| Protein name | | | | Locus Name | | Acc# |

Description

NO-HIT

| ORF Name | NTID | AAID | NT Length | AA Length | Score | Probability |
|---|---|---|---|---|---|---|
| 35166437_f2_39 | 4208 | 9430 | 89 | 270 | | |

| Protein name | | | | Locus Name | | Acc# |

Description

NO-HIT

| ORF Name | NTID | AAID | NT Length | AA Length | Score | Probability |
|---|---|---|---|---|---|---|
| 35343753_c1_77 | 4209 | 9431 | 61 | 186 | | |

| Protein name | | | | Locus Name | | Acc# |

Description

NO-HIT

| ORF Name | NTID | AAID | NT Length | AA Length | Score | Probability |
|---|---|---|---|---|---|---|
| 36134625_f2_36 | 4210 | 9432 | 296 | 891 | 1351 | 6.0e−138 |

| Protein name | | | | Locus Name | | Acc# |
|---|---|---|---|---|---|---|
| glucose-1-phosphate thymidyl transferase | | | | gp:AF048749 | | AF048749 |

Description

*Bacteroides fragilis* capsular polysaccharide biosynthesis operon, complete sequence.

-continued

| ORF Name | NTID | AAID | NT Length | AA Length | Score | Probability |
|---|---|---|---|---|---|---|
| 4469002_f3_50 | 4211 | 9433 | 556 | 1671 | 955 | 5.6e−96 |

| Protein name | Locus Name | Acc# |
|---|---|---|
| | sp:YIDE_ECOLI | |

Description

HYPOTHETICAL 58.9 KD PROTEIN IN GLVC-IBPB INTERGENIC REGION (ORFA)

| ORF Name | NTID | AAID | NT Length | AA Length | Score | Probability |
|---|---|---|---|---|---|---|
| 4694052_f3_67 | 4212 | 9434 | 343 | 1032 | 1134 | 6.0e−115 |

| Protein name | Locus Name | Acc# |
|---|---|---|
| Cap8E | gp:SAU73374 | U73374 |

Description

*Staphylococcus aureus* type 8 capsule genes, cap8A, cap8B, cap8C, cap8D, cap8E, cap8F, cap8G, cap8H, cap8I, cap8J, cap8K, cap8L, cap8M, cap8N, cap8O, cap8P, complete cds.

| ORF Name | NTID | AAID | NT Length | AA Length | Score | Probability |
|---|---|---|---|---|---|---|
| 4720327_f3_62 | 4213 | 9435 | 187 | 564 | 792 | 1.0e−78 |

| Protein name | Locus Name | Acc# |
|---|---|---|
| dTDP-6-deoxy-D-glucose-3,5 epimerase | gp:AF048749 | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 4941937_c2_112 | 4214 | 9436 | 374 | 1125 | 1219 | 5.9e−124 |

| Protein name | Locus Name | Acc# |
|---|---|---|
| GDP-mannose dehydratase | gp:AF047478 | |

Description

*Brucella melitensis* strain 16M lipopolysaccharide O side chain biosynthesis gene cluster, complete sequence.

| ORF Name | NTID | AAID | NT Length | AA Length | Score | Probability |
|---|---|---|---|---|---|---|
| 5115927_f2_42 | 4215 | 9437 | 364 | 1095 | 475 | 4.1e−45 |

| Protein name | Locus Name | Acc# |
|---|---|---|
| pleiotropic regulatory protein DegT | pir:D69025 | D69025 |

Description

| ORF Name | NTID | AAID | NT Length | AA Length | Score | Probability |
|---|---|---|---|---|---|---|
| 5878176_f3_68 | 4216 | 9438 | 83 | 252 | 76 | 0.048 |

| Protein name | Locus Name | Acc# |
|---|---|---|
| reverse transcriptase like protein 1, intron-encoded | pir:S58503 | S58503 |

Description

-continued

| ORF Name | NTID | AAID | NT Length | AA Length | Score | Probability |
|---|---|---|---|---|---|---|
| 7062750_f2_44 | 4217 | 9439 | 358 | 1077 | 334 | 3.6e−30 |

| Protein name | Locus Name | Acc# |
|---|---|---|
| aspartate aminotransferase (aspb-like1) PAB0774 | pir:D75096 | D75096 |

Description

| ORF Name | NTID | AAID | NT Length | AA Length | Score | Probability |
|---|---|---|---|---|---|---|
| 7314165_f1_11 | 4218 | 9440 | 360 | 1083 | 407 | 6.5e−38 |

| Protein name | Locus Name | Acc# |
|---|---|---|
| | sp:YA38_HAEIN | P44099 |

Description

HYPOTHETICAL PROTEIN HI1038

| ORF Name | NTID | AAID | NT Length | AA Length | Score | Probability |
|---|---|---|---|---|---|---|
| 828957_f3_64 | 4219 | 9441 | 83 | 252 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 10737801_c3_238 | 4220 | 9442 | 471 | 1416 | 718 | 7.2e−71 |

| Protein name | Locus Name | Acc# |
|---|---|---|
| probable oxidoreductase | gp:SCF11 | AL132662 |

Description

*Streptomyces coelicolor* cosmid F11.

| ORF Name | NTID | AAID | NT Length | AA Length | Score | Probability |
|---|---|---|---|---|---|---|
| 11877138_c2_215 | 4221 | 9443 | 319 | 960 | 372 | 3.3e−34 |

| Protein name | Locus Name | Acc# |
|---|---|---|
| shikimate 5-dehydrogenase | pir:F70377 | F70377 |

Description

| ORF Name | NTID | AAID | NT Length | AA Length | Score | Probability |
|---|---|---|---|---|---|---|
| 11963262_c3_239 | 4222 | 9444 | 263 | 792 | 334 | 3.6e−30 |

| Protein name | Locus Name | Acc# |
|---|---|---|
| conserved hypothetical protein | pir:G72409 | G72409 |

Description

-continued

| ORF Name | NTID | AAID | NT Length | AA Length | Score | Probability |
|---|---|---|---|---|---|---|
| 12507691_c2_217 | 4223 | 9445 | 274 | 825 | 478 | 2.0e−45 |

| Protein name | Locus Name | Acc# |
|---|---|---|
| lemA protein | pir:F72311 | F72311 |

Description

| ORF Name | NTID | AAID | NT Length | AA Length | Score | Probability |
|---|---|---|---|---|---|---|
| 12539091_c2_230 | 4224 | 9446 | 862 | 2589 | 493 | 2.9e−46 |

| Protein name | Locus Name | Acc# |
|---|---|---|
|  | sp:ALR2_BACSU | P94494 |

Description

PUTATIVE ALANINE RACEMASE,

| ORF Name | NTID | AAID | NT Length | AA Length | Score | Probability |
|---|---|---|---|---|---|---|
| 15051562_c1_181 | 4225 | 9447 | 96 | 291 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 15657052_c2_211 | 4226 | 9448 | 169 | 510 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 15829675_f2_57 | 4227 | 9449 | 525 | 1578 | 137 | 2.e−05 |

| Protein name | Locus Name | Acc# |
|---|---|---|
| receptor antigen (RagA) | sp:PGI130872 | AJ130872 |

Description

*Porphyromonas gingivalis* W50 receptor antigen (rag) locus encoding a major immunodominant 55 kDa antigen.

| ORF Name | NTID | AAID | NT Length | AA Length | Score | Probability |
|---|---|---|---|---|---|---|
| 16131877_c2_231 | 4228 | 9450 | 272 | 819 | 318 | 1.7e−31 |

| Protein name | Locus Name | Acc# |
|---|---|---|
| conserved hypothetical integral membrane protein HP1061 | pir:E64652 | E64652 |

Description

-continued

| ORF Name | NTID | AAID | NT Length | AA Length | Score | Probability |
|---|---|---|---|---|---|---|
| 20089042_c2_205 | 4229 | 9451 | 1043 | 3132 | 1063 | 1.2e-194 |

| Protein name | Locus Name | Acc# |
|---|---|---|
| beta-galactosidase | pir:F72283 | F72283 |

Description

| ORF Name | NTID | AAID | NT Length | AA Length | Score | Probability |
|---|---|---|---|---|---|---|
| 20710888_f3_138 | 4230 | 9452 | 100 | 303 | 72 | 0.043 |

| Protein name | Locus Name | Acc# |
|---|---|---|
| glutamine-asparagine rich protein | gp:DDU07817 | U07817 |

Description

*Dictyostelium discoicteum* AX3 glutamine-asparagine rich protein gene, partial cds.

| ORF Name | NTID | AAID | NT Length | AA Length | Score | Probability |
|---|---|---|---|---|---|---|
| 22147552_c2_232 | 4231 | 9453 | 397 | 1194 | 268 | 8.0e-22 |

| Protein name | Locus Name | Acc# |
|---|---|---|
| 3-O-acyltransferase, MdmB:midecamycin biosynthesis enzyme | pir:A42719 | A42719 |

Description

| ORF Name | NTID | AAID | NT Length | AA Length | Score | Probability |
|---|---|---|---|---|---|---|
| 23492786_c2_228 | 4332 | 9454 | 85 | 258 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 23632187_c1_184 | 4233 | 9455 | 262 | 789 | 536 | 1.4e-51 |

| Protein name | Locus Name | Acc# |
|---|---|---|
| | sp:LPXA_ECOLI | |

Description (EC 2.3.1.129) (UDP-N-ACETYLGLUCOSAMINE ACYLTRANSFERASE)

| ORF Name | NTID | AAID | NT Length | AA Length | Score | Probability |
|---|---|---|---|---|---|---|
| 23712776_c2_218 | 4234 | 9456 | 389 | 1170 | 177 | 1.1e-23 |

| Protein name | Locus Name | Acc# |
|---|---|---|
| | sp:PUR5_METJA | Q57656 |

Description (AIRS) (PHOSPHORIBOSYL-AMINOIMIDAZOLE SYNTHETASE) (AIR SYNTHASE)

-continued

| ORF Name | NTID | AAID | NT Length | AA Length | Score | Probability |
|---|---|---|---|---|---|---|
| 23850828_c3_254 | 4235 | 9457 | 86 | 261 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 23867302_c2_222 | 4236 | 9458 | 230 | 693 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24038577_c2_219 | 4237 | 9459 | 370 | 1113 | 899 | 4.8e−90 |

| Protein name | | | | Locus Name | | Acc# |
|---|---|---|---|---|---|---|
| | | | | sp:RF1_COXBU | | P47849 |

Description

PEPTIDE CHAIN RELEASE FACTOR 1 (RF-1)

| ORF Name | NTID | AAID | NT Length | AA Length | Score | Probability |
|---|---|---|---|---|---|---|
| 24119033_c2_227 | 4238 | 9460 | 130 | 393 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24223382_c2_206 | 4239 | 9461 | 368 | 1107 | 566 | 9.2e−55 |

| Protein name | | | | Locus Name | | Acc# |
|---|---|---|---|---|---|---|
| hypothetical protein slr1880 | | | | pir:S77134 | | S77134 |

Description

| ORF Name | NTID | AAID | NT Length | AA Length | Score | Probability |
|---|---|---|---|---|---|---|
| 24299131_c3_257 | 4240 | 9462 | 72 | 219 | 70 | 0.033 |

| Protein name | | | | Locus Name | | Acc# |
|---|---|---|---|---|---|---|
| ribosomal protein L20 | | | | pir:A75326 | | A75326 |

Description

-continued

| ORF Name | NTID | AAID | NT Length | AA Length | Score | Probability |
|---|---|---|---|---|---|---|
| 24391561_c3_248 | 4241 | 9463 | 548 | 1647 | 395 | 1.2e−36 |

| Protein name | Locus Name | Acc# |
|---|---|---|
|  | sp:YUAG_BACSU | O32076 |

Description

HYPOTHETICAL 56.0 KD PROTEIN IN GLGB-GBSB INTERGENIC REGION

| ORF Name | NTID | AAID | NT Length | AA Length | Score | Probability |
|---|---|---|---|---|---|---|
| 24408457_c1_198 | 4242 | 9464 | 1180 | 3543 | 535 | 7.0e−59 |

| Protein name | Locus Name | Acc# |
|---|---|---|
| hypothetical protein sll1582 | pir:S75309 | S75309 |

Description

| ORF Name | NTID | AAID | NT Length | AA Length | Score | Probability |
|---|---|---|---|---|---|---|
| 24634681_c3_256 | 4243 | 9465 | 462 | 1389 | 382 | 2.7e−44 |

| Protein name | Locus Name | Acc# |
|---|---|---|
|  | sp:LPXC_HAEIN | P45070 |

Description (EC 3.5.1.—)

| ORF Name | NTID | AAID | NT Length | AA Length | Score | Probability |
|---|---|---|---|---|---|---|
| 24640752_f2_45 | 4244 | 9466 | 417 | 1254 |  |  |

| Protein name | Locus Name | Acc# |
|---|---|---|
|  |  |  |

Description

NO-HIT

| ORF Name | NTID | AAID | NT Length | AA Length | Score | Probability |
|---|---|---|---|---|---|---|
| 2461553_c2_220 | 4245 | 9467 | 248 | 747 | 404 | 1.4e−37 |

| Protein name | Locus Name | Acc# |
|---|---|---|
| OMP decarboxylase-orotate phosphoribosyl transferase, | pir:T30520 | T30520 |

Description

| ORF Name | NTID | AAID | NT Length | AA Length | Score | Probability |
|---|---|---|---|---|---|---|
| 24695302_c3_249 | 4246 | 9468 | 251 | 756 | 465 | 4.7e−44 |

| Protein name | Locus Name | Acc# |
|---|---|---|
| ubiquinone/menaquinone biosynthesis methyltransferase | pir:F75277 | F75277 |

Description

| ORF Name | NTID | AAID | NT Length | AA Length | Score | Probability |
|---|---|---|---|---|---|---|
| 24735830_c3_258 | 4247 | 9469 | 395 | 1188 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24801442_f2_44 | 4248 | 9470 | 76 | 231 | 90 | 0.0023 |

| Protein name | | | | Locus Name | | Acc# |
|---|---|---|---|---|---|---|
| probable glycosyl hydrolase | | | | pir:T36467 | | T36467 |

Description

| ORF Name | NTID | AAID | NT Length | AA Length | Score | Probability |
|---|---|---|---|---|---|---|
| 26211057_f1_36 | 4249 | 9471 | 601 | 1806 | 91 | 0.017 |

| Protein name | | | | Locus Name | | Acc# |
|---|---|---|---|---|---|---|
| polygalacturonase precursor | | | | pir:S57806 | | S57806 |

Description

| ORF Name | NTID | AAID | NT Length | AA Length | Score | Probability |
|---|---|---|---|---|---|---|
| 26361438_f2_82 | 4250 | 9472 | 226 | 681 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 29344691_f3_110 | 4251 | 9473 | 703 | 2112 | 255 | 8.9e−21 |

| Protein name | | | | Locus Name | | Acc# |
|---|---|---|---|---|---|---|
| histidine kinase | | | | gp:SPAJ6393 | | AJ006393 |

Description

*Streptococcus pneumoniae* rr03 and hk03 genes; two component system03.

| ORF Name | NTID | AAID | NT Length | AA Length | Score | Probability |
|---|---|---|---|---|---|---|
| 31520840_f2_95 | 4252 | 9474 | 80 | 240 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 33235880_f2_55 | 4253 | 9475 | 64 | 195 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 33612762_f2_81 | 4254 | 9476 | 318 | 957 | 204 | 5.2e−16 |
| Protein name | | | Locus Name | | | Acc# |
| hypothetical protein aq_246 | | | pir:E70322 | | | E70322 |
| Description | | | | | | |

| ORF Name | NTID | AAID | NT Length | AA Length | Score | Probability |
|---|---|---|---|---|---|---|
| 34173175_c2_214 | 4255 | 9477 | 318 | 957 | 611 | 1.6e−59 |
| Protein name | | | Locus Name | | | Acc# |
| | | | sp:PUR7_ARATH | | | P38025 |
| Description | | | | | | |

(EC 6.3.2.6) (SAICAR SYNTHETASE)

| ORF Name | NTID | AAID | NT Length | AA Length | Score | Probability |
|---|---|---|---|---|---|---|
| 34546942_f2_80 | 4256 | 9478 | 399 | 1200 | 195 | 7.7e−15 |
| Protein name | | | Locus Name | | | Acc# |
| conserved hypothetical protein | | | pir:C72361 | | | C72361 |
| Description | | | | | | |

| ORF Name | NTID | AAID | NT Length | AA Length | Score | Probability |
|---|---|---|---|---|---|---|
| 35396062_f1_14 | 4257 | 9479 | 79 | 240 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 35401883_f1_43 | 4258 | 9480 | 147 | 444 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 36523452_c2_216 | 4259 | 9481 | 316 | 951 | 327 | 2.0e−29 |
| Protein name | | | Locus Name | | | Acc# |
| | | | sp:YQKD_BACSU | | | P54567 |
| Description | | | | | | |

HYPOTHETICAL 34.6 KD PROTEIN IN GLNQ-ANSR INTERGENIC REGION

-continued

| ORF Name | NTID | AAID | NT Length | AA Length | Score | Probability |
|---|---|---|---|---|---|---|
| 3948392_c3_255 | 4260 | 9482 | 349 | 1050 | 577 | 6.3e−56 |

| Protein name | Locus Name | Acc# |
|---|---|---|
| | sp:LPXD_RICRI | P32202 |

Description (EC 2.3.1.—) (FIRA PROTEIN) (RIFAMPICIN RESISTANCE PROTEIN)

| ORF Name | NTID | AAID | NT Length | AA Length | Score | Probability |
|---|---|---|---|---|---|---|
| 3956556_c2_223 | 4261 | 9483 | 304 | 915 | 525 | 2.0e−50 |

| Protein name | Locus Name | Acc# |
|---|---|---|
| tRNA isopentenylpyrophosphate transferase miaA | pir:G69657 | G69657 |

Description

| ORF Name | NTID | AAID | NT Length | AA Length | Score | Probability |
|---|---|---|---|---|---|---|
| 424042_f1_37 | 4262 | 9484 | 264 | 795 | 404 | 1.4e−37 |

| Protein name | Locus Name | Acc# |
|---|---|---|
| | sp:TRUA_BACSU | P70973 |

Description

I) (PSEUDOURIDINE SYNTHASE I) (URACIL HYDROLYASE)

| ORF Name | NTID | AAID | NT Length | AA Length | Score | Probability |
|---|---|---|---|---|---|---|
| 4351562_c3_250 | 4263 | 9485 | 375 | 1128 | 255 | 1.2e−30 |

| Protein name | Locus Name | Acc# |
|---|---|---|
| conserved hypothetical protein | pir:G72311 | G72311 |

Description

| ORF Name | NTID | AAID | NT Length | AA Length | Score | Probability |
|---|---|---|---|---|---|---|
| 4711562_f3_135 | 4264 | 9486 | 230 | 693 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4767252_c1_174 | 4265 | 9487 | 340 | 1023 | 710 | 5.1e−70 |

| Protein name | Locus Name | Acc# |
|---|---|---|
| | gp:BMAJ4829 | AJ224829 |

Description

*Bacillus megaterium* DSM319 spoIV operon, 5' flanking region, 3' flanking region.

-continued

| ORF Name | NTID | AAID | NT Length | AA Length | Score | Probability |
|---|---|---|---|---|---|---|
| 5082512_c3_265 | 4266 | 9488 | 332 | 999 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 6360910_c1_196 | 4267 | 9489 | 79 | 240 | 155 | 3.3e−11 |

| Protein name | | | | Locus Name | | Acc# |
|---|---|---|---|---|---|---|
| conserved hypothetical secreted protein HP0320 | | | | pir:H64559 | | H64559 |

Description

| ORF Name | NTID | AAID | NT Length | AA Length | Score | Probability |
|---|---|---|---|---|---|---|
| 7126431_c1_185 | 4268 | 9490 | 61 | 186 | 72 | 0.020 |

| Protein name | | | | Locus Name | | Acc# |
|---|---|---|---|---|---|---|
| leech zinc finger protein | | | | gp:HTDNALZF1 | | X91396 |

Description

*H. triserialis* Lzf1 gene.

| ORF Name | NTID | AAID | NT Length | AA Length | Score | Probability |
|---|---|---|---|---|---|---|
| 85882_f2_56 | 4269 | 9491 | 135 | 408 | 147 | 2.3e−10 |

| Protein name | | | | Locus Name | | Acc# |
|---|---|---|---|---|---|---|
| | | | | sp:MECI_STAEP | | P26598 |

Description

METHICILLIN RESISTANCE REGULATORY PROTEIN MECI

| ORF Name | NTID | AAID | NT Length | AA Length | Score | Probability |
|---|---|---|---|---|---|---|
| 992787_c2_221 | 4270 | 9492 | 437 | 1314 | 498 | 1.5e−47 |

| Protein name | | | | Locus Name | | Acc# |
|---|---|---|---|---|---|---|
| | | | | sp:YWFO_BACSU | | P39651 |

Description

HYPOTHETICAL 51.0 KD PROTEIN IN PAT 3' REGION

| ORF Name | NTID | AAID | NT Length | AA Length | Score | Probability |
|---|---|---|---|---|---|---|
| 14922291_c3_55 | 4271 | 9493 | 287 | 864 | | |

| Protein name | | | | Locus Name | | Acc# |
|---|---|---|---|---|---|---|

Description

NO-HIT

-continued

| ORF Name | NTID | AAID | NT Length | AA Length | Score | Probability |
|---|---|---|---|---|---|---|
| 22079700_f2_11 | 4272 | 9494 | 174 | 525 | 362 | 3.8e−33 |

| Protein name | Locus Name | Acc# |
|---|---|---|
| | sp:RODA_ECOLI | |

Description

ROD SHAPE-DETERMINING PROTEIN RODA

| ORF Name | NTID | AAID | NT Length | AA Length | Score | Probability |
|---|---|---|---|---|---|---|
| 23495336_c3_52 | 4273 | 9495 | 115 | 348 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 2350306_c2_42 | 4274 | 9496 | 100 | 303 | 105 | 6.6e−06 |

| Protein name | Locus Name | Acc# |
|---|---|---|
| hypothetical protein PH0217 | pir:G71244 | G71244 |

Description

| ORF Name | NTID | AAID | NT Length | AA Length | Score | Probability |
|---|---|---|---|---|---|---|
| 23944506_c2_39 | 4275 | 9497 | 63 | 192 | 108 | 3.2e−06 |

| Protein name | Locus Name | Acc# |
|---|---|---|
| hypothetical protein PH0219 | pir:A71245 | A71245 |

Description

| ORF Name | NTID | AAID | NT Length | AA Length | Score | Probability |
|---|---|---|---|---|---|---|
| 24417061_c1_33 | 4276 | 9498 | 362 | 1089 | 389 | 5.3e−36 |

| Protein name | Locus Name | Acc# |
|---|---|---|
| | sp:METF_AQUAE | O67422 |

Description 5,10-METHYLENETETRAHYDROFOLATE REDUCTASE,

| ORF Name | NTID | AAID | NT Length | AA Length | Score | Probability |
|---|---|---|---|---|---|---|
| 282708_c3_45 | 4277 | 9499 | 60 | 183 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 5332506_c2_38 | 4278 | 9500 | 95 | 288 | 73 | 0.034 |

| Protein name | Locus Name | Acc# |
|---|---|---|
| hypothetical protein PH0220 | pir:B71245 | B71245 |

Description

| ORF Name | NTID | AAID | NT Length | AA Length | Score | Probability |
|---|---|---|---|---|---|---|
| 579667_c2_43 | 4279 | 9501 | 492 | 1479 | 418 | 4.5e−39 |

| Protein name | Locus Name | Acc# |
|---|---|---|
|  | sp:YAAT_BACSU | P37541 |

Description

HYPOTHETICAL 31.2 KD PROTEIN IN XPAC-ABRB INTERGENIC REGION

| ORF Name | NTID | AAID | NT Length | AA Length | Score | Probability |
|---|---|---|---|---|---|---|
| 9658_c1_34 | 4280 | 9502 | 370 | 1113 | 168 | 1.1e−19 |

| Protein name | Locus Name | Acc# |
|---|---|---|
| DNA polymerase III gamma subunit | pir:A70460 | A70460 |

Description

| ORF Name | NTID | AAID | NT Length | AA Length | Score | Probability |
|---|---|---|---|---|---|---|
| 10838905_c1_26 | 4281 | 9503 | 97 | 294 |  |  |

| Protein name | Locus Name | Acc# |
|---|---|---|
|  |  |  |

Description

NO-HIT

| ORF Name | NTID | AAID | NT Length | AA Length | Score | Probability |
|---|---|---|---|---|---|---|
| 11197928_f1_1 | 4282 | 9504 | 828 | 2487 | 649 | 4.5e−112 |

| Protein name | Locus Name | Acc# |
|---|---|---|
|  | sp:BGLS_AGRTU | P27034 |

Description

GLUCOSIDE GLUCOHYDROLASE)

| ORF Name | NTID | AAID | NT Length | AA Length | Score | Probability |
|---|---|---|---|---|---|---|
| 12698552_c3_72 | 4283 | 9505 | 325 | 978 | 398 | 5.9e−37 |

| Protein name | Locus Name | Acc# |
|---|---|---|
|  | sp:MMSR_PSEAE | P28809 |

Description

MMSAB OPERON REGULATORY PROTEIN

-continued

| ORF Name | NTID | AAID | NT Length | AA Length | Score | Probability |
|---|---|---|---|---|---|---|
| 19944466_f1_9 | 4284 | 9506 | 348 | 1047 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 2031705_f1_2 | 4285 | 9507 | 482 | 1449 | 847 | 1.5e−84 |

| Protein name | | | Locus Name | | | Acc# |
|---|---|---|---|---|---|---|
| L-arabinose transport (permease) araE | | | pir:F69587 | | | F69587 |

Description

| ORF Name | NTID | AAID | NT Length | AA Length | Score | Probability |
|---|---|---|---|---|---|---|
| 24651537_f2_14 | 4286 | 9508 | 1102 | 3309 | 2097 | 5.4e−217 |

| Protein name | | | Locus Name | | | Acc# |
|---|---|---|---|---|---|---|
| | | | sp:YPHG_ECOLI | | | P76585 |

Description

HYPOTHETICAL 127.3 KD PROTEIN IN CSIE-GLYA INTERGENIC REGION

| ORF Name | NTID | AAID | NT Length | AA Length | Score | Probability |
|---|---|---|---|---|---|---|
| 34069436_f1_8 | 4287 | 9509 | 940 | 2823 | 261 | 2.5e−18 |

| Protein name | | | Locus Name | | | Acc# |
|---|---|---|---|---|---|---|
| beta-galactosidase | | | gp:AF055482 | | | AF055482 |

Description

Thermotoga neapolitana galactose utilization operon, complete sequence.

| ORF Name | NTID | AAID | NT Length | AA Length | Score | Probability |
|---|---|---|---|---|---|---|
| 15789087_c2_51 | 4288 | 9510 | 224 | 675 | 179 | 9.5e−14 |

| Protein name | | | Locus Name | | | Acc# |
|---|---|---|---|---|---|---|
| RNA polymerase sigma factor SigZ-like protein | | | gp:AF137263 | | | AF137263 |

Description

Bactericides thetaiotaomicron 30S ribosomal protein S16-like protein, fucose
gene cluster, and RNA polymerase sigma factor SigZ-like protein (sigZ) genes, complete cds.

| ORF Name | NTID | AAID | NT Length | AA Length | Score | Probability |
|---|---|---|---|---|---|---|
| 16131437_f2_20 | 4289 | 9511 | 439 | 1320 | 118 | 0.0015 |

| Protein name | | | Locus Name | | | Acc# |
|---|---|---|---|---|---|---|
| BcDNA.GH11973 | | | gp:AF145671 | | | AF145671 |

Description

*Drosophila melanogaster* clone GH11973 BcDNA.GH11973 (BcDNA.GH11973) mRNA,
complete cds.

-continued

| ORF Name | NTID | AAID | NT Length | AA Length | Score | Probability |
|---|---|---|---|---|---|---|
| 20895303_f2_21 | 4290 | 9512 | 1227 | 3684 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 212752_c3_69 | 4291 | 9513 | 814 | 2445 | 518 | 1.2e−46 |

| Protein name | | | Locus Name | | | Acc# |
|---|---|---|---|---|---|---|
| receptor antigen (RagA) | | | gp:GPI130872 | | | AJ130872 |

Description

*Porphyromonas gingivalis* W50 receptor antigen (rag) locus encoding a major immunodominant 55 kDa antigen.

| ORF Name | NTID | AAID | NT Length | AA Length | Score | Probability |
|---|---|---|---|---|---|---|
| 24335781_f3_25 | 4292 | 9514 | 140 | 423 | 77 | 0.0064 |

| Protein name | | | Locus Name | | | Acc# |
|---|---|---|---|---|---|---|
| | | | sp:NOLP_RHILP | | | P23717 |

Description

NODULATION PROTEIN NOLP

| ORF Name | NTID | AAID | NT Length | AA Length | Score | Probability |
|---|---|---|---|---|---|---|
| 25494062_c2_50 | 4293 | 9515 | 84 | 255 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 26594067_c1_39 | 4294 | 9516 | 320 | 963 | 155 | 1.2e−08 |

| Protein name | | | Locus Name | | | Acc# |
|---|---|---|---|---|---|---|
| transmembrane sensor | | | gp:AF051691 | | | AF051691 |

Description

*Pseudomonas aeruginosa* stress factor A (pstA), ECF sigma factor (fiuI), transmembrane sensor (fiuR), and hydroxamate-type ferrisiderophore receptor (fiuA) genes, complete cds.

| ORF Name | NTID | AAID | NT Length | AA Length | Score | Probability |
|---|---|---|---|---|---|---|
| 4103377_f3_30 | 4295 | 9517 | 119 | 360 | | |

| Protein name | | | Locus Name | | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 13878550_f3_40 | 4296 | 9518 | 548 | 1647 | 2831 | 8.9e−295 |

| Protein name | Locus Name | Acc# |
|---|---|---|
| neuraminidase precursor | gp:BNRNANASE | D28493 |

Description

*Bacteroides fragilis* nanH gene for neuraminidase, complete cds.

| ORF Name | NTID | AAID | NT Length | AA Length | Score | Probability |
|---|---|---|---|---|---|---|
| 14876300_c2_90 | 4297 | 9519 | 532 | 1599 | 139 | 6.7e−08 |

| Protein name | Locus Name | Acc# |
|---|---|---|
| unknown | gp:U96771 | U96771 |

Description

*Prevotella bryantii* putative polygalacturonase,B-1,4-endogluconase, and mannanase genes, complete cds; and unknown genes.

| ORF Name | NTID | AAID | NT Length | AA Length | Score | Probability |
|---|---|---|---|---|---|---|
| 16267638_c2_67 | 4298 | 9520 | 93 | 282 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 21595663_f3_39 | 4299 | 9521 | 1083 | 3252 | 519 | 4.8e−84 |

| Protein name | Locus Name | Acc# |
|---|---|---|
| 115K outer membrane protein precursor:SusC protein | pir:JC6027 | JC6027 |

Description

| ORF Name | NTID | AAID | NT Length | AA Length | Score | Probability |
|---|---|---|---|---|---|---|
| 22861562_f2_28 | 4300 | 9522 | 861 | 2586 | 1101 | 1.9e−111 |

| Protein name | Locus Name | Acc# |
|---|---|---|
| hypothetical protein TM1624 | pir:H72228 | H72228 |

Description

| ORF Name | NTID | AAID | NT Length | AA Length | Score | Probability |
|---|---|---|---|---|---|---|
| 24256587_f2_17 | 4301 | 9523 | 549 | 1650 | 125 | 1.5e−06 |

| Protein name | Locus Name | Acc# |
|---|---|---|
| unknown | gp:U96771 | U96771 |

Description

*Prevotella bryantii* putative polygalacturonase, B-1,4-endoglucanase, and mannanase genes, complete cds; and unknown genes.

-continued

| ORF Name | NTID | AAID | NT Length | AA Length | Score | Probability |
|---|---|---|---|---|---|---|
| 24259683_f2_27 | 4302 | 9524 | 691 | 2076 | 331 | 8.1e−35 |

| Protein name | Locus Name | Acc# |
|---|---|---|
| sialic-acid O-acetylesterase | gp:MMU40408 | U40408 |

Description

*Mus musculus* lysosomal sialic acid O-acetylesterase mRNA, complete cds.

| ORF Name | NTID | AAID | NT Length | AA Length | Score | Probability |
|---|---|---|---|---|---|---|
| 24415877_f3_33 | 4303 | 9525 | 521 | 1566 | 107 | 1.2e−07 |

| Protein name | Locus Name | Acc# |
|---|---|---|
| unknown | gp:U96771 | U96771 |

Description

*Prevotella bryantii* putative polygalacturonase, B-1,4-endoglucanase, and mannanase genes, complete cds; and unknown genes.

| ORF Name | NTID | AAID | NT Length | AA Length | Score | Probability |
|---|---|---|---|---|---|---|
| 24429036_c1_51 | 4304 | 9256 | 64 | 195 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24640892_f2_23 | 4305 | 9527 | 673 | 2022 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24648937_f3_41 | 4306 | 9528 | 209 | 630 | 126 | 2.6e−06 |

| Protein name | Locus Name | Acc# |
|---|---|---|
| | sp:PA1B_RAT | O35264 |

Description

ACTIVATING FACTOR ACETYLHYDROALSE ALPHA 2 SUBUNIT) (PAF-AH ALPHA 2)

| ORF Name | NTID | AAID | NT Length | AA Length | Score | Probability |
|---|---|---|---|---|---|---|
| 2772937_c2_89 | 4307 | 9529 | 1093 | 3282 | 528 | 3.0e−89 |

| Protein name | Locus Name | Acc# |
|---|---|---|
| 115K outer membrane protein precursor:SusC protein | pir:JC6027 | JC6027 |

Description

-continued

| ORF Name | NTID | AAID | NT Length | AA Length | Score | Probability |
|---|---|---|---|---|---|---|
| 33243818_f2_13 | 4308 | 9530 | 434 | 1305 | 740 | 1.2e−84 |

| Protein name | | | | Locus Name | | Acc# |
|---|---|---|---|---|---|---|
| alpha-L-fucosidase, 1 precursor, tissue:alpha-L-fucosidase I:alpha-L-fucoside fucohydrolase | | | | pir:HWHUFA | | |

Description

| ORF Name | NTID | AAID | NT Length | AA Length | Score | Probability |
|---|---|---|---|---|---|---|
| 34416427_f1_11 | 4309 | 9531 | 672 | 2019 | 310 | 9.2e−26 |

| Protein name | | | | Locus Name | | Acc# |
|---|---|---|---|---|---|---|
| | | | | sp:HEXA_PORGI | | P49008 |

Description (BETA-NAHASE)

| ORF Name | NTID | AAID | NT Length | AA Length | Score | Probability |
|---|---|---|---|---|---|---|
| 35351583_c3_124 | 4310 | 9532 | 71 | 216 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 4140927_f3_43 | 4311 | 9533 | 518 | 1557 | 1139 | 1.8e−115 |

| Protein name | | | | Locus Name | | Acc# |
|---|---|---|---|---|---|---|
| | | | | sp:HEXA_PORGI | | P49008 |

Description (BETA-NAHASE)

| ORF Name | NTID | AAID | NT Length | AA Length | Score | Probability |
|---|---|---|---|---|---|---|
| 4484687_f3_32 | 4312 | 9534 | 529 | 1590 | 119 | 1.8e−06 |

| Protein name | | | | Locus Name | | Acc# |
|---|---|---|---|---|---|---|
| unknown | | | | gp:U96771 | | U96771 |

Description

*Prevotella bryantii* putative polygalacturonase, B-1,4-endoglucanase, and mannanase genes, complete cds; and unknown genes.

| ORF Name | NTID | AAID | NT Length | AA Length | Score | Probability |
|---|---|---|---|---|---|---|
| 5109392_c1_64 | 4313 | 9535 | 173 | 522 | | |

| Protein name | | | | Locus Name | | Acc# |
|---|---|---|---|---|---|---|

Description

NO-HIT

-continued

| ORF Name | NTID | AAID | NT Length | AA Length | Score | Probability |
|---|---|---|---|---|---|---|
| 781932_f1_4 | 4314 | 9536 | 1118 | 3357 | 463 | 5.9e−82 |

| Protein name | Locus Name | Acc# |
|---|---|---|
| receptor antigen (RagA) | gp:PGI130872 | AJ130872 |

Description

*Porphyromonas gingivalis* W50 receptor antigen (rag) locus encoding a major immunodominant 55 kDa antigen.

| ORF Name | NTID | AAID | NT Length | AA Length | Score | Probability |
|---|---|---|---|---|---|---|
| 781932_f2_16 | 4315 | 9537 | 1102 | 3309 | 526 | 5.1e−83 |

| Protein name | Locus Name | Acc# |
|---|---|---|
| 115K outer membrane protein precursor:SusC protein | pir:JC6027 | JC6027 |

Description

| ORF Name | NTID | AAID | NT Length | AA Length | Score | Probability |
|---|---|---|---|---|---|---|
| 781932_f3_31 | 4316 | 9538 | 1120 | 3363 | 529 | 2.6e−79 |

| Protein name | Locus Name | Acc# |
|---|---|---|
| 115K outer membrane protein precursor:SusC protein | pir:JC6027 | JC6027 |

Description

| ORF Name | NTID | AAID | NT Length | AA Length | Score | Probability |
|---|---|---|---|---|---|---|
| 859438_c3_108 | 4317 | 9539 | 85 | 258 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 1206500_f1_15 | 4318 | 9540 | 385 | 1158 | 465 | 4.7e−44 |

| Protein name | Locus Name | Acc# |
|---|---|---|
| probable nagA protein | pir:C70845 | C70845 |

Description

| ORF Name | NTID | AAID | NT Length | AA Length | Score | Probability |
|---|---|---|---|---|---|---|
| 1272677_f3_45 | 4319 | 9514 | 398 | 1197 | 384 | 1.8e−35 |

| Protein name | Locus Name | Acc# |
|---|---|---|
| hypothetical protein b1325 | pir:H64881 | H64881 |

Description

-continued

| ORF Name | NTID | AAID | NT Length | AA Length | Score | Probability |
|---|---|---|---|---|---|---|
| 14656257_f1_8 | 4320 | 9542 | 451 | 1356 | 479 | 2.7e−48 |

| Protein name | Locus Name | Acc# |
|---|---|---|
| hypothetical protein | pir:A72430 | A72430 |

Description

| ORF Name | NTID | AAID | NT Length | AA Length | Score | Probability |
|---|---|---|---|---|---|---|
| 1959437_f1_18 | 4321 | 9543 | 70 | 213 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 2147656_f2_25 | 4322 | 9544 | 406 | 1221 | 225 | 3.8e−18 |

| Protein name | Locus Name | Acc# |
|---|---|---|
| polysugar degrading enzyme homolog ykfC | pir:A69856 | A69856 |

Description

| ORF Name | NTID | AAID | NT Length | AA Length | Score | Probability |
|---|---|---|---|---|---|---|
| 2350306_c1_62 | 4323 | 9545 | 100 | 303 | 111 | 1.5e−06 |

| Protein name | Locus Name | Acc# |
|---|---|---|
| hypothetical protein PH0217 | pir:G71244 | G71244 |

Description

| ORF Name | NTID | AAID | NT Length | AA Length | Score | Probability |
|---|---|---|---|---|---|---|
| 24407827_f3_50 | 4324 | 9546 | 521 | 1566 | 600 | 2.3e−58 |

| Protein name | Locus Name | Acc# |
|---|---|---|
| | sp:HTRA_ECOLI | |

Description

PROTEASE DO PRECURSOR,

| ORF Name | NTID | AAID | NT Length | AA Length | Score | Probability |
|---|---|---|---|---|---|---|
| 24642211_f2_30 | 4325 | 9547 | 135 | 408 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24665887_f2_20 | 4326 | 9548 | 230 | 693 | 287 | 3.4e−25 |

| Protein name | Locus Name | Acc# |
|---|---|---|
| phosphate transport system regulator PhoU | pir:G72275 | G72275 |

Description

-continued

| ORF Name | NTID | AAID | NT Length | AA Length | Score | Probability |
|---|---|---|---|---|---|---|
| 25977212_f1_3 | 4327 | 9549 | 69 | 210 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 26367177_c3_110 | 4328 | 9550 | 439 | 1320 | 253 | 2.2e−19 |
| Protein name | | | Locus Name | | | Acc# |
| sensory protein kinase | | | pir:T30222 | | | T30222 |
| Description | | | | | | |

| ORF Name | NTID | AAID | NT Length | AA Length | Score | Probability |
|---|---|---|---|---|---|---|
| 2931525_f2_31 | 4329 | 9551 | 394 | 1185 | 192 | 3.3e−12 |
| Protein name | | | Locus Name | | | Acc# |
| clostripain-related protein | | | pir:B72351 | | | B72351 |
| Description | | | | | | |

| ORF Name | NTID | AAID | NT Length | AA Length | Score | Probability |
|---|---|---|---|---|---|---|
| 30494212_f3_51 | 4330 | 9552 | 95 | 288 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 33397186_f1_10 | 4331 | 9553 | 301 | 906 | 933 | 1.2e−93 |
| Protein name | | | Locus Name | | | Acc# |
| SigA | | | gp:CTU67718 | | | U67718 |
| Description | | | | | | |

Chlorobium tepidum SigA (sigA) gene, complete cds.

| ORF Name | NTID | AAID | NT Length | AA Length | Score | Probability |
|---|---|---|---|---|---|---|
| 33398377_f3_43 | 4332 | 9554 | 205 | 618 | 384 | 1.8e−35 |
| Protein name | | | Locus Name | | | Acc# |
| | | | sp:RISA_BACSU | | | |
| Description | | | | | | |

RIBOFLAVIN SYNTHASE ALPHA CHAIN,

-continued

| ORF Name | NTID | AAID | NT Length | AA Length | Score | Probability |
|---|---|---|---|---|---|---|
| 33863876_c2_96 | 4333 | 9555 | 527 | 1584 | | |

| Protein name | | Locus Name | | Acc# |
|---|---|---|---|---|
| | | | | |

Description

NO-HIT

| ORF Name | NTID | AAID | NT Length | AA Length | Score | Probability |
|---|---|---|---|---|---|---|
| 35366625_f2_37 | 4334 | 9556 | 128 | 387 | | |

| Protein name | | Locus Name | | Acc# |
|---|---|---|---|---|
| | | | | |

Description

NO-HIT

| ORF Name | NTID | AAID | NT Length | AA Length | Score | Probability |
|---|---|---|---|---|---|---|
| 36430393_f3_44 | 4335 | 9557 | 189 | 570 | 141 | 4.2e−15 |

| Protein name | | Locus Name | | Acc# |
|---|---|---|---|---|
| | | sp:YDGI_BACSU | | P96707 |

Description

PUTATIVE NAD(P)H NITROREDUCTASE YDGI,

| ORF Name | NTID | AAID | NT Length | AA Length | Score | Probability |
|---|---|---|---|---|---|---|
| 36525157_f2_19 | 4336 | 9558 | 125 | 378 | 496 | 2.4e−47 |

| Protein name | | Locus Name | | Acc# |
|---|---|---|---|---|
| phosphate transport ATP binding protein | | pir:G70390 | | G70390 |

Description

| ORF Name | NTID | AAID | NT Length | AA Length | Score | Probability |
|---|---|---|---|---|---|---|
| 390826_c1_76 | 4337 | 9559 | 451 | 1356 | 382 | 2.9e−35 |

| Protein name | | Locus Name | | Acc# |
|---|---|---|---|---|
| | | sp:RBN_HAEIN | | P44608 |

Description

RIBONUCLEASE BN, (RNASE BN)

| ORF Name | NTID | AAID | NT Length | AA Length | Score | Probability |
|---|---|---|---|---|---|---|
| 4881450_c3_112 | 4338 | 9560 | 157 | 474 | | |

| Protein name | | Locus Name | | Acc# |
|---|---|---|---|---|
| | | | | |

Description

NO-HIT

-continued

| ORF Name | NTID | AAID | NT Length | AA Length | Score | Probability |
|---|---|---|---|---|---|---|
| 6674062_c3_113 | 4339 | 9561 | 283 | 852 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 78158_c1_67 | 4340 | 9562 | 236 | 711 | 383 | 2.3e−35 |

| Protein name | | | | Locus Name | | Acc# |
|---|---|---|---|---|---|---|
| | | | | sp:PHOP_BACSU | | P13792 |

Description

PHOP

| ORF Name | NTID | AAID | NT Length | AA Length | Score | Probability |
|---|---|---|---|---|---|---|
| 15103800_c3_56 | 4341 | 9563 | 94 | 285 | 78 | 0.018 |

| Protein name | | | | Locus Name | | Acc# |
|---|---|---|---|---|---|---|
| response regulator | | | | gp:AF130997 | | AF130997 |

Description

*Enterococcus faecium* strain BM4339 vanD glycopeptide resistance gene cluster, complete sequence.

| ORF Name | NTID | AAID | NT Length | AA Length | Score | Probability |
|---|---|---|---|---|---|---|
| 157263_c3_59 | 4342 | 9564 | 385 | 1158 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 16832885_c1_38 | 4343 | 9565 | 431 | 1296 | 1723 | 2.3e−177 |

| Protein name | | | | Locus Name | | Acc# |
|---|---|---|---|---|---|---|
| hypothetical protein | | | | pir:JQ1020 | | JQ1020 |

Description

| ORF Name | NTID | AAID | NT Length | AA Length | Score | Probability |
|---|---|---|---|---|---|---|
| 16832885_f3_33 | 4344 | 9566 | 208 | 624 | 710 | 5.1e−70 |

| Protein name | | | | Locus Name | | Acc# |
|---|---|---|---|---|---|---|
| hypothetical protein | | | | pir:JQ1020 | | JQ1020 |

Description

-continued

| ORF Name | NTID | AAID | NT Length | AA Length | Score | Probability |
|---|---|---|---|---|---|---|
| 188967_f3_26 | 4345 | 9567 | 91 | 276 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 20087753_c3_63 | 4346 | 9568 | 317 | 954 | 1426 | 6.8e−146 |

| Protein name | | | | Locus Name | | Acc# |
|---|---|---|---|---|---|---|
| putative UDP-GlcNAc:undecaprenylphosphate | | | | gp:AF048749 | | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 2040937_c2_52 | 4347 | 9569 | 253 | 762 | 207 | 1.0e−16 |

| Protein name | | | | Locus Name | | Acc# |
|---|---|---|---|---|---|---|
| putative glycosyl transferase | | | | gp:LPN7311 | | AJ007311 |

Description

*Legionella pneumophila* serogroup 1 lipopolysaccharide biosynthesis gene cluster.

| ORF Name | NTID | AAID | NT Length | AA Length | Score | Probability |
|---|---|---|---|---|---|---|
| 20594161_c3_61 | 4348 | 9570 | 91 | 276 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 22658450_c1_34 | 4349 | 9571 | 72 | 219 | 156 | 2.7e−10 |

| Protein name | | | | Locus Name | | Acc# |
|---|---|---|---|---|---|---|
| arylsulfotransferase | | | | gp:AF126201 | | AF126201 |

Description

*Pseudomonas putida* strain S-313 sulfate ester desulfurization genelocus, complete sequence.

| ORF Name | NTID | AAID | NT Length | AA Length | Score | Probability |
|---|---|---|---|---|---|---|
| 22860128_c2_49 | 4350 | 9572 | 83 | 252 | 64 | 0.031 |

| Protein name | | | | Locus Name | | Acc# |
|---|---|---|---|---|---|---|
| | | | | sp:SPRC_XENLA | | P36378 |

Description (OSTEONECTIN) (ON) (BASEMENT MEMBRANE PROTEIN BM-40)

-continued

| ORF Name | NTID | AAID | NT Length | AA Length | Score | Probability |
|---|---|---|---|---|---|---|
| 22860128_f1_15 | 4351 | 9573 | 83 | 252 | 64 | 0.031 |

| Protein name | Locus Name | Acc# |
|---|---|---|

Description (OSTEONECTIN) (ON) (BASEMENT MEMBRANE PROTEIN BM-40)

| ORF Name | NTID | AAID | NT Length | AA Length | Score | Probability |
|---|---|---|---|---|---|---|
| 24238263_f1_7 | 4352 | 9574 | 129 | 390 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 26212762_c2_48 | 4353 | 9575 | 350 | 1053 | 123 | 9.7e−08 |

| Protein name | Locus Name | Acc# |
|---|---|---|
| Cap5J | gp:SAU81973 | U81973 |

Description

*Staphylococcus aureus* capsule gene cluster Cap5A through Cap5P genes, complete cds.

| ORF Name | NTID | AAID | NT Length | AA Length | Score | Probability |
|---|---|---|---|---|---|---|
| 2742755_c1_35 | 4354 | 9576 | 63 | 192 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 32056392_c1_39 | 4355 | 9577 | 69 | 210 | 85 | 0.010 |

| Protein name | Locus Name | Acc# |
|---|---|---|
| hypothetical protein, 57.8 kD | gp:POL245436 | |

Description

*Pseudomonas putida* OCT plasmid alk genes cluster and flanking DNA, strain TF4-1L.

| ORF Name | NTID | AAID | NT Length | AA Length | Score | Probability |
|---|---|---|---|---|---|---|
| 3314078_c2_46 | 4356 | 9578 | 470 | 1413 | 252 | 6.0e−19 |

| Protein name | Locus Name | Acc# |
|---|---|---|
| probable lipopolysaccharide O-side chain biosynthesis protein (O-antigen transporter) | pir:F71152 | F71152 |

Description

-continued

| ORF Name | NTID | AAID | NT Length | AA Length | Score | Probability |
|---|---|---|---|---|---|---|
| 33460952_c2_54 | 4357 | 9579 | 171 | 516 | 95 | 9.5e−05 |

| Protein name | | | | Locus Name | | Acc# |
|---|---|---|---|---|---|---|
| | | | | sp:DBH5_RHILE | | P02348 |

Description

DNA-BINDING PROTEIN HRL53

| ORF Name | NTID | AAID | NT Length | AA Length | Score | Probability |
|---|---|---|---|---|---|---|
| 35970967_f3_27 | 4358 | 9580 | 62 | 189 | 71 | 0.026 |

| Protein name | | | | Locus Name | | Acc# |
|---|---|---|---|---|---|---|
| | | | | sp:HIPB_ECOLI | | P23873 |

Description

HIPB PROTEIN

| ORF Name | NTID | AAID | NT Length | AA Length | Score | Probability |
|---|---|---|---|---|---|---|
| 3907151_f1_11 | 4359 | 9581 | 80 | 243 | | |

| Protein name | | | | Locus Name | | Acc# |

Description

NO-HIT

| ORF Name | NTID | AAID | NT Length | AA Length | Score | Probability |
|---|---|---|---|---|---|---|
| 3945302_f1_8 | 4360 | 9582 | 60 | 183 | | |

| Protein name | | | | Locus Name | | Acc# |

Description

NO-HIT

| ORF Name | NTID | AAID | NT Length | AA Length | Score | Probability |
|---|---|---|---|---|---|---|
| 4103387_c1_36 | 4361 | 9583 | 305 | 918 | 204 | 2.1e−16 |

| Protein name | | | | Locus Name | | Acc# |
|---|---|---|---|---|---|---|
| probable rhamnosyltransferase | | | | pir:H75596 | | H75596 |

Description

| ORF Name | NTID | AAID | NT Length | AA Length | Score | Probability |
|---|---|---|---|---|---|---|
| 41293_c3_60 | 4362 | 9584 | 87 | 264 | | |

| Protein name | | | | Locus Name | | Acc# |

Description

NO-HIT

-continued

| ORF Name | NTID | AAID | NT Length | AA Length | Score | Probability |
|---|---|---|---|---|---|---|
| 4176566_c1_40 | 4363 | 9585 | 77 | 234 | 82 | 0.023 |

| Protein name | Locus Name | Acc# |
|---|---|---|
| unknown | gp:AF134706 | AF134706 |

Description

*Sinorhizobium meliloti* insertion sequence ISRm14, complete sequence.

| ORF Name | NTID | AAID | NT Length | AA Length | Score | Probability |
|---|---|---|---|---|---|---|
| 4198425_c2_47 | 4364 | 9586 | 327 | 984 | 130 | 1.6e−05 |

| Protein name | Locus Name | Acc# |
|---|---|---|
| | gp:AB000222 | AB000222 |

Description

*Staphylococcus capitis* epr gene, complete cds.

| ORF Name | NTID | AAID | NT Length | AA Length | Score | Probability |
|---|---|---|---|---|---|---|
| 4704715_c3_62 | 4365 | 9587 | 338 | 1017 | 1447 | 4.1e−148 |

| Protein name | Locus Name | Acc# |
|---|---|---|
| UDP-glucose-4-epimerase/dTDP-glucose-4,6 | gp:AF048749 | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 5970193_f1_1 | 4366 | 9588 | 69 | 210 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 5978385_c1_37 | 4367 | 9589 | 345 | 1038 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 6725327_c2_51 | 4368 | 9590 | 238 | 717 | 296 | 3.8e−26 |

| Protein name | Locus Name | Acc# |
|---|---|---|
| glycosyltransferase | pir:G75596 | G75596 |

Description

-continued

| ORF Name | NTID | AAID | NT Length | AA Length | Score | Probability |
|---|---|---|---|---|---|---|
| 13689660_f3_10 | 4369 | 9591 | 267 | 804 | 1330 | 1.0e−135 |

| Protein name | Locus Name | Acc# |
|---|---|---|
| | sp:ISTB_BACFR | Q45120 |

Description

INSERTION SEQUENCE IS21-LIKE PUTATIVE ATP-BINDING PROTEIN

| ORF Name | NTID | AAID | NT Length | AA Length | Score | Probability |
|---|---|---|---|---|---|---|
| 14272692_f3_8 | 4370 | 9592 | 333 | 1002 | 1671 | 7.4e−172 |

| Protein name | Locus Name | Acc# |
|---|---|---|
| | sp:TRA2_BACFR | Q45119 |

Description

TRANSPOSASE FOR INSERTION SEQUENCE ELEMENT IS21-LIKE

| ORF Name | NTID | AAID | NT Length | AA Length | Score | Probability |
|---|---|---|---|---|---|---|
| 16299062_f3_11 | 4371 | 9593 | 592 | 1779 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 22460186_f2_6 | 4372 | 9594 | 64 | 195 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 29937943_f2_4 | 4373 | 9595 | 214 | 645 | 1109 | 2.7e−112 |

| Protein name | Locus Name | Acc# |
|---|---|---|
| | sp:TRA2_BACFR | Q45119 |

Description

TRANSPOSASE FOR INSERTION SEQUENCE ELEMENT IS21-LIKE

| ORF Name | NTID | AAID | NT Length | AA Length | Score | Probability |
|---|---|---|---|---|---|---|
| 30525762_f2_7 | 4374 | 9596 | 123 | 372 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 100385_f1_32 | 4375 | 9597 | 72 | 219 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 12285135_c3_311 | 4376 | 9598 | 752 | 2259 | 1461 | 1.3e−149 |

| Protein name | | | | Locus Name | | Acc# |
|---|---|---|---|---|---|---|
| | | | | sp:BIOA_HAEIN | | P44426 |

Description

AMINOTRANSFERASE)

| ORF Name | NTID | AAID | NT Length | AA Length | Score | Probability |
|---|---|---|---|---|---|---|
| 12688437_c3_302 | 4377 | 9599 | 489 | 1470 | 578 | 4.9e−56 |

| Protein name | | | | Locus Name | | Acc# |
|---|---|---|---|---|---|---|
| immunoreactive 53 kD antigen PG123 | | | | gp:AF144641 | | AF144641 |

Description

*Porphyromonas gingivalis* strain W50 immunoreactive 53 kD antigen PG123 gene, complete cds.

| ORF Name | NTID | AAID | NT Length | AA Length | Score | Probability |
|---|---|---|---|---|---|---|
| 12947777_f2_99 | 4378 | 9600 | 190 | 573 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 13828450_f3_154 | 4379 | 9601 | 140 | 423 | 86 | 0.019 |

| Protein name | | | | Locus Name | | Acc# |
|---|---|---|---|---|---|---|
| | | | | sp:FKBA_ECOLI | | |

Description (EC 5.2.1.8) (PPIASE) (ROTAMASE)

| ORF Name | NTID | AAID | NT Length | AA Length | Score | Probability |
|---|---|---|---|---|---|---|
| 13835937_f2_100 | 4380 | 9602 | 454 | 1365 | 789 | 2.2e−78 |

| Protein name | | | | Locus Name | | Acc# |
|---|---|---|---|---|---|---|
| dihydrolipoamide dehydrogenase, :2-oxoglutarate dehydrogenase complex chain E3:acetoin dehydrogenase complex | | | | pir:I40794 | | I40794 |

Description

-continued

| ORF Name | NTID | AAID | NT Length | AA Length | Score | Probability |
|---|---|---|---|---|---|---|
| 14095406_c1_182 | 4381 | 9603 | 140 | 423 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 14727331_c1_191 | 4382 | 9604 | 60 | 183 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 14737507_c2_221 | 4383 | 9605 | 129 | 390 | 132 | 9.2e−09 |

| Protein name | | | | Locus Name | | Acc# |
|---|---|---|---|---|---|---|
| hypothetical protein APE1673 | | | | pir:E72548 | | E72548 |

Description

| ORF Name | NTID | AAID | NT Length | AA Length | Score | Probability |
|---|---|---|---|---|---|---|
| 15040893_f3_137 | 4384 | 9606 | 1043 | 3132 | 729 | 1.7e−120 |

| Protein name | | | | Locus Name | | Acc# |
|---|---|---|---|---|---|---|
| receptor antigen (RagA) | | | | gp:PGI130872 | | AJ130872 |

Description

*Porphyromonas gingivalis* W50 receptor antigen (rag) locus encoding a major immunodominant 55 kDa antigen.

| ORF Name | NTID | AAID | NT Length | AA Length | Score | Probability |
|---|---|---|---|---|---|---|
| 16832885_f3_155 | 4385 | 9607 | 200 | 603 | 762 | 1.6e−75 |

| Protein name | | | | Locus Name | | Acc# |
|---|---|---|---|---|---|---|
| hypothetical protein | | | | pir:JQ1020 | | JQ1020 |

Description

| ORF Name | NTID | AAID | NT Length | AA Length | Score | Probability |
|---|---|---|---|---|---|---|
| 175317_c3_292 | 4386 | 9608 | 74 | 225 | | |

| Protein name | | | | Locus Name | | Acc# |
|---|---|---|---|---|---|---|

Description

NO-HIT

-continued

| ORF Name | NTID | AAID | NT Length | AA Length | Score | Probability |
|---|---|---|---|---|---|---|
| 199062_f1_48 | 4387 | 9609 | 73 | 222 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 20582930_c3_321 | 4388 | 9610 | 522 | 1569 | 814 | 4.9e−81 |

| Protein name | | | | Locus Name | | Acc# |
|---|---|---|---|---|---|---|
| *Salmonella typhimurium* transcriptional | | | | gp:STYSTMF1 | | AF170176 |

Description

*Salmonella typhimurium* fragment STMF1.

| ORF Name | NTID | AAID | NT Length | AA Length | Score | Probability |
|---|---|---|---|---|---|---|
| 20750302_f1_44 | 4389 | 9611 | 459 | 1380 | 445 | 6.3e−71 |

| Protein name | | | | Locus Name | | Acc# |
|---|---|---|---|---|---|---|
| | | | | sp:ODB2_BACSU | | P37942 |

Description

CHAIN TRANSACYLASE)

| ORF Name | NTID | AAID | NT Length | AA Length | Score | Probability |
|---|---|---|---|---|---|---|
| 21971036_c2_282 | 4390 | 9612 | 68 | 207 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 22277_c1_157 | 4391 | 9613 | 289 | 870 | 298 | 2.3e−26 |

| Protein name | | | | Locus Name | | Acc# |
|---|---|---|---|---|---|---|
| | | | | gp:AB023064 | | AB023064 |

Description

*Listeria monocytogenes* DNA for DnaK operon, complete cds.

| ORF Name | NTID | AAID | NT Length | AA Length | Score | Probability |
|---|---|---|---|---|---|---|
| 22860128_f1_52 | 4392 | 9614 | 83 | 252 | 64 | 0.031 |

| Protein name | | | | Locus Name | | Acc# |
|---|---|---|---|---|---|---|
| | | | | sp:SPRC_XENLA | | P36378 |

Description (OSTEONECTIN) (ON) (BASEMENT MEMBRANE PROTEIN BM-40)

-continued

| ORF Name | NTID | AAID | NT Length | AA Length | Score | Probability |
|---|---|---|---|---|---|---|
| 23851527_c3_312 | 4393 | 9615 | 405 | 1218 | 1026 | 1.7e−103 |
| Protein name | | | | Locus Name | | Acc# |
| | | | | sp:BIOF_HAEIN | | P44422 |

Description

LIGASE)

| ORF Name | NTID | AAID | NT Length | AA Length | Score | Probability |
|---|---|---|---|---|---|---|
| 24432030_f2_88 | 4394 | 9616 | 563 | 1692 | 114 | 1.2e−06 |
| Protein name | | | | Locus Name | | Acc# |
| unknown | | | | gp:U96771 | | U96771 |

Description

*Prevotella bryantii* putative polygalacturonase, B-1,4-endoglucanase, and mannanase genes, complete cds; and unknown genes.

| ORF Name | NTID | AAID | NT Length | AA Length | Score | Probability |
|---|---|---|---|---|---|---|
| 24641932_f1_40 | 4395 | 9617 | 555 | 1668 | | |
| Protein name | | | | Locus Name | | Acc# |

Description

NO-HIT

| ORF Name | NTID | AAID | NT Length | AA Length | Score | Probability |
|---|---|---|---|---|---|---|
| 24644015_c3_296 | 4396 | 9618 | 152 | 459 | 204 | 7.4e−16 |
| Protein name | | | | Locus Name | | Acc# |
| prolidase | | | | gp:AB014613 | | AB014613 |

Description

*Aureobacterium esteraromaticum* gene for prolidase, complete cds.

| ORF Name | NTID | AAID | NT Length | AA Length | Score | Probability |
|---|---|---|---|---|---|---|
| 24645252_f3_123 | 4397 | 9619 | 441 | 1326 | 476 | 3.2e−45 |
| Protein name | | | | Locus Name | | Acc# |
| immunoreactive 50 kD antigen PG53 | | | | gp:AF175720 | | AF175720 |

Description

*Porphyromonas gingivalis* strain W50 immunoreactive 50 kD antigen PG53 gene, complete cds.

| ORF Name | NTID | AAID | NT Length | AA Length | Score | Probability |
|---|---|---|---|---|---|---|
| 24648407_c3_301 | 4398 | 9620 | 199 | 600 | | |
| Protein name | | | | Locus Name | | Acc# |

Description

NO-HIT

-continued

| ORF Name | NTID | AAID | NT Length | AA Length | Score | Probability |
|---|---|---|---|---|---|---|
| 24666005_c3_316 | 4399 | 9621 | 68 | 207 | 49 | 0.036 |

| Protein name | | | Locus Name | | Acc# | |
|---|---|---|---|---|---|---|
| hypothetical protein A556L | | | pir:T18058 | | T18058 | |

Description

| ORF Name | NTID | AAID | NT Length | AA Length | Score | Probability |
|---|---|---|---|---|---|---|
| 25448566_f1_18 | 4400 | 9622 | 267 | 804 | 564 | 1.5e−54 |

| Protein name | | | Locus Name | | Acc# | |
|---|---|---|---|---|---|---|
| | | | sp:YF08_METJA | | Q58903 | |

Description

HYPOTHETICAL ABC TRANSPORTER ATP-BINDING PROTEIN MJ1508

| ORF Name | NTID | AAID | NT Length | AA Length | Score | Probability |
|---|---|---|---|---|---|---|
| 255313_c1_163 | 4401 | 9623 | 74 | 225 | | |

| Protein name | | | Locus Name | | Acc# | |
|---|---|---|---|---|---|---|

Description

NO-HIT

| ORF Name | NTID | AAID | NT Length | AA Length | Score | Probability |
|---|---|---|---|---|---|---|
| 26369006_f2_94 | 4402 | 9624 | 515 | 1548 | 1829 | 1.3e−188 |

| Protein name | | | Locus Name | | Acc# | |
|---|---|---|---|---|---|---|
| propionyl-CoA carboxylase | | | gp:AB007000 | | AB007000 | |

Description

*Myxococcus xanthus* MxppcB gene for propionyl-CoA carboxylase, complete cds.

| ORF Name | NTID | AAID | NT Length | AA Length | Score | Probability |
|---|---|---|---|---|---|---|
| 26445311_c2_263 | 4403 | 9625 | 229 | 690 | 502 | 5.6e−48 |

| Protein name | | | Locus Name | | Acc# | |
|---|---|---|---|---|---|---|
| | | | sp:BID2_HAEIN | | P45248 | |

Description 2) (DTB SYNTHETASE 2) (DTBS 2)

| ORF Name | NTID | AAID | NT Length | AA Length | Score | Probability |
|---|---|---|---|---|---|---|
| 26461542_f2_95 | 4404 | 9626 | 509 | 1530 | 1297 | 3.2e−132 |

| Protein name | | | Locus Name | | Acc# | |
|---|---|---|---|---|---|---|
| acetyl-CoA carboxylase (biotin carboxylase subunit) Acc | | | pir:A69581 | | A69581 | |

Description

-continued

| ORF Name | NTID | AAID | NT Length | AA Length | Score | Probability |
|---|---|---|---|---|---|---|
| 26594425_f2_69 | 4405 | 9627 | 417 | 1254 | 214 | 5.6e−15 |
| Protein name | | | Locus Name | | | Acc# |
| hypothetical protein aq_294 | | | pir:H70326 | | | H70326 |
| Description | | | | | | |

| ORF Name | NTID | AAID | NT Length | AA Length | Score | Probability |
|---|---|---|---|---|---|---|
| 31281883_f3_134 | 4406 | 9628 | 118 | 357 | 110 | 1.9e−06 |
| Protein name | | | Locus Name | | | Acc# |
| hypothetical protein APE1466 | | | pir:B72626 | | | B72626 |
| Description | | | | | | |

| ORF Name | NTID | AAID | NT Length | AA Length | Score | Probability |
|---|---|---|---|---|---|---|
| 32115637_f1_43 | 4407 | 9629 | 242 | 729 | 336 | 2.2e−30 |
| Protein name | | | Locus Name | | | Acc# |
| | | | sp:LPLA_MYCPN | | | P75394 |
| Description | | | | | | |
| PROBABLE LIPOATE-PROTEIN LIGASE A, | | | | | | |

| ORF Name | NTID | AAID | NT Length | AA Length | Score | Probability |
|---|---|---|---|---|---|---|
| 32116703_c2_268 | 4408 | 9630 | 68 | 207 | 136 | 3.4e−09 |
| Protein name | | | Locus Name | | | Acc# |
| hypothetical protein APE2061 | | | pir:G72510 | | | G72510 |
| Description | | | | | | |

| ORF Name | NTID | AAID | NT Length | AA Length | Score | Probability |
|---|---|---|---|---|---|---|
| 32226550_f3_152 | 4409 | 9631 | 174 | 525 | 367 | 1.1e−33 |
| Protein name | | | Locus Name | | | Acc# |
| flavodoxin | | | pir:A28670 | | | |
| Description | | | | | | |

| ORF Name | NTID | AAID | NT Length | AA Length | Score | Probability |
|---|---|---|---|---|---|---|
| 32633411_f3_125 | 4410 | 9632 | 810 | 2433 | 171 | 2.0e−09 |
| Protein name | | | Locus Name | | | Acc# |
| conserved hypothetical protein | | | pir:G72385 | | | G72385 |
| Description | | | | | | |

| ORF Name | NTID | AAID | NT Length | AA Length | Score | Probability |
|---|---|---|---|---|---|---|
| 33218827_c3_300 | 4411 | 9633 | 513 | 1542 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 3370317_f1_38 | 4412 | 9634 | 144 | 435 | 154 | 5.8e-14 |

| Protein name | Locus Name | Acc# |
|---|---|---|
| methylmalonyl-coa decarboxylase gamma chain PAB1771 | pir:F75135 | F75135 |

Description

| ORF Name | NTID | AAID | NT Length | AA Length | Score | Probability |
|---|---|---|---|---|---|---|
| 35367263_c2_266 | 4413 | 9635 | 433 | 1302 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 35710811_c1_187 | 4414 | 9636 | 502 | 1509 | 468 | 2.2e-44 |

| Protein name | Locus Name | Acc# |
|---|---|---|
| | sp:BIOC_HAEIN | P45249 |

Description

PUTATIVE BIOTIN SYNTHESIS PROTEIN BIOC

| ORF Name | NTID | AAID | NT Length | AA Length | Score | Probability |
|---|---|---|---|---|---|---|
| 3929091_c1_201 | 4415 | 9637 | 376 | 1131 | 256 | 6.5e-22 |

| Protein name | Locus Name | Acc# |
|---|---|---|
| membrane protein | pir:G64590 | G64590 |

Description

| ORF Name | NTID | AAID | NT Length | AA Length | Score | Probability |
|---|---|---|---|---|---|---|
| 3948425_f1_3 | 4416 | 9638 | 402 | 1209 | 856 | 1.7e-85 |

| Protein name | Locus Name | Acc# |
|---|---|---|
| aspartate aminotransferase | pir:D72220 | D72220 |

Description

| ORF Name | NTID | AAID | NT Length | AA Length | Score | Probability |
|---|---|---|---|---|---|---|
| 4337882_f3_151 | 4417 | 9639 | 695 | 2088 | 1022 | 4.4e-103 |

| Protein name | Locus Name | Acc# |
|---|---|---|
| probable (pyruvate) oxoisovalerate dehydrogenase alpha and beta fusion | pir:G71526 | G71526 |

Description

-continued

| ORF Name | NTID | AAID | NT Length | AA Length | Score | Probability |
|---|---|---|---|---|---|---|
| 4462535_f1_4 | 4418 | 9640 | 438 | 1317 | 283 | 4.4e−23 |

| Protein name | Locus Name | Acc# |
|---|---|---|
| | sp:YCFW_ECOLI | P75958 |

Description

HYPOTHETICAL 45.3 KD PROTEIN IN MFD-COBB INTERGENIC REGION

| ORF Name | NTID | AAID | NT Length | AA Length | Score | Probability |
|---|---|---|---|---|---|---|
| 4486037_c3_330 | 4419 | 9641 | 415 | 1248 | 379 | 6.1e−35 |

| Protein name | Locus Name | Acc# |
|---|---|---|
| hypothetical protein APE1887 | pir:G72575 | G72575 |

Description

| ORF Name | NTID | AAID | NT Length | AA Length | Score | Probability |
|---|---|---|---|---|---|---|
| 4807687_c3_303 | 4420 | 9642 | 503 | 1512 | 941 | 1.7e−94 |

| Protein name | Locus Name | Acc# |
|---|---|---|
| L-lactate permease (lctP) homolog | pir:C70175 | C70175 |

Description

| ORF Name | NTID | AAID | NT Length | AA Length | Score | Probability |
|---|---|---|---|---|---|---|
| 4953527_f1_51 | 4421 | 9643 | 480 | 1443 | 104 | 1.0e−05 |

| Protein name | Locus Name | Acc# |
|---|---|---|
| | sp:PRTT_PORGI | P43158 |

Description

THIOL PROTEASE/HEMAGGLUTININ PRTT PRECURSOR,

| ORF Name | NTID | AAID | NT Length | AA Length | Score | Probability |
|---|---|---|---|---|---|---|
| 4957582_c2_281 | 4422 | 9644 | 281 | 846 | 209 | 7.8e−16 |

| Protein name | Locus Name | Acc# |
|---|---|---|
| | sp:CHAC_SPHHE | Q59288 |

Description (CHONDROITIN SULFATE LYASE) (CHONDROITIN AC ELIMINASE)

| ORF Name | NTID | AAID | NT Length | AA Length | Score | Probability |
|---|---|---|---|---|---|---|
| 5195132_c2_275 | 4423 | 9645 | 425 | 1278 | 289 | 4.7e−26 |

| Protein name | Locus Name | Acc# |
|---|---|---|
| sensor protein pilS | pir:S70528 | |

Description

-continued

| ORF Name | NTID | AAID | NT Length | AA Length | Score | Probability |
|---|---|---|---|---|---|---|
| 523587_c3_319 | 4424 | 9646 | 434 | 1305 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 54802_c2_264 | 4425 | 9647 | 456 | 1371 | 643 | 6.4e−63 |

| Protein name | | | | Locus Name | | Acc# |
|---|---|---|---|---|---|---|
| NADH dehydrogenase,:protein slr0851:protein slr0851 | | | | pir:S74826 | | S74826 |

Description

| ORF Name | NTID | AAID | NT Length | AA Length | Score | Probability |
|---|---|---|---|---|---|---|
| 628465_c1_172 | 4426 | 9648 | 344 | 1035 | 369 | 6.9e−34 |

| Protein name | | | | Locus Name | | Acc# |
|---|---|---|---|---|---|---|
| | | | | sp:YJV3_YEAST | | P40896 |

Description

HYPOTHETICAL 35.9 KD PROTEIN IN HXT8-CRT1 INTERGENIC REGION

| ORF Name | NTID | AAID | NT Length | AA Length | Score | Probability |
|---|---|---|---|---|---|---|
| 882912_f1_41 | 4427 | 9649 | 395 | 1188 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 914202_c2_276 | 4428 | 9650 | 390 | 1173 | 162 | 2.9e−09 |

| Protein name | | | | Locus Name | | Acc# |
|---|---|---|---|---|---|---|
| EpsG | | | | gp:AF036485 | | |

Description

Plasmid pNZ4000, complete sequence.

| ORF Name | NTID | AAID | NT Length | AA Length | Score | Probability |
|---|---|---|---|---|---|---|
| 1172330_f1_2 | 4429 | 9651 | 345 | 1038 | 1055 | 1.4e−106 |

| Protein name | | | | Locus Name | | Acc# |
|---|---|---|---|---|---|---|
| Retol-acid reductoisomerase | | | | gp:PSP16743 | | Y16743 |

Description

*Piromyces* sp. E2 mRNA for ketol-acid reductoisomerase.

-continued

| ORF Name | NTID | AAID | NT Length | AA Length | Score | Probability |
|---|---|---|---|---|---|---|
| 20443775_c1_29 | 4430 | 9652 | 644 | 1935 | 717 | 9.2e−71 |

| Protein name | Locus Name | Acc# |
|---|---|---|
| hypothetical protein T18E12.6 | pir:T02699 | T02699 |

Description

| ORF Name | NTID | AAID | NT Length | AA Length | Score | Probability |
|---|---|---|---|---|---|---|
| 23448402_f3_16 | 4431 | 9653 | 658 | 1977 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 23478512_f1_1 | 4432 | 9654 | 198 | 597 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24017827_f2_12 | 4433 | 9655 | 247 | 744 | 184 | 2.5e−15 |

| Protein name | Locus Name | Acc# |
|---|---|---|
| palmitoyl-acyl carrier protein thioesterase | gp:AF034266 | AF034266 |

Description

*Gossypium hirsutum* palmitoyl-acyl carrier protein thioesterase (FatB1) mRNA, partial cds.

| ORF Name | NTID | AAID | NT Length | AA Length | Score | Probability |
|---|---|---|---|---|---|---|
| 24331376_f1_9 | 4434 | 9565 | 790 | 2373 | 2363 | 3.5e−245 |

| Protein name | Locus Name | Acc# |
|---|---|---|
| | sp:ACON_GRAVE | P49609 |

Description (HYDRO-LYASE) (ACONITASE)

| ORF Name | NTID | AAID | NT Length | AA Length | Score | Probability |
|---|---|---|---|---|---|---|
| 24630192_f2_11 | 4435 | 9657 | 153 | 462 | 151 | 8.8e−11 |

| Protein name | Locus Name | Acc# |
|---|---|---|
| acetolactate synthase | pir:E70459 | E70459 |

Description

-continued

| ORF Name | NTID | AAID | NT Length | AA Length | Score | Probability |
|---|---|---|---|---|---|---|
| 4877202_f1_10 | 4436 | 9658 | 303 | 909 | 867 | 3.9e−98 |

| Protein name | | Locus Name | Acc# |
|---|---|---|---|
| isocitrate dehydrogenase | | gp:BIISOCIT | Y13358 |

Description

*Bacillus israeli* isocitrate dehydrogenase gene.

| ORF Name | NTID | AAID | NT Length | AA Length | Score | Probability |
|---|---|---|---|---|---|---|
| 12509425_f1_8 | 4437 | 9659 | 191 | 576 | 639 | 1.7e−62 |

| Protein name | | Locus Name | Acc# |
|---|---|---|---|
| | | gp:AB022867 | AB022867 |

Description

*Prevotella ruminicola* genes for polyA polymerase, D-alanineglycinepermease and cellulase, complete cds.

| ORF Name | NTID | AAID | NT Length | AA Length | Score | Probability |
|---|---|---|---|---|---|---|
| 13837557_c3_73 | 4438 | 9660 | 123 | 372 | 113 | 9.3e−07 |

| Protein name | | Locus Name | Acc# |
|---|---|---|---|
| | | gp:MZECWAB | M36913 |

Description

*Z. mays* cell wall protein mRNA, 3' end.

| ORF Name | NTID | AAID | NT Length | AA Length | Score | Probability |
|---|---|---|---|---|---|---|
| 14461002_f2_16 | 4439 | 9661 | 299 | 900 | 264 | 3.3e−22 |

| Protein name | | Locus Name | Acc# |
|---|---|---|---|
| | | sp:YEBA_HAEIN | P44693 |

Description

HYPOTHETICAL PROTEIN HI0409

| ORF Name | NTID | AAID | NT Length | AA Length | Score | Probability |
|---|---|---|---|---|---|---|
| 14744002_f2_14 | 4440 | 9662 | 184 | 555 | 317 | 2.2e−28 |

| Protein name | | Locus Name | Acc# |
|---|---|---|---|
| 4-methyl-5(b-hydroxyethyl)-thiazole monophosphate biosynthesis protein (thiJ) homolog | | pir:D70177 | D70177 |

Description

| ORF Name | NTID | AAID | NT Length | AA Length | Score | Probability |
|---|---|---|---|---|---|---|
| 22860927_f1_7 | 4441 | 9663 | 166 | 501 | 362 | 3.8e−33 |

| Protein name | | Locus Name | Acc# |
|---|---|---|---|
| probable nucleoside−diphosphate kinase, | | pir:C71116 | C71116 |

Description

| ORF Name | NTID | AAID | NT Length | AA Length | Score | Probability |
|---|---|---|---|---|---|---|
| 24098388_c2_56 | 4442 | 9664 | 310 | 933 | 591 | 2.1e−57 |

| Protein name | Locus Name | Acc# |
|---|---|---|
| | gp:PGPUT | X97228 |

Description

*P. gingivalis* gpdxJ, put, and yhbG-pg genes.

| ORF Name | NTID | AAID | NT Length | AA Length | Score | Probability |
|---|---|---|---|---|---|---|
| 26213181_c3_61 | 4443 | 9665 | 257 | 774 | 992 | 6.7e−100 |

| Protein name | Locus Name | Acc# |
|---|---|---|
| hypothetical protein | pir:JQ1020 | JQ1020 |

Description

| ORF Name | NTID | AAID | NT Length | AA Length | Score | Probability |
|---|---|---|---|---|---|---|
| 26759387_f2_17 | 4444 | 9666 | 444 | 1335 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 29480341_c1_44 | 4445 | 9667 | 85 | 255 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 3312913_f3_27 | 4446 | 9668 | 223 | 672 | 336 | 2.2e−30 |

| Protein name | Locus Name | Acc# |
|---|---|---|
| conserved hypothetical protein yacM | pir:S66119 | |

Description

| ORF Name | NTID | AAID | NT Length | AA Length | Score | Probability |
|---|---|---|---|---|---|---|
| 33392202_f2_18 | 4447 | 9669 | 267 | 804 | 587 | 5.5e−57 |

| Protein name | Locus Name | Acc# |
|---|---|---|
| triosephosphate isomerase | gp:AF043386 | AF043386 |

Description

*Clostridium acetobutylicum* glyceraldehyde-3-phosphate dehydrogenase (gap),
phosphoglycerate kinase (pgk), and triosephosphate isomerase (tpi) genes,
complete cds; and 2,3-bpg-independent phosphoglyceratemutase (pgm-i) gene, partial cds.

-continued

| ORF Name | NTID | AAID | NT Length | AA Length | Score | Probability |
|---|---|---|---|---|---|---|
| 33476625_f2_15 | 4448 | 9670 | 707 | 2124 | 1284 | 7.6e−131 |

| Protein name | Locus Name | Acc# |
|---|---|---|
| | sp:RECG_SYNY3 | Q55681 |

Description

ATP-DEPENDENT DNA HELICASE RECG,

| ORF Name | NTID | AAID | NT Length | AA Length | Score | Probability |
|---|---|---|---|---|---|---|
| 34081405_f3_22 | 4449 | 9671 | 88 | 267 | 110 | 1.9e−06 |

| Protein name | Locus Name | Acc# |
|---|---|---|
| hypothetical protein PHS004 | pir:F71245 | F71245 |

Description

| ORF Name | NTID | AAID | NT Length | AA Length | Score | Probability |
|---|---|---|---|---|---|---|
| 35205387_f3_26 | 4450 | 9672 | 293 | 882 | 256 | 6.5e−22 |

| Protein name | Locus Name | Acc# |
|---|---|---|
| | sp:TONB_NEIGO | O06432 |

Description

TONB PROTEIN

| ORF Name | NTID | AAID | NT Length | AA Length | Score | Probability |
|---|---|---|---|---|---|---|
| 4159587_f3_24 | 4451 | 9673 | 211 | 636 | 676 | 2.0e−66 |

| Protein name | Locus Name | Acc# |
|---|---|---|
| pyridoxal phosphate synthetase | gp:PGPUT | X97228 |

Description

*P. gingivalis* gpdxJ, put, and yhbG-pg genes.

| ORF Name | NTID | AAID | NT Length | AA Length | Score | Probability |
|---|---|---|---|---|---|---|
| 4578461_f1_5 | 4452 | 9674 | 149 | 450 | 139 | 1.6e−09 |

| Protein name | Locus Name | Acc# |
|---|---|---|
| | sp:TOLR_HAEIN | P43769 |

Description

TOLR PROTEIN

| ORF Name | NTID | AAID | NT Length | AA Length | Score | Probability |
|---|---|---|---|---|---|---|
| 5087912_c2_59 | 4453 | 9675 | 89 | 270 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 9853312__f3__25 | 4454 | 9676 | 245 | 738 | 232 | 2.3e−19 |
| Protein name | | | Locus Name | | | Acc# |
| hypothetical protein | | | gp:PST243354 | | | AJ243354 |
| Description | | | | | | |

*Pseudomonas stutzeri* hyp1 and comA genes and putative tolQ, exbB, tolR and exbD genes.

| ORF Name | NTID | AAID | NT Length | AA Length | Score | Probability |
|---|---|---|---|---|---|---|
| 10137__c2__279 | 4455 | 9677 | 185 | 558 | 537 | 1.1e−51 |
| Protein name | | | Locus Name | | | Acc# |
| carbonic anhydrase homolog ytiB | | | pir:F69993 | | | F69993 |
| Description | | | | | | |

| ORF Name | NTID | AAID | NT Length | AA Length | Score | Probability |
|---|---|---|---|---|---|---|
| 10632768__c3__321 | 4456 | 9678 | 68 | 207 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 10675680__c2__245 | 4457 | 9679 | 74 | 225 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 12600340__f3__137 | 4458 | 9680 | 364 | 1095 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 12676061__f1__4 | 4459 | 9681 | 474 | 1425 | | |
| Protein name | | | Locus Name | | | Acc# |
| Description | | | | | | |

NO-HIT

-continued

| ORF Name | NTID | AAID | NT Length | AA Length | Score | Probability |
|---|---|---|---|---|---|---|
| 1353457_f1_34 | 4460 | 9682 | 461 | 1386 | 461 | 1.6e−56 |

| Protein name | Locus Name | Acc# |
|---|---|---|
| AlgI | gp:PAU50202 | U50202 |

Description

*Pseudomonas aeruginosa* alginate gene cluster AlgI (algI), AlgJ (algJ) and AlgF (algF) genes, complete cds.

| ORF Name | NTID | AAID | NT Length | AA Length | Score | Probability |
|---|---|---|---|---|---|---|
| 1378526_f2_111 | 4461 | 9683 | 68 | 207 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 14541001_f2_82 | 4462 | 9684 | 382 | 1149 | 315 | 3.7e−28 |

| Protein name | Locus Name | Acc# |
|---|---|---|
| thiamin biosynthesis protein homolog | pir:H69260 | H69260 |

Description

| ORF Name | NTID | AAID | NT Length | AA Length | Score | Probability |
|---|---|---|---|---|---|---|
| 14634500_c2_298 | 4463 | 9685 | 455 | 1368 | 153 | 3.7e−07 |

| Protein name | Locus Name | Acc# |
|---|---|---|
| KIAA1275 protein | gp:AB033101 | AB033101 |

Description

*Homo sapiens* mRNA for KIAA1275 protein, partial cds.

| ORF Name | NTID | AAID | NT Length | AA Length | Score | Probability |
|---|---|---|---|---|---|---|
| 14650287_c3_304 | 4464 | 9686 | 540 | 1623 | 416 | 6.4e−67 |

| Protein name | Locus Name | Acc# |
|---|---|---|
| outer membrane protein | gp:BNROMPB | L77614 |

Description

*Bacteroides thetaiotaomicron* outer membrane protein (susD) gene, complete cds.

| ORF Name | NTID | AAID | NT Length | AA Length | Score | Probability |
|---|---|---|---|---|---|---|
| 14712516_c3_359 | 4465 | 9687 | 133 | 402 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 14954712_f1_49 | 4466 | 9688 | 150 | 453 | 125 | 5.0e−08 |

| Protein name | Locus Name | Acc# |
|---|---|---|
| | sp:MEXR_PSEAE | P52003 |

Description

MULTIDRUG RESISTANCE OPERON REPRESSOR

| ORF Name | NTID | AAID | NT Length | AA Length | Score | Probability |
|---|---|---|---|---|---|---|
| 16101587_f1_50 | 4467 | 9689 | 359 | 1080 | 403 | 1.7e−37 |

| Protein name | Locus Name | Acc# |
|---|---|---|
| | sp:EMRA_HAEIN | P44928 |

Description

MULTIDRUG RESISTANCE PROTEIN A HOMOLOG

| ORF Name | NTID | AAID | NT Length | AA Length | Score | Probability |
|---|---|---|---|---|---|---|
| 16832885_c2_285 | 4468 | 9690 | 431 | 1296 | 1723 | 2.3e−177 |

| Protein name | Locus Name | Acc# |
|---|---|---|
| hypothetical protein | pir:JQ1020 | JQ1020 |

Description

| ORF Name | NTID | AAID | NT Length | AA Length | Score | Probability |
|---|---|---|---|---|---|---|
| 16905_f2_75 | 4469 | 9691 | 64 | 195 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 20015643_c3_312 | 4470 | 9692 | 66 | 201 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 20369826_c3_332 | 4471 | 9693 | 190 | 573 | 240 | 3.2e−20 |

| Protein name | Locus Name | Acc# |
|---|---|---|
| | sp:YM67_ARCFU | O28017 |

Description (EC 1.—.—.—)

-continued

| ORF Name | NTID | AAID | NT Length | AA Length | Score | Probability |
|---|---|---|---|---|---|---|
| 20509630_c1_184 | 4472 | 9694 | 954 | 2865 | 345 | 3.3e−28 |

| Protein name | Locus Name | Acc# |
|---|---|---|
| alpha-amylase, precursor:protein c0620 | pir:S73087 | S73087 |

Description

| ORF Name | NTID | AAID | NT Length | AA Length | Score | Probability |
|---|---|---|---|---|---|---|
| 22287681_f3_174 | 4473 | 9695 | 402 | 1209 | 152 | 4.0e−10 |

| Protein name | Locus Name | Acc# |
|---|---|---|
| thiol:disulfide interchange protein homolog yneN | pir:E69891 | E69891 |

Description

| ORF Name | NTID | AAID | NT Length | AA Length | Score | Probability |
|---|---|---|---|---|---|---|
| 22459655_c3_360 | 4474 | 9696 | 337 | 1014 | 133 | 4.7e−06 |

| Protein name | Locus Name | Acc# |
|---|---|---|
| transmembrane sensor | gp:AF051691 | AF051691 |

Description

*Pseudomonas aeruginosa* stress factor A (psfA), ECF sigma factor (fiuI), transmembrane sensor (fiuR), and hydroxamate−typeferrisiderophore receptor (fiuA) genes, complete cds.

| ORF Name | NTID | AAID | NT Length | AA Length | Score | Probability |
|---|---|---|---|---|---|---|
| 22478431_f2_84 | 4475 | 9697 | 397 | 1194 | 282 | 1.1e−23 |

| Protein name | Locus Name | Acc# |
|---|---|---|
| | sp:YRKO_BACSU | P54442 |

Description

HYPOTHETICAL 46.4 KD PROTEIN IN BLTR-SPOIIIC INTERGENIC REGION

| ORF Name | NTID | AAID | NT Length | AA Length | Score | Probability |
|---|---|---|---|---|---|---|
| 22687767_f1_19 | 4476 | 9698 | 421 | 1266 | 770 | 1.9e−113 |

| Protein name | Locus Name | Acc# |
|---|---|---|
| cytosolic phosphoglycerate kinase 1 | gp:AB018410 | AB018410 |

Description

*Populus nigra* PnCytPGK1 mRNA for cytosolic phosphoglycerate kinase1, complete cds.

| ORF Name | NTID | AAID | NT Length | AA Length | Score | Probability |
|---|---|---|---|---|---|---|
| 22860128_c3_340 | 4477 | 9699 | 83 | 252 | 64 | 0.031 |

| Protein name | Locus Name | Acc# |
|---|---|---|
| | sp:SPRC_XENLA | P36378 |

Description (OSTEONECTIN) (ON) (BASEMENT MEMBRANE PROTEIN BM-40)

-continued

| ORF Name | NTID | AAID | NT Length | AA Length | Score | Probability |
|---|---|---|---|---|---|---|
| 23554563_f2_81 | 4478 | 9700 | 229 | 690 | 493 | 5.0e-47 |

| Protein name | Locus Name | Acc# |
|---|---|---|
| endonuclease III | pir:B71919 | B71919 |

Description

| ORF Name | NTID | AAID | NT Length | AA Length | Score | Probability |
|---|---|---|---|---|---|---|
| 23634703_c2_280 | 4479 | 9701 | 69 | 210 | 58 | 0.0059 |

| Protein name | Locus Name | Acc# |
|---|---|---|
| | sp:ARCD_PSEAE | P18275 |

Description

ARGININE/ORNITHINE ANTIPORTER

| ORF Name | NTID | AAID | NT Length | AA Length | Score | Probability |
|---|---|---|---|---|---|---|
| 24000925_c2_301 | 4480 | 9702 | 723 | 2169 | 440 | 4.2e-46 |

| Protein name | Locus Name | Acc# |
|---|---|---|
| 115K outer membrane protein precursor:SusC protein | pir:JC6027 | JC6027 |

Description

| ORF Name | NTID | AAID | NT Length | AA Length | Score | Probability |
|---|---|---|---|---|---|---|
| 24016525_c2_259 | 4481 | 9703 | 343 | 1032 | 1174 | 3.4e-119 |

| Protein name | Locus Name | Acc# |
|---|---|---|
| | sp:ALF_TREPA | O83668 |

Description

FRUCTOSE-BISPHOSPHATE ALDOLASE,

| ORF Name | NTID | AAID | NT Length | AA Length | Score | Probability |
|---|---|---|---|---|---|---|
| 24017303_c1_242 | 4482 | 9704 | 677 | 2034 | 2862 | 4.6e-298 |

| Protein name | Locus Name | Acc# |
|---|---|---|
| pullulanase | gp:BTU67061 | U67061 |

Description

*Bacteroides thetaiotaomicron* pullulanase (pulI) gene, complete cds.

| ORF Name | NTID | AAID | NT Length | AA Length | Score | Probability |
|---|---|---|---|---|---|---|
| 24041626_f3_161 | 4483 | 9705 | 452 | 1359 | 141 | 1.5e-06 |

| Protein name | Locus Name | Acc# |
|---|---|---|
| conserved hypothetical protein MTH83 | pir:F69210 | F69210 |

Description

-continued

| ORF Name | NTID | AAID | NT Length | AA Length | Score | Probability |
|---|---|---|---|---|---|---|
| 24415877_f3_149 | 4484 | 9706 | 131 | 396 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24417075_f3_158 | 4485 | 9707 | 167 | 504 | 343 | 4.0e−31 |

| Protein name | | | | Locus Name | | Acc# |
|---|---|---|---|---|---|---|
| hypothetical protein PH0272 | | | | pir:A71452 | | A71452 |

Description

| ORF Name | NTID | AAID | NT Length | AA Length | Score | Probability |
|---|---|---|---|---|---|---|
| 24487937_f1_46 | 4486 | 9708 | 425 | 1278 | 153 | 6.0e−08 |

| Protein name | | | | Locus Name | | Acc# |
|---|---|---|---|---|---|---|
| conserved hypothetical protein BB0195 | | | | pir:C70124 | | C70124 |

Description

| ORF Name | NTID | AAID | NT Length | AA Length | Score | Probability |
|---|---|---|---|---|---|---|
| 24689717_f3_135 | 4487 | 9709 | 443 | 1332 | 422 | 1.7e−39 |

| Protein name | | | | Locus Name | | Acc# |
|---|---|---|---|---|---|---|
| antibiotic resistance protein homolog ywoG | | | | pir:B70065 | | B70065 |

Description

| ORF Name | NTID | AAID | NT Length | AA Length | Score | Probability |
|---|---|---|---|---|---|---|
| 24695316_f2_76 | 4488 | 9710 | 349 | 1050 | 788 | 2.8e−78 |

| Protein name | | | | Locus Name | | Acc# |
|---|---|---|---|---|---|---|
| | | | | sp:SYFA_BACSU | | |

Description (-TRNA LIGASE ALPHA CHAIN) (PHERS)

| ORF Name | NTID | AAID | NT Length | AA Length | Score | Probability |
|---|---|---|---|---|---|---|
| 25634375_c2_246 | 4489 | 9711 | 97 | 294 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 2595036_c3_358 | 4490 | 9712 | 60 | 183 | | |

| Protein name | | | | Locus Name | | Acc# |
|---|---|---|---|---|---|---|

Description

NO-HIT

-continued

| ORF Name | NTID | AAID | NT Length | AA Length | Score | Probability |
|---|---|---|---|---|---|---|
| 25978377_f2_85 | 4491 | 9713 | 733 | 2202 | 228 | 1.8e−16 |
| Protein name | | | | Locus Name | | Acc# |
| | | | | sp:Y798_METJA | | Q58208 |

Description

HYPOTHETICAL PROTEIN MJ0798

| ORF Name | NTID | AAID | NT Length | AA Length | Score | Probability |
|---|---|---|---|---|---|---|
| 26600187_f2_88 | 4492 | 9714 | 508 | 1527 | 499 | 6.4e−51 |
| Protein name | | | | Locus Name | | Acc# |
| | | | | gp:AB019578 | | AB019578 |

Description

*Microcystis aeruginosa* mcyA, mcyB and mcyC genes, complete cds.

| ORF Name | NTID | AAID | NT Length | AA Length | Score | Probability |
|---|---|---|---|---|---|---|
| 26756557_f1_28 | 4493 | 9715 | 173 | 522 | | |
| Protein name | | | | Locus Name | | Acc# |

Description

NO-HIT

| ORF Name | NTID | AAID | NT Length | AA Length | Score | Probability |
|---|---|---|---|---|---|---|
| 29971007_c3_315 | 4494 | 9716 | 72 | 219 | | |
| Protein name | | | | Locus Name | | Acc# |

Description

NO-HIT

| ORF Name | NTID | AAID | NT Length | AA Length | Score | Probability |
|---|---|---|---|---|---|---|
| 3125006_c2_257 | 4495 | 9717 | 60 | 183 | | |
| Protein name | | | | Locus Name | | Acc# |

Description

NO-HIT

| ORF Name | NTID | AAID | NT Length | AA Length | Score | Probability |
|---|---|---|---|---|---|---|
| 31276925_f1_39 | 4496 | 9718 | 285 | 858 | | |
| Protein name | | | | Locus Name | | Acc# |

Description

NO-HIT

-continued

| ORF Name | NTID | AAID | NT Length | AA Length | Score | Probability |
|---|---|---|---|---|---|---|
| 31854557_c2_247 | 4497 | 9719 | 246 | 741 | 503 | 4.9e−48 |

| Protein name | Locus Name | Acc# |
|---|---|---|
| 115K outer membrane protein precursor:SusC protein | pir:JC6027 | JC6027 |

Description

| ORF Name | NTID | AAID | NT Length | AA Length | Score | Probability |
|---|---|---|---|---|---|---|
| 31876687_f1_33 | 4498 | 9720 | 97 | 294 | 102 | 1.4e−05 |

| Protein name | Locus Name | Acc# |
|---|---|---|
| acyl carrier protein | pir:S28475 | S28475 |

Description

| ORF Name | NTID | AAID | NT Length | AA Length | Score | Probability |
|---|---|---|---|---|---|---|
| 32620812_f2_108 | 4499 | 9721 | 540 | 1623 | 176 | 4.8e−10 |

| Protein name | Locus Name | Acc# |
|---|---|---|
| VceB | gp:AF012101 | AF012101 |

Description

*Vibrio cholerae* efflux gene A (vceA) and efflux gene B (bceB) multidrug resistance pump genes, complete cds.

| ORF Name | NTID | AAID | NT Length | AA Length | Score | Probability |
|---|---|---|---|---|---|---|
| 3377027_c1_213 | 4500 | 9722 | 310 | 933 | 135 | 1.3e−06 |

| Protein name | Locus Name | Acc# |
|---|---|---|
| hypothetical protein | pir:F72216 | F72216 |

Description

| ORF Name | NTID | AAID | NT Length | AA Length | Score | Probability |
|---|---|---|---|---|---|---|
| 34414052_c3_333 | 4501 | 9723 | 175 | 528 | 285 | 5.5e−25 |

| Protein name | Locus Name | Acc# |
|---|---|---|
| conserved hypothetical protein aq_2171 | pir:D70486 | D70486 |

Description

| ORF Name | NTID | AAID | NT Length | AA Length | Score | Probability |
|---|---|---|---|---|---|---|
| 35820461_c3_316 | 4502 | 9724 | 63 | 192 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 36360000_f2_112 | 4503 | 9725 | 624 | 1875 | 121 | 0.00057 |

| Protein name | Locus Name | Acc# |
|---|---|---|
| unknown | gp:AF013216 | |

Description

*Myxococcus xanthus* Dog (dog), isocitrate lyase (ic1), Mis (mls), Ufo (ufo), fumarate hydratase (fhy), and proteosome major subunit (clpP) genes, complete cds; and acyl-CoA oxidase (aco) gene, partial cds.

| ORF Name | NTID | AAID | NT Length | AA Length | Score | Probability |
|---|---|---|---|---|---|---|
| 391540_c1_201 | 4504 | 9726 | 61 | 186 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 4094816_f3_164 | 4505 | 9727 | 620 | 1863 | 1365 | 2.0e−139 |

| Protein name | Locus Name | Acc# |
|---|---|---|
| neopullulanase | gp:BTU66897 | U66897 |

Description

*Bacteroides thetaiotaomicron* neopullulanase (susA) and alpha-glucosidase (susB) genes, complete cds.

| ORF Name | NTID | AAID | NT Length | AA Length | Score | Probability |
|---|---|---|---|---|---|---|
| 4104062_f1_58 | 4506 | 9728 | 88 | 267 | 242 | 2.0e−20 |

| Protein name | Locus Name | Acc# |
|---|---|---|
| probable ribosomal protein L31 | pir:T36353 | T36353 |

Description

| ORF Name | NTID | AAID | NT Length | AA Length | Score | Probability |
|---|---|---|---|---|---|---|
| 4144002_c1_243 | 4507 | 9729 | 190 | 573 | 292 | 1.0e−25 |

| Protein name | Locus Name | Acc# |
|---|---|---|
| RNA polymerase sigma factor SigZ-like protein | gp:AF137263 | AF137263 |

Description

*Bacteroides thetaiotaomicron* 30S ribosomal protein S16-likeprotein, fucose gene cluster, and RNA polymerase sigma factorSigZ-like protein (sigZ) genes, complete cds.

| ORF Name | NTID | AAID | NT Length | AA Length | Score | Probability |
|---|---|---|---|---|---|---|
| 4172012_c1_223 | 4508 | 9730 | 283 | 852 | 464 | 6.0e−44 |

| Protein name | Locus Name | Acc# |
|---|---|---|
| endo-beta-galactosidase | gp:AF083896 | AF083896 |

Description

*Flavobacterium keratolyticus* endo-beta-galactosidase gene, completecds.

-continued

| ORF Name | NTID | AAID | NT Length | AA Length | Score | Probability |
|---|---|---|---|---|---|---|
| 4320313_f2_99 | 4509 | 9731 | 520 | 1563 | 1634 | 6.2e-168 |

| Protein name | Locus Name | Acc# |
|---|---|---|
| methylmalonyl-CoA decarboxylase, alpha chain | pir:A49094 | A49094 |

Description

| ORF Name | NTID | AAID | NT Length | AA Length | Score | Probability |
|---|---|---|---|---|---|---|
| 4820387_f2_100 | 4510 | 9732 | 146 | 441 | 242 | 2.0e-20 |

| Protein name | Locus Name | Acc# |
|---|---|---|
| glutaconyl-CoA decarboxylase gamma subunit | gp:AF030576 | AF030576 |

Description

*Acidaminococcus fermentans* methylmalonyl-CoA decarboxylase alphasubunit (mmdA) gene, partial cds; and glutaconyl-CoA decarboxylasedelta subunit (gcdD), glutaconyl-CoA decarboxylase gamma subunit (gcdC), and glutaconyl-CoA decarboxylase beta subunit (gcdB) genes, complete cds.

| ORF Name | NTID | AAID | NT Length | AA Length | Score | Probability |
|---|---|---|---|---|---|---|
| 492206_f1_35 | 4511 | 9733 | 352 | 1059 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4945187_c2_248 | 4512 | 9734 | 538 | 1617 | 92 | 0.0019 |

| Protein name | Locus Name | Acc# |
|---|---|---|
| outer membrane protein | gp:BNROMPA | L77615 |

Description

*Bacteroides thetaiotaomicron* outer membrane protein (susE) gene, complete cds.

| ORF Name | NTID | AAID | NT Length | AA Length | Score | Probability |
|---|---|---|---|---|---|---|
| 5328165_c2_282 | 4513 | 9735 | 210 | 633 | 336 | 2.2e-30 |

| Protein name | Locus Name | Acc# |
|---|---|---|
| | sp:MAF_BACSU | |

Description

MAF PROTEIN

| ORF Name | NTID | AAID | NT Length | AA Length | Score | Probability |
|---|---|---|---|---|---|---|
| 5330267_c2_299 | 4514 | 9736 | 200 | 603 | 295 | 4.8e-26 |

| Protein name | Locus Name | Acc# |
|---|---|---|
| crossover junction endodeoxyribonuclease | pir:B72360 | B72360 |

Description

-continued

| ORF Name | NTID | AAID | NT Length | AA Length | Score | Probability |
|---|---|---|---|---|---|---|
| 5890712_f3_171 | 4515 | 9737 | 118 | 357 | | |

| Protein name | | | | Locus Name | | Acc# |
|---|---|---|---|---|---|---|
| Description | | | | | | |

NO-HIT

| ORF Name | NTID | AAID | NT Length | AA Length | Score | Probability |
|---|---|---|---|---|---|---|
| 5900682_f1_42 | 4516 | 9738 | 308 | 927 | | |

| Protein name | | | | Locus Name | | Acc# |
|---|---|---|---|---|---|---|
| Description | | | | | | |

NO-HIT

| ORF Name | NTID | AAID | NT Length | AA Length | Score | Probability |
|---|---|---|---|---|---|---|
| 9772930_f2_116 | 4517 | 9739 | 104 | 315 | | |

| Protein name | | | | Locus Name | | Acc# |
|---|---|---|---|---|---|---|
| Description | | | | | | |

NO-HIT

| ORF Name | NTID | AAID | NT Length | AA Length | Score | Probability |
|---|---|---|---|---|---|---|
| 9796942_c2_258 | 4518 | 9740 | 363 | 1092 | | |

| Protein name | | | | Locus Name | | Acc# |
|---|---|---|---|---|---|---|
| Description | | | | | | |

NO-HIT

| ORF Name | NTID | AAID | NT Length | AA Length | Score | Probability |
|---|---|---|---|---|---|---|
| 9847330_f3_160 | 4519 | 9741 | 353 | 1062 | 966 | 3.8e−97 |

| Protein name | | | | Locus Name | | Acc# |
|---|---|---|---|---|---|---|
| oxaloacetate decarboxylase, beta subunit | | | | pir:B72324 | | B72324 |
| Description | | | | | | |

| ORF Name | NTID | AAID | NT Length | AA Length | Score | Probability |
|---|---|---|---|---|---|---|
| 13134680_f3_49 | 4520 | 9742 | 194 | 585 | 126 | 5.8e−06 |

| Protein name | | | | Locus Name | | Acc# |
|---|---|---|---|---|---|---|
| beta-galactosidase, | | | | pir:T29434 | | T29434 |
| Description | | | | | | |

| ORF Name | NTID | AAID | NT Length | AA Length | Score | Probability |
|---|---|---|---|---|---|---|
| 14720382_f1_14 | 4521 | 9743 | 83 | 252 | | |

| Protein name | | | | Locus Name | | Acc# |
|---|---|---|---|---|---|---|
| Description | | | | | | |

NO-HIT

-continued

| ORF Name | NTID | AAID | NT Length | AA Length | Score | Probability |
|---|---|---|---|---|---|---|
| 14845965_f2_35 | 4522 | 9744 | 250 | 753 | 138 | 1.3e−06 |

| Protein name | Locus Name | Acc# |
|---|---|---|
| M-protein | gp:SEU73162 | U73162 |

Description

*Streptococcus equi* M-protein (seM) gene, complete cds.

| ORF Name | NTID | AAID | NT Length | AA Length | Score | Probability |
|---|---|---|---|---|---|---|
| 15899063_c3_109 | 4523 | 9745 | 81 | 246 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 16604818_c1_71 | 4524 | 9746 | 783 | 2352 | 200 | 4.7e−15 |

| Protein name | Locus Name | Acc# |
|---|---|---|
| colicin I receptor | gp:ECOCIR | |

Description

*E. coli* colicin I receptor gene, complete cds.

| ORF Name | NTID | AAID | NT Length | AA Length | Score | Probability |
|---|---|---|---|---|---|---|
| 17069076_f1_15 | 4525 | 9747 | 253 | 762 | 257 | 5.1e−22 |

| Protein name | Locus Name | Acc# |
|---|---|---|
| | sp:YJJG_ECOLI | |

Description

HYPOTHETICAL 25.3 KD PROTEIN IN RIMI-PRFC INTERGENIC REGION

| ORF Name | NTID | AAID | NT Length | AA Length | Score | Probability |
|---|---|---|---|---|---|---|
| 20784708_f1_1 | 4526 | 9748 | 66 | 201 | 81 | 0.021 |

| Protein name | Locus Name | Acc# |
|---|---|---|
| glutamyl-tRNA reductase | gp:AF080069 | |

Description

*Chlorobium vibrioforme* glutamyl-tRNA reductase (hemA) gene, complete cds; and porphobilinogen deaminase (hemC) gene, partialcds.

| ORF Name | NTID | AAID | NT Length | AA Length | Score | Probability |
|---|---|---|---|---|---|---|
| 23595055_c3_94 | 4527 | 9749 | 722 | 2169 | 342 | 1.1e−41 |

| Protein name | Locus Name | Acc# |
|---|---|---|
| 115K outer membrane protein precursor:SusC protein | pir:JC6027 | JC6027 |

Description

-continued

| ORF Name | NTID | AAID | NT Length | AA Length | Score | Probability |
|---|---|---|---|---|---|---|
| 24225385_f2_38 | 4528 | 9750 | 73 | 222 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24422505_f1_13 | 4529 | 9751 | 287 | 864 | 98 | 0.0043 |

| Protein name | | | | Locus Name | | Acc# |
|---|---|---|---|---|---|---|
| hypothetical protein | | | | pir:T10699 | | T10699 |

Description

| ORF Name | NTID | AAID | NT Length | AA Length | Score | Probability |
|---|---|---|---|---|---|---|
| 25504687_c2_84 | 4530 | 9752 | 219 | 660 | 568 | 5.7e−55 |

| Protein name | | | | Locus Name | | Acc# |
|---|---|---|---|---|---|---|
| thymidine kinase | | | | gp:AF028720 | | AF028720 |

Description

*Rhodothermus* sp. 'ITI 518' thymidine kinase (tdk) gene, completecds.

| ORF Name | NTID | AAID | NT Length | AA Length | Score | Probability |
|---|---|---|---|---|---|---|
| 33439010_c1_63 | 4531 | 9753 | 947 | 2844 | 968 | 2.3e−97 |

| Protein name | | | | Locus Name | | Acc# |
|---|---|---|---|---|---|---|
| receptor antigen (RagA) | | | | gp:PGI130872 | | AJ130872 |

Description

*Porphyromonas gingivalis* W50 receptor antigen (rag) locus encoding a major immunodominant 55 kDa antigen.

| ORF Name | NTID | AAID | NT Length | AA Length | Score | Probability |
|---|---|---|---|---|---|---|
| 34178252_c1_64 | 4532 | 9754 | 537 | 1614 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 36018792_f2_34 | 4533 | 9755 | 239 | 720 | 568 | 5.7e−55 |

| Protein name | | | | Locus Name | | Acc# |
|---|---|---|---|---|---|---|
| conserved hypothetical protein | | | | pir:D72343 | | D72343 |

Description

-continued

| ORF Name | NTID | AAID | NT Length | AA Length | Score | Probability |
|---|---|---|---|---|---|---|
| 3913937_c3_93 | 4534 | 9756 | 507 | 1524 | 146 | 3.9e−14 |

| Protein name | Locus Name | Acc# |
|---|---|---|
| unknown | gp:U96771 | U96771 |

Description

*Prevotella bryantii* putative polygalacturonase, B-1,4-endoglucanase, and mannanase genes, complete cds; and unknown genes.

| ORF Name | NTID | AAID | NT Length | AA Length | Score | Probability |
|---|---|---|---|---|---|---|
| 3948412_c1_72 | 4535 | 9757 | 418 | 1257 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4351417_c1_68 | 4536 | 9758 | 394 | 1185 | 300 | 1.4e−26 |

| Protein name | Locus Name | Acc# |
|---|---|---|
| probable permease perM homolog (perM) RP630 | pir:E71668 | E71668 |

Description

| ORF Name | NTID | AAID | NT Length | AA Length | Score | Probability |
|---|---|---|---|---|---|---|
| 4739778_f2_21 | 4537 | 9759 | 195 | 588 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 474143_f2_24 | 4538 | 9760 | 543 | 1632 | 628 | 2.8e−95 |

| Protein name | Locus Name | Acc# |
|---|---|---|
| endo-1,4-beta-xylanase, | pir:T30909 | T30909 |

Description

| ORF Name | NTID | AAID | NT Length | AA Length | Score | Probability |
|---|---|---|---|---|---|---|
| 4976501_f1_9 | 4539 | 9761 | 339 | 1020 | 242 | 2.0e−20 |

| Protein name | Locus Name | Acc# |
|---|---|---|
| regulatory protein pchR-2:protein slr1489:protein slr1489 | pir:S74456 | S74456 |

Description

-continued

| ORF Name | NTID | AAID | NT Length | AA Length | Score | Probability |
|---|---|---|---|---|---|---|
| 5964205_f3_58 | 4540 | 9762 | 71 | 216 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 6914125_f3_55 | 4541 | 9763 | 242 | 729 | 363 | 3.0e−33 |

| Protein name | Locus Name | Acc# |
|---|---|---|
| | sp:YVBG_BACSU | O32244 |

Description

HYPOTHETICAL 22.6 KD PROTEIN IN OPUCA-ENO INTERGENIC REGION

| ORF Name | NTID | AAID | NT Length | AA Length | Score | Probability |
|---|---|---|---|---|---|---|
| 895290_c2_83 | 4542 | 9764 | 189 | 570 | 137 | 7.6e−08 |

| Protein name | Locus Name | Acc# |
|---|---|---|
| | sp:YN23_YEAST | P53832 |

Description

PRECURSOR

| ORF Name | NTID | AAID | NT Length | AA Length | Score | Probability |
|---|---|---|---|---|---|---|
| 909513_c2_78 | 4543 | 9765 | 253 | 762 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 10578415_f2_20 | 4544 | 9766 | 1360 | 4083 | 335 | 2.0e−41 |

| Protein name | Locus Name | Acc# |
|---|---|---|
| adenylate cyclase homolog | pir:T17197 | T17197 |

Description

| ORF Name | NTID | AAID | NT Length | AA Length | Score | Probability |
|---|---|---|---|---|---|---|
| 10737900_f3_43 | 4545 | 9767 | 221 | 666 | 140 | 9.3e−08 |

| Protein name | Locus Name | Acc# |
|---|---|---|
| AnsH phosphatase | gp:SCAHBAGC2 | AF131879 |

Description

*Streptomyces collinus ansatrienin* AHBA biosynthetic gene cluster region 2, complete sequence.

-continued

| ORF Name | NTID | AAID | NT Length | AA Length | Score | Probability |
|---|---|---|---|---|---|---|
| 16832885_f2_28 | 4546 | 9768 | 159 | 477 | 535 | 1.8e−51 |

| Protein name | Locus Name | Acc# |
|---|---|---|
| hypothetical protein | pir:JQ1020 | JQ1020 |

Description

| ORF Name | NTID | AAID | NT Length | AA Length | Score | Probability |
|---|---|---|---|---|---|---|
| 16832885_f3_32 | 4547 | 9769 | 431 | 1296 | 1723 | 2.3e−177 |

| Protein name | Locus Name | Acc# |
|---|---|---|
| hypothetical protein | pir:JQ1020 | JQ1020 |

Description

| ORF Name | NTID | AAID | NT Length | AA Length | Score | Probability |
|---|---|---|---|---|---|---|
| 19537503_f1_8 | 4548 | 9770 | 188 | 567 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 1960876_f1_2 | 4549 | 9771 | 500 | 1503 | 96 | 0.0095 |

| Protein name | Locus Name | Acc# |
|---|---|---|
| putative glucosyl hydrolase precursor | gp:AF047839 | AF047839 |

Description

*Pseudoalteromonas* sp. S9 putative glucosyl hydrolase precursor and adaptive response regulatory protein (ada) genes, complete cds.

| ORF Name | NTID | AAID | NT Length | AA Length | Score | Probability |
|---|---|---|---|---|---|---|
| 19688778_c3_87 | 4550 | 9772 | 301 | 906 | 165 | 6.6e−12 |

| Protein name | Locus Name | Acc# |
|---|---|---|
| MsmR | gp:SPU49397 | U49397 |

Description

*Streptococcus pyogenes* MsmR (msmR) gene, partial cds; LepA (lepA), Cpa (cpa), and Nra (nra) genes, complete cds; SsbA (ssbA) gene, partial cds; and unknown genes.

| ORF Name | NTID | AAID | NT Length | AA Length | Score | Probability |
|---|---|---|---|---|---|---|
| 20704052_c3_82 | 4551 | 9773 | 465 | 1398 | 380 | 4.7e−35 |

| Protein name | Locus Name | Acc# |
|---|---|---|
| hypothetical protein PAB0790 | pir:H75098 | H75098 |

Description

-continued

| ORF Name | NTID | AAID | NT Length | AA Length | Score | Probability |
|---|---|---|---|---|---|---|
| 22860128_f1_3 | 4552 | 9774 | 83 | 252 | 64 | 0.031 |

| Protein name | Locus Name | Acc# |
|---|---|---|
| | sp:SPRC_XENLA | P36378 |

Description (OSTEONECTIN) (ON) (BASEMENT MEMBRANE PROTEIN BM-40)

| ORF Name | NTID | AAID | NT Length | AA Length | Score | Probability |
|---|---|---|---|---|---|---|
| 22860128_f3_49 | 4553 | 9775 | 83 | 252 | 64 | 0.031 |

| Protein name | Locus Name | Acc# |
|---|---|---|
| | sp:SPRC_XENLA | P36378 |

Description (OSTEONECTIN) (ON) (BASEMENT MEMBRANE PROTEIN BM-40)

| ORF Name | NTID | AAID | NT Length | AA Length | Score | Probability |
|---|---|---|---|---|---|---|
| 24229677_c2_64 | 4554 | 9776 | 225 | 678 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 2507010_f2_13 | 4555 | 9777 | 349 | 1050 | 213 | 4.2e−16 |

| Protein name | Locus Name | Acc# |
|---|---|---|
| hypothetical protein PH1107 | pir:D71051 | D71051 |

Description

| ORF Name | NTID | AAID | NT Length | AA Length | Score | Probability |
|---|---|---|---|---|---|---|
| 25798155_f3_36 | 4556 | 9778 | 71 | 216 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 33442_f1_9 | 4557 | 9779 | 390 | 1173 | 153 | 1.5e−16 |

| Protein name | Locus Name | Acc# |
|---|---|---|
| transcription regulator AraC/XylS family homolog ydeE | pir:G69777 | G69777 |

Description

-continued

| ORF Name | NTID | AAID | NT Length | AA Length | Score | Probability |
|---|---|---|---|---|---|---|
| 33625407_c1_50 | 4558 | 9780 | 118 | 357 | 119 | 1.6e−06 |
| Protein name | | | Locus Name | | Acc# | |
| transposase | | | gp:AF038866 | | AF038866 | |
| Description | | | | | | |

*Bacteroides fragilis* transposon Tn5520 transposase (bipH) and mobilization protein BmpH (bmpH) genes, complete cds.

| ORF Name | NTID | AAID | NT Length | AA Length | Score | Probability |
|---|---|---|---|---|---|---|
| 35555187_c3_80 | 4559 | 9781 | 112 | 339 | 111 | 1.2e−05 |
| Protein name | | | Locus Name | | Acc# | |
| transposase | | | gp:AF038866 | | AF038866 | |
| Description | | | | | | |

*Bacteroides fragilis* transposon Tn5520 transposase (bipH) and mobilization protein BmpH (bmpH) genes, complete cds.

| ORF Name | NTID | AAID | NT Length | AA Length | Score | Probability |
|---|---|---|---|---|---|---|
| 36361510_f1_10 | 4560 | 9782 | 157 | 474 | 116 | 4.5e−07 |
| Protein name | | | Locus Name | | Acc# | |
| hypothetical protein MTH628 | | | pir:E69183 | | E69183 | |
| Description | | | | | | |

| ORF Name | NTID | AAID | NT Length | AA Length | Score | Probability |
|---|---|---|---|---|---|---|
| 36523937_c2_72 | 4561 | 9783 | 658 | 1977 | 243 | 4.7e−34 |
| Protein name | | | Locus Name | | Acc# | |
| sialic acid-specific 9-O-acetylesterase | | | gp:MMAS90A | | X98625 | |
| Description | | | | | | |

*M. musculus* mRNA for sialic acid-specific 9-O-acetylesterase.

| ORF Name | NTID | AAID | NT Length | AA Length | Score | Probability |
|---|---|---|---|---|---|---|
| 4095062_c1_53 | 4562 | 9784 | 514 | 1545 | 90 | 0.00020 |
| Protein name | | | Locus Name | | Acc# | |
| oligopeptide ABC transporter, ATP-binding protein | | | pir:D72289 | | D72289 | |
| Description | | | | | | |

| ORF Name | NTID | AAID | NT Length | AA Length | Score | Probability |
|---|---|---|---|---|---|---|
| 4103816_c1_57 | 4563 | 9785 | 70 | 213 | | |
| Protein name | | | Locus Name | | Acc# | |
| Description | | | | | | |

NO-HIT

-continued

| ORF Name | NTID | AAID | NT Length | AA Length | Score | Probability |
|---|---|---|---|---|---|---|
| 4110010_f3_47 | 4564 | 9786 | 82 | 249 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 4884682_c2_65 | 4565 | 9787 | 74 | 225 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 548762_f2_21 | 4566 | 9788 | 220 | 663 | 429 | 3.0e−40 |

| Protein name | | | | Locus Name | | Acc# |
|---|---|---|---|---|---|---|
| | | | | sp:YJV8_YEAST | | P40892 |

Description (EC 2.3.1.—)

| ORF Name | NTID | AAID | NT Length | AA Length | Score | Probability |
|---|---|---|---|---|---|---|
| 587763_f3_41 | 4567 | 9789 | 170 | 513 | 212 | 3.0e−17 |

| Protein name | | | | Locus Name | | Acc# |
|---|---|---|---|---|---|---|
| hypothetical protein TM0383 | | | | pir:G72383 | | G72383 |

Description

| ORF Name | NTID | AAID | NT Length | AA Length | Score | Probability |
|---|---|---|---|---|---|---|
| 6364505_f3_29 | 4568 | 9790 | 260 | 783 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 7031556_f1_11 | 4569 | 9791 | 174 | 525 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 866537_f3_35 | 4570 | 9792 | 654 | 1965 | 354 | 4.4e−40 |

| Protein name | Locus Name | Acc# |
|---|---|---|
| alpha-glucosidase | gp:BTU66897 | U66897 |

Description

*Bacteroides thetaiotaomicron neopullulanase* (susA) and alpha-glucosidase (susB) genes, complete cds.

| ORF Name | NTID | AAID | NT Length | AA Length | Score | Probability |
|---|---|---|---|---|---|---|
| 15097187_f3_38 | 4571 | 9793 | 118 | 357 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 17074063_f2_13 | 4572 | 9794 | 98 | 297 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 193757_f2_27 | 4573 | 9795 | 788 | 2367 | 830 | 9.8e−83 |

| Protein name | Locus Name | Acc# |
|---|---|---|
| 115K outer membrane protein precursor:SusC protein | pir:JC6027 | JC6027 |

Description

| ORF Name | NTID | AAID | NT Length | AA Length | Score | Probability |
|---|---|---|---|---|---|---|
| 20820162_f2_11 | 4574 | 9796 | 597 | 1794 | 1587 | 5.9e−163 |

| Protein name | Locus Name | Acc# |
|---|---|---|
| immunoreactive 87 kD antigen PG92 | gp:AF175724 | AF175724 |

Description

*Porphyromonas gingivalis* strain W50 immunoreactive 87 kD antigen PG92 gene, complete cds.

| ORF Name | NTID | AAID | NT Length | AA Length | Score | Probability |
|---|---|---|---|---|---|---|
| 22478383_f3_37 | 4575 | 9797 | 188 | 567 | 215 | 1.4e−17 |

| Protein name | Locus Name | Acc# |
|---|---|---|
| RNA polymerase ECF-type sigma factor sigW | pir:H69706 | H69706 |

Description

-continued

| ORF Name | NTID | AAID | NT Length | AA Length | Score | Probability |
|---|---|---|---|---|---|---|
| 22698312_f1_7 | 4576 | 9798 | 359 | 1080 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 24023387_f2_12 | 4577 | 9799 | 839 | 2520 | 1103 | 1.2e−111 |
| Protein name | | | Locus Name | | | Acc# |
| putative secreted beta-galactosidase | | | gp:SCF81 | | | AL133171 |
| Description | | | | | | |

*Streptomyces coelicolor* cosmid F81.

| ORF Name | NTID | AAID | NT Length | AA Length | Score | Probability |
|---|---|---|---|---|---|---|
| 24219562_f1_9 | 4578 | 9800 | 292 | 879 | 338 | 1.3e−30 |
| Protein name | | | Locus Name | | | Acc# |
| hypothetical protein | | | pir:S76053 | | | S76053 |
| Description | | | | | | |

| ORF Name | NTID | AAID | NT Length | AA Length | Score | Probability |
|---|---|---|---|---|---|---|
| 25484661_f2_20 | 4579 | 9801 | 567 | 1704 | 1736 | 9.6e−179 |
| Protein name | | | Locus Name | | | Acc# |
| ABC transporter (ATP-binding protein) homolog ykpA | | | pir:E69861 | | | E69861 |
| Description | | | | | | |

| ORF Name | NTID | AAID | NT Length | AA Length | Score | Probability |
|---|---|---|---|---|---|---|
| 25595943_f2_10 | 4580 | 9802 | 68 | 207 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 26306512_c1_56 | 4581 | 9803 | 395 | 1188 | 1301 | 1.2e−132 |
| Protein name | | | Locus Name | | | Acc# |
| immunoreactive heat shock protein DnaJ | | | gp:AF145797 | | | AF145797 |
| Description | | | | | | |

*Porphyromonas gingivalis* strain W50 immunoreactive heat shock protein DnaJ gene, complete cds.

-continued

| ORF Name | NTID | AAID | NT Length | AA Length | Score | Probability |
|---|---|---|---|---|---|---|
| 34181503_f1_2 | 4582 | 9804 | 544 | 1635 | 130 | 5.1e−09 |

| Protein name | Locus Name | Acc# |
|---|---|---|
| outer membrane protein | gp:BNROMPB | L77614 |

Description

*Bacteroides thetaiotaomicron* outer membrane protein (susD) gene, complete cds.

| ORF Name | NTID | AAID | NT Length | AA Length | Score | Probability |
|---|---|---|---|---|---|---|
| 34553375_c2_78 | 4583 | 9805 | 83 | 252 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 35797208_f2_14 | 4584 | 9806 | 841 | 2526 | 407 | 1.1e−70 |

| Protein name | Locus Name | Acc# |
|---|---|---|
| 115K outer membrane protein precursor:SusC protein | pir:JC6027 | JC6027 |

Description

| ORF Name | NTID | AAID | NT Length | AA Length | Score | Probability |
|---|---|---|---|---|---|---|
| 36360255_f2_26 | 4585 | 9807 | 347 | 1044 | 261 | 1.9e−22 |

| Protein name | Locus Name | Acc# |
|---|---|---|
| | sp:PLC_BACCE | P14262 |

Description (PHOSPHATIDYLINOSITOL-SPECIFIC PHOSPHOLIPASE C) (PI-PLC)

| ORF Name | NTID | AAID | NT Length | AA Length | Score | Probability |
|---|---|---|---|---|---|---|
| 36540925_f2_25 | 4586 | 9808 | 85 | 258 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4328182_c3_89 | 4587 | 9809 | 353 | 1062 | 149 | 5.7e−07 |

| Protein name | Locus Name | Acc# |
|---|---|---|
| surface antigen BspA | pir:T31094 | T31094 |

Description

-continued

| ORF Name | NTID | AAID | NT Length | AA Length | Score | Probability |
|---|---|---|---|---|---|---|
| 4879627_f1_8 | 4588 | 9810 | 292 | 879 | 259 | 3.1e−22 |

| Protein name | Locus Name | Acc# |
|---|---|---|
| probable transmembrane protein | pir:T34651 | T34651 |

Description

| ORF Name | NTID | AAID | NT Length | AA Length | Score | Probability |
|---|---|---|---|---|---|---|
| 6283150_f1_1 | 4589 | 9811 | 261 | 786 | 789 | 2.2e−78 |

| Protein name | Locus Name | Acc# |
|---|---|---|
| immunoreactive 87 kD antigen PG92 | gp:AF175724 | AF175724 |

Description

*Porphyromonas gingivalis* strain W50 immunoreactive 87 kD antigen PG92 gene, complete cds.

| ORF Name | NTID | AAID | NT Length | AA Length | Score | Probability |
|---|---|---|---|---|---|---|
| 6640682_c1_55 | 4590 | 9812 | 255 | 768 | 309 | 1.6e−27 |

| Protein name | Locus Name | Acc# |
|---|---|---|
|  | sp:GREP_FRATU | P48204 |

Description

GRPE PROTEIN

| ORF Name | NTID | AAID | NT Length | AA Length | Score | Probability |
|---|---|---|---|---|---|---|
| 10000261_c3_250 | 4591 | 9813 | 297 | 894 | 603 | 1.1e−58 |

| Protein name | Locus Name | Acc# |
|---|---|---|
| integrase | gp:BFU75371 | U75371 |

Description

*Bacteroides fragilis* transposon Tn4555 TnpA (tnpA), integrase (int), TnpC (tnpC), excisionase (xis), mobilization protein (mobA), and beta-lactamase (cfxA) genes, complete cds; and unknown genes.

| ORF Name | NTID | AAID | NT Length | AA Length | Score | Probability |
|---|---|---|---|---|---|---|
| 10555153_c3_255 | 4592 | 9814 | 573 | 1722 | 373 | 5.3e−34 |

| Protein name | Locus Name | Acc# |
|---|---|---|
| hypothetical protein sll0855 | pir:S74833 | S74833 |

Description

| ORF Name | NTID | AAID | NT Length | AA Length | Score | Probability |
|---|---|---|---|---|---|---|
| 1203515_c3_268 | 4593 | 9815 | 60 | 183 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 13750040_c1_159 | 4594 | 9816 | 80 | 243 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 13759507_f3_114 | 4595 | 9817 | 304 | 915 | 159 | 5.9e−10 |
| Protein name | | | Locus Name | | | Acc# |
| hypothetical protein jhp0651 | | | pir:E71905 | | | E71905 |
| Description | | | | | | |

| ORF Name | NTID | AAID | NT Length | AA Length | Score | Probability |
|---|---|---|---|---|---|---|
| 13782212_f3_105 | 4596 | 9818 | 82 | 249 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 13882712_f2_84 | 4597 | 9819 | 87 | 264 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 14970628_c1_165 | 4598 | 9820 | 547 | 1644 | 355 | 1.3e−53 |
| Protein name | | | Locus Name | | | Acc# |
| K+ transport protein homolog | | | pir:H70430 | | | H70430 |
| Description | | | | | | |

| ORF Name | NTID | AAID | NT Length | AA Length | Score | Probability |
|---|---|---|---|---|---|---|
| 16054635_f2_70 | 4599 | 9821 | 208 | 627 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 16433140_c3_253 | 4600 | 9822 | 76 | 231 | | |
| Protein name | | | Locus Name | | | Acc# |
| Description | | | | | | |
| NO-HIT | | | | | | |

| ORF Name | NTID | AAID | NT Length | AA Length | Score | Probability |
|---|---|---|---|---|---|---|
| 16695462_f3_104 | 4601 | 9823 | 68 | 207 | | |
| Protein name | | | | Locus Name | | Acc# |
| | | | | | | |
| Description | | | | | | |
| NO-HIT | | | | | | |

| ORF Name | NTID | AAID | NT Length | AA Length | Score | Probability |
|---|---|---|---|---|---|---|
| 16832885_c1_166 | 4602 | 9824 | 431 | 1296 | 1723 | 2.3e−177 |
| Protein name | | | | Locus Name | | Acc# |
| hypothetical protein | | | | pir:JQ1020 | | JQ1020 |
| Description | | | | | | |

| ORF Name | NTID | AAID | NT Length | AA Length | Score | Probability |
|---|---|---|---|---|---|---|
| 176875_c1_156 | 4603 | 9825 | 194 | 585 | | |
| Protein name | | | | Locus Name | | Acc# |
| Description | | | | | | |
| NO-HIT | | | | | | |

| ORF Name | NTID | AAID | NT Length | AA Length | Score | Probability |
|---|---|---|---|---|---|---|
| 189010_f1_28 | 4604 | 9826 | 1198 | 3597 | 111 | 1.5e−06 |
| Protein name | | | | Locus Name | | Acc# |
| | | | | sp:YY02_METJA | | Q60301 |
| Description | | | | | | |
| HYPOTHETICAL PROTEIN MJECS02 | | | | | | |

| ORF Name | NTID | AAID | NT Length | AA Length | Score | Probability |
|---|---|---|---|---|---|---|
| 19726387_f1_8 | 4605 | 9827 | 490 | 1473 | 2625 | 6.0e−273 |
| Protein name | | | | Locus Name | | Acc# |
| | | | | sp:CATB_BACFR | | P45737 |
| Description | | | | | | |
| CATALASE, | | | | | | |

| ORF Name | NTID | AAID | NT Length | AA Length | Score | Probability |
|---|---|---|---|---|---|---|
| 19959762_c2_184 | 4606 | 9828 | 1167 | 3504 | | |
| Protein name | | | | Locus Name | | Acc# |
| Description | | | | | | |
| NO-HIT | | | | | | |

-continued

| ORF Name | NTID | AAID | NT Length | AA Length | Score | Probability |
|---|---|---|---|---|---|---|
| 20101577_f1_50 | 4607 | 9829 | 334 | 1005 | 514 | 3.0e-49 |

| Protein name | Locus Name | Acc# |
|---|---|---|
| hemin permease | pir:S54438 | S54438 |

Description

| ORF Name | NTID | AAID | NT Length | AA Length | Score | Probability |
|---|---|---|---|---|---|---|
| 20110930_f1_14 | 4608 | 9830 | 461 | 1386 | 1259 | 3.4e-128 |

| Protein name | Locus Name | Acc# |
|---|---|---|
| tryptophan synthase, subunit beta (trpB-1) homolog | pir:G69404 | G69404 |

Description

| ORF Name | NTID | AAID | NT Length | AA Length | Score | Probability |
|---|---|---|---|---|---|---|
| 20312527_c3_266 | 4609 | 9831 | 203 | 612 | 203 | 2.7e-16 |

| Protein name | Locus Name | Acc# |
|---|---|---|
| RNA polymerase sigma factor SigZ-like protein | gp:AF137263 | AF137263 |

Description

*Bacteroides thetaiotaomicron* 30S ribosomal protein S16-like protein, fucose gene cluster, and RNA polymerase sigma factor SigZ-like protein (sigZ) genes, complete cds.

| ORF Name | NTID | AAID | NT Length | AA Length | Score | Probability |
|---|---|---|---|---|---|---|
| 20320177_f2_75 | 4610 | 9832 | 278 | 837 | 103 | 0.0042 |

| Protein name | Locus Name | Acc# |
|---|---|---|
| branched-chain amino acid ABC transporter, ATP-binding protein (braG-4) homolog | pir:D69423 | D69423 |

Description

| ORF Name | NTID | AAID | NT Length | AA Length | Score | Probability |
|---|---|---|---|---|---|---|
| 20422203_f3_101 | 4611 | 9833 | 305 | 918 | 941 | 1.7e-94 |

| Protein name | Locus Name | Acc# |
|---|---|---|
| | sp:END4_ECOLI | |

Description

ENDONUCLEASE IV, (ENDODEOXYRIBONUCLEASE IV)

| ORF Name | NTID | AAID | NT Length | AA Length | Score | Probability |
|---|---|---|---|---|---|---|
| 20517142_f2_74 | 4612 | 9834 | 855 | 2568 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 20706678_c2_177 | 4613 | 9835 | 83 | 252 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 2115625_c2_207 | 4614 | 9836 | 285 | 858 | 107 | 1.1e−06 |
| Protein name | | | Locus Name | | | Acc# |
| | | | sp:YZ35_METJA | | | Q60291 |
| Description | | | | | | |

HYPOTHETICAL PROTEIN MJECL35

| ORF Name | NTID | AAID | NT Length | AA Length | Score | Probability |
|---|---|---|---|---|---|---|
| 2150262_f1_22 | 4615 | 9837 | 194 | 585 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 21739427_f1_21 | 4616 | 9838 | 161 | 486 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 22386007_c1_160 | 4617 | 9839 | 65 | 198 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 22461713_f2_69 | 4618 | 9840 | 82 | 249 | 101 | 3.9e−05 |
| Protein name | | | Locus Name | | | Acc# |
| | | | gp:BPU53767 | | | U53767 |
| Description | | | | | | |

*Bacillus pumilus* plasmid pSH1452, Rep gene, complete cds.

-continued

| ORF Name | NTID | AAID | NT Length | AA Length | Score | Probability |
|---|---|---|---|---|---|---|
| 22860128_c2_211 | 4619 | 9841 | 83 | 252 | 64 | 0.031 |

| Protein name | Locus Name | Acc# |
|---|---|---|
| | sp:SPRC_XENLA | P36378 |

Description (OSTEONECTIN) (ON) (BASEMENT MEMBRANE PROTEIN BM-40)

| ORF Name | NTID | AAID | NT Length | AA Length | Score | Probability |
|---|---|---|---|---|---|---|
| 23478176_f1_25 | 4620 | 9842 | 124 | 375 | 94 | 0.00045 |

| Protein name | Locus Name | Acc# |
|---|---|---|
| TnpC | gp:BFU75371 | U75371 |

Description

*Bacteroides fragilis* transposon Tn4555 TnpA (tnpA), integrase (int), TnpC (tnpC), excisionase (xis), mobilization protein (mobA), and beta-lactamase (cfxA) genes, complete cds; and unknown genes.

| ORF Name | NTID | AAID | NT Length | AA Length | Score | Probability |
|---|---|---|---|---|---|---|
| 23628262_f2_86 | 4621 | 9843 | 70 | 213 | 53 | 0.0033 |

| Protein name | Locus Name | Acc# |
|---|---|---|
| hypothetical protein BB0404 | pir:C70150 | C70150 |

Description

| ORF Name | NTID | AAID | NT Length | AA Length | Score | Probability |
|---|---|---|---|---|---|---|
| 23992136_f1_7 | 4622 | 9844 | 849 | 2550 | 323 | 4.9e−39 |

| Protein name | Locus Name | Acc# |
|---|---|---|
| putative alpha-glucosidase | gp:AAC252161 | AJ252161 |

Description

*Alicyclobacillus acidocaldarius* maltose/maltodextrine transport gene region (malEFGR genes, cdaA gene and glcA gene).

| ORF Name | NTID | AAID | NT Length | AA Length | Score | Probability |
|---|---|---|---|---|---|---|
| 24020312_c2_221 | 4623 | 9845 | 962 | 2889 | 436 | 2.7e−37 |

| Protein name | Locus Name | Acc# |
|---|---|---|
| 115K outer membrane protein precursor:SusC protein | pir:JC6027 | JC6027 |

Description

| ORF Name | NTID | AAID | NT Length | AA Length | Score | Probability |
|---|---|---|---|---|---|---|
| 24237762_c1_176 | 4624 | 9846 | 325 | 978 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 24241377_f3_93 | 4625 | 9847 | 320 | 963 | 1564 | 1.6e−160 |

| Protein name | Locus Name | Acc# |
|---|---|---|
| beta-lactamase, A precursor:cephalosporinase | pir:I40192 | |

Description

| ORF Name | NTID | AAID | NT Length | AA Length | Score | Probability |
|---|---|---|---|---|---|---|
| 24329702_c2_182 | 4626 | 9848 | 174 | 525 | 79 | 0.036 |

| Protein name | Locus Name | Acc# |
|---|---|---|
| unknown | gp:AF048749 | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 24415932_f3_107 | 4627 | 9849 | 422 | 1269 | 119 | 0.00030 |

| Protein name | Locus Name | Acc# |
|---|---|---|
| | sp:Y665_HAEIN | P44033 |

Description

HYPOTHETICAL PROTEIN HI0665

| ORF Name | NTID | AAID | NT Length | AA Length | Score | Probability |
|---|---|---|---|---|---|---|
| 24648550_f3_109 | 4628 | 9850 | 213 | 642 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 25658441_c2_222 | 4629 | 9851 | 69 | 210 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 25945152_f2_71 | 4630 | 9852 | 1215 | 3648 | 93 | 0.014 |

| Protein name | Locus Name | Acc# |
|---|---|---|
| rhoptry protein | pir:T28676 | T28676 |

Description

-continued

| ORF Name | NTID | AAID | NT Length | AA Length | Score | Probability |
|---|---|---|---|---|---|---|
| 26594683_c2_185 | 4631 | 9853 | 728 | 2187 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 26597832_f3_113 | 4632 | 9854 | 679 | 2040 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 3006377_f2_66 | 4633 | 9855 | 98 | 297 | 113 | 4.0e−06 |
| Protein name | | | Locus Name | | | Acc# |
| AbiEii | | | gp:LLU36837 | | | U36837 |
| Description | | | | | | |

*Lactococcus lactis* plasmid pNP40, abortive infection locus, AbiEi, AbiEii, RecA(LP), AbiF genes, complete cds.

| ORF Name | NTID | AAID | NT Length | AA Length | Score | Probability |
|---|---|---|---|---|---|---|
| 30128208_c2_206 | 4634 | 9856 | 96 | 291 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 32243757_f1_26 | 4635 | 9857 | 89 | 270 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 34257752_c2_216 | 4636 | 9858 | 369 | 1110 | 209 | 7.6e−24 |
| Protein name | | | Locus Name | | | Acc# |
| | | | sp:XYLB_BACOV | | | P49943 |
| Description | | | | | | |

| ORF Name | NTID | AAID | NT Length | AA Length | Score | Probability |
|---|---|---|---|---|---|---|
| 34578410_c3_254 | 4637 | 9859 | 72 | 219 | | |
| Protein name | | | | Locus Name | | Acc# |
| Description | | | | | | |

NO-HIT

| ORF Name | NTID | AAID | NT Length | AA Length | Score | Probability |
|---|---|---|---|---|---|---|
| 35665952_f3_95 | 4638 | 9860 | 127 | 384 | 644 | 5.0e−63 |
| Protein name | | | | Locus Name | | Acc# |
| hypothetical protein 2 | | | | pir:I40233 | | I40233 |
| Description | | | | | | |

| ORF Name | NTID | AAID | NT Length | AA Length | Score | Probability |
|---|---|---|---|---|---|---|
| 35792967_c2_183 | 4639 | 9861 | 660 | 1983 | 2579 | 4.5e−268 |
| Protein name | | | | Locus Name | | Acc# |
| DnaK | | | | gp:AB015879 | | AB015879 |
| Description | | | | | | |

*Porphyromonas gingivalis* dnaK operon genes, complete cds.

| ORF Name | NTID | AAID | NT Length | AA Length | Score | Probability |
|---|---|---|---|---|---|---|
| 3959627_c3_225 | 4640 | 9862 | 196 | 591 | 295 | 4.8e−26 |
| Protein name | | | | Locus Name | | Acc# |
| ORF5 | | | | gp:AB015879 | | AB015879 |
| Description | | | | | | |

*Porphyromonas gingivalis* dnaK operon genes, complete cds.

| ORF Name | NTID | AAID | NT Length | AA Length | Score | Probability |
|---|---|---|---|---|---|---|
| 4147126_f1_32 | 4641 | 9863 | 318 | 957 | 534 | 2.3e−51 |
| Protein name | | | | Locus Name | | Acc# |
| 5′-nucleotidase | | | | gp:CLI131243 | | AJ131243 |
| Description | | | | | | |

*Columba livia* mRNA for 5′-nucleotidase.

| ORF Name | NTID | AAID | NT Length | AA Length | Score | Probability |
|---|---|---|---|---|---|---|
| 4173530_c2_192 | 4642 | 9864 | 62 | 189 | | |
| Protein name | | | | Locus Name | | Acc# |
| Description | | | | | | |

NO-HIT

-continued

| ORF Name | NTID | AAID | NT Length | AA Length | Score | Probability |
|---|---|---|---|---|---|---|
| 42700_c1_167 | 4643 | 9865 | 95 | 288 | 163 | 3.1e−11 |

| Protein name | | | | Locus Name | | Acc# |
|---|---|---|---|---|---|---|
| Na+-ATPase chain J:protein slr1509:protein slr1509 | | | | pir:S75455 | | S75455 |

Description

| ORF Name | NTID | AAID | NT Length | AA Length | Score | Probability |
|---|---|---|---|---|---|---|
| 4727280_f2_87 | 4644 | 9866 | 396 | 1191 | 277 | 8.9e−23 |

| Protein name | | | | Locus Name | | Acc# |
|---|---|---|---|---|---|---|
| | | | | sp:Y878_METJA | | Q58288 |

Description

HYPOTHETICAL PROTEIN MJ0878

| ORF Name | NTID | AAID | NT Length | AA Length | Score | Probability |
|---|---|---|---|---|---|---|
| 4727337_f1_29 | 4645 | 9867 | 536 | 1611 | 127 | 1.4e−13 |

| Protein name | | | | Locus Name | | Acc# |
|---|---|---|---|---|---|---|
| hypothetical protein PAB1002 | | | | pir:G75064 | | G75064 |

Description

| ORF Name | NTID | AAID | NT Length | AA Length | Score | Probability |
|---|---|---|---|---|---|---|
| 4954832_f2_55 | 4646 | 9868 | 60 | 183 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 5274003_c1_138 | 4647 | 9869 | 724 | 2175 | 438 | 3.0e−52 |

| Protein name | | | | Locus Name | | Acc# |
|---|---|---|---|---|---|---|
| otnA protein | | | | pir:S70958 | | S70958 |

Description

| ORF Name | NTID | AAID | NT Length | AA Length | Score | Probability |
|---|---|---|---|---|---|---|
| 9798467_c1_140 | 4648 | 9870 | 78 | 237 | | |

| Protein name | | | | Locus Name | | Acc# |
|---|---|---|---|---|---|---|

Description

NO-HIT

-continued

| ORF Name | NTID | AAID | NT Length | AA Length | Score | Probability |
|---|---|---|---|---|---|---|
| 984805_c1_168 | 4649 | 9871 | 233 | 702 | 294 | 6.2e−26 |

| Protein name | Locus Name | Acc# |
|---|---|---|
| conserved hypothetical protein aq_1503 | pir:G70430 | G70430 |

Description

| ORF Name | NTID | AAID | NT Length | AA Length | Score | Probability |
|---|---|---|---|---|---|---|
| 1211062_f2_93 | 4650 | 9872 | 84 | 255 | 90 | 0.0068 |

| Protein name | Locus Name | Acc# |
|---|---|---|
| Cry1A toxin receptor A | gp:AF173552 | AF173552 |

Description

*Heliothis virescens* Cry1A toxin receptor A mRNA, complete cds.

| ORF Name | NTID | AAID | NT Length | AA Length | Score | Probability |
|---|---|---|---|---|---|---|
| 1226510_c1_222 | 4651 | 9873 | 448 | 1347 | 319 | 1.3e−31 |

| Protein name | Locus Name | Acc# |
|---|---|---|
| putative putrescine/spermidine binding protein | gp:PSEPAHP | L49465 |

Description

*Pseudomonas fluorescens* hypothetical metabolite transport protein, positive transcriptional regulator (phnR), phosphonoacetatehydrolase (phnA), 2-phosphonopropionate transporter (phnB), putative putrescine/spermidine binding protein, and putative methionine sulfoxide reductase genes, complete cds.

| ORF Name | NTID | AAID | NT Length | AA Length | Score | Probability |
|---|---|---|---|---|---|---|
| 13906285_f1_29 | 4652 | 9874 | 1069 | 3210 | 393 | 1.8e−48 |

| Protein name | Locus Name | Acc# |
|---|---|---|
| histidine protein kinase homolog GacS | gp:AF197912 | AF197912 |

Description

*Azotobacter vinelandii* histidine protein kinase homolog GacS (gacS) gene, complete cds.

| ORF Name | NTID | AAID | NT Length | AA Length | Score | Probability |
|---|---|---|---|---|---|---|
| 14225953_f3_194 | 4653 | 9875 | 65 | 198 | 158 | 1.6e−11 |

| Protein name | Locus Name | Acc# |
|---|---|---|
| hypothetical protein APE2061 | pir:G72510 | G72510 |

Description

| ORF Name | NTID | AAID | NT Length | AA Length | Score | Probability |
|---|---|---|---|---|---|---|
| 14485880_f1_53 | 4654 | 9876 | 395 | 1188 | 206 | 4.5e−16 |

| Protein name | Locus Name | Acc# |
|---|---|---|
|  | sp:TLPA_BRAJA | P43221 |

Description (PROTEIN TLPA)

-continued

| ORF Name | NTID | AAID | NT Length | AA Length | Score | Probability |
|---|---|---|---|---|---|---|
| 14539662_f3_160 | 4655 | 9877 | 204 | 615 | 308 | 2.0e−27 |

| Protein name | Locus Name | Acc# |
|---|---|---|
| hypothetical protein MTH671 | pir:D69189 | D69189 |

Description

| ORF Name | NTID | AAID | NT Length | AA Length | Score | Probability |
|---|---|---|---|---|---|---|
| 14630035_c2_271 | 4656 | 9878 | 597 | 1794 | 1319 | 1.5e−134 |

| Protein name | Locus Name | Acc# |
|---|---|---|
| probable V-type ATPase, subunit A (atpA-1) | pir:G71325 | G71325 |

Description

| ORF Name | NTID | AAID | NT Length | AA Length | Score | Probability |
|---|---|---|---|---|---|---|
| 15712666_f1_24 | 4657 | 9879 | 198 | 597 | 222 | 2.6e−18 |

| Protein name | Locus Name | Acc# |
|---|---|---|
|  | sp:YJJP_HAEIN | P44520 |

Description

HYPOTHETICAL PROTEIN HI0108

| ORF Name | NTID | AAID | NT Length | AA Length | Score | Probability |
|---|---|---|---|---|---|---|
| 15719042_c2_270 | 4658 | 9880 | 296 | 891 | 93 | 5.1e−06 |

| Protein name | Locus Name | Acc# |
|---|---|---|
| hypothetical protein BB0095 | pir:G70111 | G70111 |

Description

| ORF Name | NTID | AAID | NT Length | AA Length | Score | Probability |
|---|---|---|---|---|---|---|
| 16539038_c3_351 | 4659 | 9881 | 199 | 600 | 427 | 5.0e−40 |

| Protein name | Locus Name | Acc# |
|---|---|---|
| 2-keto-3-deoxygluconate kinase | pir:G72422 | G72422 |

Description

| ORF Name | NTID | AAID | NT Length | AA Length | Score | Probability |
|---|---|---|---|---|---|---|
| 16610827_f1_37 | 4660 | 9882 | 468 | 1407 | 753 | 1.4e−74 |

| Protein name | Locus Name | Acc# |
|---|---|---|
| Na+/H+ antiporter (nhaC-1) homolog | pir:D70179 | D70179 |

Description

| ORF Name | NTID | AAID | NT Length | AA Length | Score | Probability |
|---|---|---|---|---|---|---|
| 16833455_c2_316 | 4661 | 9883 | 304 | 915 | 589 | 3.4e−57 |

| Protein name | Locus Name | Acc# |
|---|---|---|
| cation efflux system protein | gp:AF203881 | AF203881 |

Description

*Zymomonas mobilis* strain ZM4 clone 43F4, complete sequence.

| ORF Name | NTID | AAID | NT Length | AA Length | Score | Probability |
|---|---|---|---|---|---|---|
| 19687750_c1_228 | 4662 | 9884 | 75 | 228 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 20972755_f3_146 | 4663 | 9885 | 85 | 258 | 78 | 0.0019 |

| Protein name | Locus Name | Acc# |
|---|---|---|
| | sp:PRS6_MANSE | P46507 |

Description

26S PROTEASE REGULATORY SUBUNIT 6B (ATPASE MS73)

| ORF Name | NTID | AAID | NT Length | AA Length | Score | Probability |
|---|---|---|---|---|---|---|
| 21515678_c3_334 | 4664 | 9886 | 865 | 2598 | 1621 | 1.5e−166 |

| Protein name | Locus Name | Acc# |
|---|---|---|
| hypothetical protein PH1512 | pir:D71027 | D71027 |

Description

| ORF Name | NTID | AAID | NT Length | AA Length | Score | Probability |
|---|---|---|---|---|---|---|
| 22445301_f2_87 | 4665 | 9887 | 231 | 696 | 122 | 2.0e−07 |

| Protein name | Locus Name | Acc# |
|---|---|---|
| unknown | gp:AF125164 | AF125164 |

Description

*Bacteroides fragilis* 638R polysaccharide B (PS B2) biosynthesislocus, complete sequence; and unknown genes.

| ORF Name | NTID | AAID | NT Length | AA Length | Score | Probability |
|---|---|---|---|---|---|---|
| 22454707_f3_161 | 4666 | 9888 | 356 | 1071 | 1394 | 1.7e−142 |

| Protein name | Locus Name | Acc# |
|---|---|---|
| | sp:RIR2_TREPA | O83092 |

Description (RIBONUCLEOTIDE REDUCTASE)

-continued

| ORF Name | NTID | AAID | NT Length | AA Length | Score | Probability |
|---|---|---|---|---|---|---|
| 23595180_c1_266 | 4667 | 9889 | 403 | 1212 | 268 | 1.7e−21 |

| Protein name | Locus Name | Acc# |
|---|---|---|
| | sp:YRKO_BACSU | P54442 |

Description

HYPOTHETICAL 46.4 KD PROTEIN IN BLTR-SPOIIC INTERGENIC REGION

| ORF Name | NTID | AAID | NT Length | AA Length | Score | Probability |
|---|---|---|---|---|---|---|
| 23631627_c1_213 | 4668 | 9890 | 444 | 1335 | 1018 | 1.2e−102 |

| Protein name | Locus Name | Acc# |
|---|---|---|
| probable V-type ATPase, subunit B (atpB-1) | pir:H71325 | H71325 |

Description

| ORF Name | NTID | AAID | NT Length | AA Length | Score | Probability |
|---|---|---|---|---|---|---|
| 24253311_f3_167 | 4669 | 9891 | 405 | 1218 | 213 | 3.9e−15 |

| Protein name | Locus Name | Acc# |
|---|---|---|
| | gp:AB016260 | |

Description

*Agrobacterium tumefaciens* plasmid pTi-SAKURA, complete sequence.

| ORF Name | NTID | AAID | NT Length | AA Length | Score | Probability |
|---|---|---|---|---|---|---|
| 24257692_f1_9 | 4670 | 9892 | 599 | 1800 | 649 | 1.5e−63 |

| Protein name | Locus Name | Acc# |
|---|---|---|
| TonB-dependent receptor HmuR | gp:PGU87395 | U87395 |

Description

*Porphyromonas gingivalis* TonB-dependent receptor HmuR (hmuR) gene, complete cds.

| ORF Name | NTID | AAID | NT Length | AA Length | Score | Probability |
|---|---|---|---|---|---|---|
| 24347153_c3_330 | 4671 | 9893 | 623 | 1872 | 559 | 5.1e−54 |

| Protein name | Locus Name | Acc# |
|---|---|---|
| V-type ATPase, subunit I homolog | pir:C70111 | C70111 |

Description

| ORF Name | NTID | AAID | NT Length | AA Length | Score | Probability |
|---|---|---|---|---|---|---|
| 24509627_c3_350 | 4672 | 9894 | 142 | 429 | 494 | 3.9e−47 |

| Protein name | Locus Name | Acc# |
|---|---|---|
| 2-keto-3-deoxygluconate kinase | pir:G72422 | G72422 |

Description

-continued

| ORF Name | NTID | AAID | NT Length | AA Length | Score | Probability |
|---|---|---|---|---|---|---|
| 24806567_c1_238 | 4673 | 9895 | 119 | 360 | 245 | 9.6e−21 |

| Protein name | Locus Name | Acc# |
|---|---|---|
| conserved hypothetical protein MTH1285 | pir:A69038 | A69038 |

Description

| ORF Name | NTID | AAID | NT Length | AA Length | Score | Probability |
|---|---|---|---|---|---|---|
| 25469832_f3_184 | 4674 | 9896 | 252 | 759 | 824 | 4.2e−82 |

| Protein name | Locus Name | Acc# |
|---|---|---|
| 30S ribosomal protein S16-like protein | gp:AF137263 | AF137263 |

Description

*Bacteroides thetaiotaomicron* 30S ribosomal protein S16-likeprotein, fucose
gene cluster, and RNA polymerase sigma factorSigZ-like protein (sigZ) genes, complete cds.

| ORF Name | NTID | AAID | NT Length | AA Length | Score | Probability |
|---|---|---|---|---|---|---|
| 25984388_f1_47 | 4675 | 9897 | 447 | 1344 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 26288442_c3_348 | 4676 | 9898 | 154 | 465 | 233 | 1.8e−19 |

| Protein name | Locus Name | Acc# |
|---|---|---|
| conserved hypothetical protein yvbK | pir:B70030 | B70030 |

Description

| ORF Name | NTID | AAID | NT Length | AA Length | Score | Probability |
|---|---|---|---|---|---|---|
| 26365691_c2_287 | 4677 | 9899 | 243 | 732 | 184 | 1.0e−22 |

| Protein name | Locus Name | Acc# |
|---|---|---|
| hypothetical protein | pir:B756629 | B75629 |

Description

| ORF Name | NTID | AAID | NT Length | AA Length | Score | Probability |
|---|---|---|---|---|---|---|
| 29337830_c1_231 | 4678 | 9900 | 371 | 1116 | 214 | 7.6e−25 |

| Protein name | Locus Name | Acc# |
|---|---|---|
| hypothetical protein | pir:H75628 | H75628 |

Description

-continued

| ORF Name | NTID | AAID | NT Length | AA Length | Score | Probability |
|---|---|---|---|---|---|---|
| 29589842_c2_268 | 4679 | 9901 | 65 | 198 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 30493775_c3_332 | 4680 | 9902 | 61 | 186 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 31461016_c3_380 | 4681 | 9903 | 515 | 1548 | 700 | 5.8e−69 |

| Protein name | | | | Locus Name | | Acc# |
|---|---|---|---|---|---|---|
| | | | | sp:YHCA_BACSU | | P54585 |

Description

HYPOTHETICAL 58.3 KD PROTEIN IN GLPD-CSPB INTERGENIC REGION

| ORF Name | NTID | AAID | NT Length | AA Length | Score | Probability |
|---|---|---|---|---|---|---|
| 31833126_f2_86 | 4682 | 9904 | 309 | 930 | 106 | 0.021 |

| Protein name | | | | Locus Name | | Acc# |
|---|---|---|---|---|---|---|
| probable erythrocyte-binding protein MAEBL | | | | pir:T09129 | | T09129 |

Description

| ORF Name | NTID | AAID | NT Length | AA Length | Score | Probability |
|---|---|---|---|---|---|---|
| 32042553_c2_317 | 4683 | 9905 | 61 | 186 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 32234752_f2_91 | 4684 | 9906 | 117 | 354 | 73 | 0.016 |

| Protein name | | | | Locus Name | | Acc# |
|---|---|---|---|---|---|---|
| hypothetical protein MTH670 | | | | pir:C69189 | | C69189 |

Description

| ORF Name | NTID | AAID | NT Length | AA Length | Score | Probability |
|---|---|---|---|---|---|---|
| 33236050_c3_377 | 4685 | 9907 | 138 | 417 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 33401552_c1_230 | 4686 | 9908 | 211 | 636 | 386 | 1.1e−35 |

| Protein name | Locus Name | Acc# |
|---|---|---|
| peptide chain release factor homolog prfH | pir:E64748 | E64748 |

Description

| ORF Name | NTID | AAID | NT Length | AA Length | Score | Probability |
|---|---|---|---|---|---|---|
| 33711081_f2_136 | 4687 | 9909 | 99 | 300 | 111 | 2.4e−06 |

| Protein name | Locus Name | Acc# |
|---|---|---|
| hypothetical protein | gp:SSU18930 | Y18930 |

Description

*Sulfolobus solfataricus* 281 kb genomic DNA fragment, strain P2.

| ORF Name | NTID | AAID | NT Length | AA Length | Score | Probability |
|---|---|---|---|---|---|---|
| 3398466_f2_90 | 4688 | 9910 | 1467 | 4404 | 687 | 4.4e−125 |

| Protein name | Locus Name | Acc# |
|---|---|---|
| cobalamin biosynthesis protein N | pir:C69048 | C69048 |

Description

| ORF Name | NTID | AAID | NT Length | AA Length | Score | Probability |
|---|---|---|---|---|---|---|
| 34065926_c1_265 | 4689 | 9911 | 231 | 696 | 231 | 5.8e−26 |

| Protein name | Locus Name | Acc# |
|---|---|---|
| hypothetical protein aq_1060 | pir:D70391 | D70391 |

Description

| ORF Name | NTID | AAID | NT Length | AA Length | Score | Probability |
|---|---|---|---|---|---|---|
| 34081405_c1_212 | 4690 | 9912 | 88 | 267 | 110 | 1.9e−06 |

| Protein name | Locus Name | Acc# |
|---|---|---|
| hypothetical protein PHS004 | pir:F71245 | F71245 |

Description

| ORF Name | NTID | AAID | NT Length | AA Length | Score | Probability |
|---|---|---|---|---|---|---|
| 34242285_c1_221 | 4691 | 9913 | 269 | 810 | 469 | 1.8e−44 |

| Protein name | Locus Name | Acc# |
|---|---|---|
| spermidine/putrescine ABC transporter, permease protein (potC) homolog | pir:G70179 | G70179 |

Description

-continued

| ORF Name | NTID | AAID | NT Length | AA Length | Score | Probability |
|---|---|---|---|---|---|---|
| 34648557_c2_279 | 4692 | 9914 | 137 | 414 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 35352135_c3_339 | 4693 | 9915 | 417 | 1254 | 97 | 0.038 |

| Protein name | | | | Locus Name | | Acc# |
|---|---|---|---|---|---|---|
| hypothetical protein DKFZp566D1824.1 | | | | pir:T14767 | | T14767 |

Description

| ORF Name | NTID | AAID | NT Length | AA Length | Score | Probability |
|---|---|---|---|---|---|---|
| 3926531_f2_94 | 4694 | 9916 | 260 | 783 | 257 | 5.1e−22 |

| Protein name | | | | Locus Name | | Acc# |
|---|---|---|---|---|---|---|
| | | | | sp:YJJP_ECOLI | | P39402 |

Description

HYPOTHETICAL 30.5 KD PROTEIN IN DNAT-BGLJ INTERGENIC REGION (F277)

| ORF Name | NTID | AAID | NT Length | AA Length | Score | Probability |
|---|---|---|---|---|---|---|
| 3939211_f2_89 | 4695 | 9917 | 185 | 558 | 206 | 1.4e−15 |

| Protein name | | | | Locus Name | | Acc# |
|---|---|---|---|---|---|---|
| TonB-dependent receptor HmuR | | | | gp:PGU87395 | | U87395 |

Description

*Porphyromonas gingivalis* TonB-dependent receptor HmuR (hmuR) gene, complete cds.

| ORF Name | NTID | AAID | NT Length | AA Length | Score | Probability |
|---|---|---|---|---|---|---|
| 4069152_c1_241 | 4696 | 9918 | 227 | 684 | 262 | 1.5e−22 |

| Protein name | | | | Locus Name | | Acc# |
|---|---|---|---|---|---|---|
| 2-dehydro-3-deoxyphosphogluconate aldolase/4-hydroxy-2-oxoglutarate aldolase | | | | pir:F72422 | | F72422 |

Description

| ORF Name | NTID | AAID | NT Length | AA Length | Score | Probability |
|---|---|---|---|---|---|---|
| 4103530_c3_326 | 4697 | 9919 | 199 | 600 | 152 | 6.9e−11 |

| Protein name | | | | Locus Name | | Acc# |
|---|---|---|---|---|---|---|
| V-type ATPase, subunit E homolog | | | | pir:H70111 | | H70111 |

Description

-continued

| ORF Name | NTID | AAID | NT Length | AA Length | Score | Probability |
|---|---|---|---|---|---|---|
| 4148892_c1_217 | 4698 | 9920 | 220 | 663 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 489680_f1_43 | 4699 | 9921 | 130 | 393 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 4900276_f2_92 | 4700 | 9922 | 840 | 2523 | 2812 | 9.2e−293 |

| Protein name | | | | Locus Name | | Acc# |
|---|---|---|---|---|---|---|
| | | | | sp:RIR1_TREPA | | O83972 |

Description (RIBONUCLEOTIDE REDUCTASE)

| ORF Name | NTID | AAID | NT Length | AA Length | Score | Probability |
|---|---|---|---|---|---|---|
| 4956537_f1_17 | 4701 | 9923 | 234 | 705 | 99 | 0.012 |

| Protein name | | | | Locus Name | | Acc# |
|---|---|---|---|---|---|---|
| conserved hypothetical protein AF1223 | | | | pir:F69402 | | F69402 |

Description

| ORF Name | NTID | AAID | NT Length | AA Length | Score | Probability |
|---|---|---|---|---|---|---|
| 4960967_f3_145 | 4702 | 9924 | 79 | 240 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 501952_c3_336 | 4703 | 9925 | 470 | 1413 | 1004 | 3.6e−101 |

| Protein name | | | | Locus Name | | Acc# |
|---|---|---|---|---|---|---|
| spermidine/putrescine ABC transporter, ATP-binding protein (potA) homolog | | | | pir:A70180 | | A70180 |

Description

-continued

| ORF Name | NTID | AAID | NT Length | AA Length | Score | Probability |
|---|---|---|---|---|---|---|
| 5285927_c1_214 | 4704 | 9926 | 204 | 615 | 231 | 2.9e−19 |

| Protein name | Locus Name | Acc# |
|---|---|---|
| probable V-type ATPase, subunit D (atpD-1) | pir:A71326 | A71326 |

Description

| ORF Name | NTID | AAID | NT Length | AA Length | Score | Probability |
|---|---|---|---|---|---|---|
| 5892183_c3_342 | 4705 | 9927 | 439 | 1320 | 1009 | 1.1e−101 |

| Protein name | Locus Name | Acc# |
|---|---|---|
| rtcB protein | pir:D75521 | D75521 |

Description

| ORF Name | NTID | AAID | NT Length | AA Length | Score | Probability |
|---|---|---|---|---|---|---|
| 5909512_c3_333 | 4706 | 9928 | 593 | 1782 | 427 | 4.8e−60 |

| Protein name | Locus Name | Acc# |
|---|---|---|
| UDPglucose--glycogen glucosyltransferase,, skeletal muscle:glycogen (starch) synthase:glycogen (starch) synthase | pir:A33369 | |

Description

| ORF Name | NTID | AAID | NT Length | AA Length | Score | Probability |
|---|---|---|---|---|---|---|
| 6912588_c2_278 | 4707 | 9929 | 268 | 807 | 426 | 6.3e−40 |

| Protein name | Locus Name | Acc# |
|---|---|---|
| spermidine/putrescine ABC transporter, permease protein (potB) homolog | pir:H70179 | H70179 |

Description

| ORF Name | NTID | AAID | NT Length | AA Length | Score | Probability |
|---|---|---|---|---|---|---|
| 7072953_c1_243 | 4708 | 9930 | 72 | 219 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 781561_c3_338 | 4709 | 9931 | 133 | 402 | 294 | 6.2e−26 |

| Protein name | Locus Name | Acc# |
|---|---|---|
| glycine-rich RNA-binding protein (clone A81) | pir:S31443 | S31443 |

Description

-continued

| ORF Name | NTID | AAID | NT Length | AA Length | Score | Probability |
|---|---|---|---|---|---|---|
| 791537_c1_225 | 4710 | 9932 | 688 | 2067 | 55 | 0.036 |

| Protein name | | | Locus Name | | | Acc# |
|---|---|---|---|---|---|---|
| | | | gp:CPU53466 | | | U53466 |

Description

*Cydia pomonella* granulosis virus ORF13L gene, partial cds, ORF15L, ORF15R, ORF16L, ORF17L genes, complete cds, ORF17R gene, partialcds.

| ORF Name | NTID | AAID | NT Length | AA Length | Score | Probability |
|---|---|---|---|---|---|---|
| 970262_c2_274 | 4711 | 9933 | 163 | 492 | 228 | 6.1e−19 |

| Protein name | | | Locus Name | | | Acc# |
|---|---|---|---|---|---|---|
| hypothetical protein PH1980 | | | pir:D71214 | | | D71214 |

Description

| ORF Name | NTID | AAID | NT Length | AA Length | Score | Probability |
|---|---|---|---|---|---|---|
| 975186_c3_379 | 4712 | 9934 | 540 | 1623 | 749 | 3.7e−74 |

| Protein name | | | Locus Name | | | Acc# |
|---|---|---|---|---|---|---|
| | | | sp:YIDE_HAEIN | | | P44472 |

Description

HYPOTHETICAL PROTEIN HI0035

| ORF Name | NTID | AAID | NT Length | AA Length | Score | Probability |
|---|---|---|---|---|---|---|
| 11882928_f1_24 | 4713 | 9935 | 65 | 198 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 11929010_f1_30 | 4714 | 9936 | 75 | 228 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 1192950_f1_6 | 4715 | 9937 | 67 | 204 | | |

| Protein name | | | Locus Name | | | Acc# |
|---|---|---|---|---|---|---|

Description

NO-HIT

-continued

| ORF Name | NTID | AAID | NT Length | AA Length | Score | Probability |
|---|---|---|---|---|---|---|
| 12112502_c3_184 | 4716 | 9938 | 519 | 1560 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 12535687_f2_39 | 4717 | 9939 | 735 | 2208 | 580 | 3.4e−76 |

| Protein name | | | Locus Name | | | Acc# |
|---|---|---|---|---|---|---|
| hypothetical protein TM0280 | | | pir:F72395 | | | F72395 |

Description

| ORF Name | NTID | AAID | NT Length | AA Length | Score | Probability |
|---|---|---|---|---|---|---|
| 1282807_c2_129 | 4718 | 9940 | 64 | 195 | 53 | 0.017 |

| Protein name | | | Locus Name | | | Acc# |
|---|---|---|---|---|---|---|
| | | | sp:RYL2_YARLI | | | P41925 |

Description

RAS-LIKE GTP-BINDING PROTEIN RYL2

| ORF Name | NTID | AAID | NT Length | AA Length | Score | Probability |
|---|---|---|---|---|---|---|
| 13066438_f2_54 | 4719 | 9941 | 88 | 267 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 13798552_f2_57 | 4720 | 9942 | 69 | 210 | | |

| Protein name | | | Locus Name | | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 14709701_c1_123 | 4721 | 9943 | 363 | 1092 | 521 | 5.4e−50 |

| Protein name | | | Locus Name | | | Acc# |
|---|---|---|---|---|---|---|
| FucR | | | gp:AF137263 | | | AF137263 |

Description

*Bacteroides thetaiotaomicron* 30S ribosomal protein S16-likeprotein, fucose
gene cluster, and RNA polymerase sigma factorSigZ-like protein (sigZ) genes, complete cds.

-continued

| ORF Name | NTID | AAID | NT Length | AA Length | Score | Probability |
|---|---|---|---|---|---|---|
| 187637_c2_130 | 4722 | 9944 | 641 | 1926 | | |

| Protein name | | Locus Name | Acc# |
|---|---|---|---|
| | | | |

Description

NO-HIT

| ORF Name | NTID | AAID | NT Length | AA Length | Score | Probability |
|---|---|---|---|---|---|---|
| 22353385_f2_44 | 4723 | 9945 | 157 | 474 | 313 | 6.0e−28 |

| Protein name | | Locus Name | Acc# |
|---|---|---|---|
| hypothetical protein slr0698 | | pir:S77038 | S77038 |

Description

| ORF Name | NTID | AAID | NT Length | AA Length | Score | Probability |
|---|---|---|---|---|---|---|
| 22939206_c1_101 | 4724 | 9946 | 393 | 1182 | 908 | 5.3e−91 |

| Protein name | | Locus Name | Acc# |
|---|---|---|---|
| hypothetical protein | | pir:H72299 | H72299 |

Description

| ORF Name | NTID | AAID | NT Length | AA Length | Score | Probability |
|---|---|---|---|---|---|---|
| 23615930_c3_176 | 4725 | 9947 | 696 | 2091 | 457 | 3.1e−41 |

| Protein name | | Locus Name | Acc# |
|---|---|---|---|
| | | sp:BGAL_THETU | P26257 |

Description

BETA-GALACTOSIDASE, (LACTASE)

| ORF Name | NTID | AAID | NT Length | AA Length | Score | Probability |
|---|---|---|---|---|---|---|
| 23625926_c1_126 | 4726 | 9948 | 390 | 1173 | 246 | 6.8e−19 |

| Protein name | | Locus Name | Acc# |
|---|---|---|---|
| unknown | | gp:AF141932 | AF141932 |

Description

*Rhizobium leguminosarum* bv. *trifolii* plasmid PR1e162Y10C rspDEFoperon, partial sequence.

| ORF Name | NTID | AAID | NT Length | AA Length | Score | Probability |
|---|---|---|---|---|---|---|
| 24259438_c1_125 | 4727 | 9949 | 204 | 615 | 98 | 0.026 |

| Protein name | | Locus Name | Acc# |
|---|---|---|---|
| protein kinase,, cGMP-dependent | | pir:B28269 | B28269 |

Description

-continued

| ORF Name | NTID | AAID | NT Length | AA Length | Score | Probability |
|---|---|---|---|---|---|---|
| 24335301_f2_43 | 4728 | 9950 | 606 | 1821 | 1237 | 7.3e−126 |
| Protein name | | | | Locus Name | | Acc# |
| | | | | sp:LCFH_HAEIN | | P44446 |

Description (ACYL-COA SYNTHETASE) (LACS)

| ORF Name | NTID | AAID | NT Length | AA Length | Score | Probability |
|---|---|---|---|---|---|---|
| 24626876_f3_63 | 4729 | 9951 | 469 | 1410 | | |
| Protein name | | | | Locus Name | | Acc# |

Description

NO-HIT

| ORF Name | NTID | AAID | NT Length | AA Length | Score | Probability |
|---|---|---|---|---|---|---|
| 24640762_c1_95 | 4730 | 9952 | 380 | 1143 | | |
| Protein name | | | | Locus Name | | Acc# |

Description

NO-HIT

| ORF Name | NTID | AAID | NT Length | AA Length | Score | Probability |
|---|---|---|---|---|---|---|
| 26595067_f1_15 | 4731 | 9953 | 433 | 1302 | 244 | 3.7e−20 |
| Protein name | | | | Locus Name | | Acc# |
| hypothetical protein MTH1451 | | | | pir:C69060 | | C69060 |

Description

| ORF Name | NTID | AAID | NT Length | AA Length | Score | Probability |
|---|---|---|---|---|---|---|
| 29462801_f1_2 | 4732 | 9954 | 62 | 189 | | |
| Protein name | | | | Locus Name | | Acc# |

Description

NO-HIT

| ORF Name | NTID | AAID | NT Length | AA Length | Score | Probability |
|---|---|---|---|---|---|---|
| 33729675_f3_65 | 4733 | 9955 | 848 | 2547 | 313 | 8.0e−26 |
| Protein name | | | | Locus Name | | Acc# |
| putative alpha-L-arabinofuranosidase | | | | gp:ATAC011708 | | AC011708 |

Description

*Arabidopsis thaliana* chromosome III BAC T7M13 genomic sequence, complete sequence.

-continued

| ORF Name | NTID | AAID | NT Length | AA Length | Score | Probability |
|---|---|---|---|---|---|---|
| 34178305_f1_14 | 4734 | 9956 | 444 | 1335 | 146 | 5.3e−07 |

| Protein name | | | | Locus Name | | Acc# |
|---|---|---|---|---|---|---|
| | | | | sp:PORP_PSEAE | | P05695 |

Description

PORIN P PRECURSOR (OUTER MEMBRANE PROTEIN D1)

| ORF Name | NTID | AAID | NT Length | AA Length | Score | Probability |
|---|---|---|---|---|---|---|
| 34252176_c1_93 | 4735 | 9957 | 84 | 255 | 116 | 1.1e−05 |

| Protein name | | | | Locus Name | | Acc# |
|---|---|---|---|---|---|---|
| Styrene sensor kinase | | | | gp:PSSTYCATA | | AJ000330 |

Description

*Pseudomonas* sp. DNA for styrene catabolism genes.

| ORF Name | NTID | AAID | NT Length | AA Length | Score | Probability |
|---|---|---|---|---|---|---|
| 34406517_c2_127 | 4736 | 9958 | 1119 | 3360 | 826 | 7.2e−97 |

| Protein name | | | | Locus Name | | Acc# |
|---|---|---|---|---|---|---|
| receptor antigen (RagA) | | | | gp:PGI130872 | | AJ130872 |

Description

*Porphyromonas gingivalis* W50 receptor antigen (rag) locus encoding a major immunodominant 55 kDa antigen.

| ORF Name | NTID | AAID | NT Length | AA Length | Score | Probability |
|---|---|---|---|---|---|---|
| 34410751_f3_75 | 4737 | 9959 | 860 | 2583 | 419 | 3.1e−37 |

| Protein name | | | | Locus Name | | Acc# |
|---|---|---|---|---|---|---|
| unknown | | | | gp:AF007381 | | AF007381 |

Description

*Flavobacterium johnsoniae* gliding motility protein (gldA) gene, complete cds; and unknown genes.

| ORF Name | NTID | AAID | NT Length | AA Length | Score | Probability |
|---|---|---|---|---|---|---|
| 3907253_f3_66 | 4738 | 9960 | 882 | 2649 | 1066 | 1.1e−127 |

| Protein name | | | | Locus Name | | Acc# |
|---|---|---|---|---|---|---|
| hypothetical protein SCF34.07 | | | | pir:T36406 | | T36406 |

Description

| ORF Name | NTID | AAID | NT Length | AA Length | Score | Probability |
|---|---|---|---|---|---|---|
| 4176462_c2_128 | 4739 | 9961 | 272 | 819 | | |

| Protein name | | | | Locus Name | | Acc# |
|---|---|---|---|---|---|---|

Description

NO-HIT

-continued

| ORF Name | NTID | AAID | NT Length | AA Length | Score | Probability |
|---|---|---|---|---|---|---|
| 424193_f3_71 | 4740 | 9962 | 354 | 1065 | 697 | 1.2e−68 |

| Protein name | Locus Name | Acc# |
|---|---|---|
| | sp:RF2_ECOLI | |

Description

PEPTIDE CHAIN RELEASE FACTOR 2 (RF-2)

| ORF Name | NTID | AAID | NT Length | AA Length | Score | Probability |
|---|---|---|---|---|---|---|
| 4330312_c1_98 | 4741 | 9963 | 306 | 921 | 160 | 8.0e−13 |

| Protein name | Locus Name | Acc# |
|---|---|---|
| hypothetical protein | pir:T33724 | T33724 |

Description

| ORF Name | NTID | AAID | NT Length | AA Length | Score | Probability |
|---|---|---|---|---|---|---|
| 4689392_f1_1 | 4742 | 9964 | 135 | 408 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 5345192_c1_99 | 4743 | 9965 | 514 | 1545 | 705 | 1.7e−69 |

| Protein name | Locus Name | Acc# |
|---|---|---|
| | sp:HEXA_PORGI | P49008 |

Description (BETA-NAHASE)

| ORF Name | NTID | AAID | NT Length | AA Length | Score | Probability |
|---|---|---|---|---|---|---|
| 587787_c2_131 | 4744 | 9966 | 404 | 1215 | 400 | 3.6e−37 |

| Protein name | Locus Name | Acc# |
|---|---|---|
| unsaturated glucuronyl hydrolase | gp:AB019619 | AB019619 |

Description

*Bacillus* sp. GL1 genes for orf and unsaturated glucuronylhydrolase, complete cds.

| ORF Name | NTID | AAID | NT Length | AA Length | Score | Probability |
|---|---|---|---|---|---|---|
| 593950_c1_94 | 4745 | 9967 | 474 | 1425 | 451 | 2.6e−42 |

| Protein name | Locus Name | Acc# |
|---|---|---|
| adenylate cyclase | gp:D89625 | D89625 |

Description

*Anabaena* sp. cyaC gene for adenylate cyclase, complete cds.

-continued

| ORF Name | NTID | AAID | NT Length | AA Length | Score | Probability |
|---|---|---|---|---|---|---|
| 6812837_c3_186 | 4746 | 9968 | 370 | 1113 | 269 | 2.7e−23 |

| Protein name | | | Locus Name | | | Acc# |
|---|---|---|---|---|---|---|
| probable succinyl-diaminopimelate desuccinylase | | | pir:H70608 | | | H70608 |

Description

| ORF Name | NTID | AAID | NT Length | AA Length | Score | Probability |
|---|---|---|---|---|---|---|
| 10969703_f2_10 | 4747 | 9969 | 170 | 513 | | |

| Protein name | | | Locus Name | | | Acc# |

Description

NO-HIT

| ORF Name | NTID | AAID | NT Length | AA Length | Score | Probability |
|---|---|---|---|---|---|---|
| 13765751_f2_15 | 4748 | 9970 | 299 | 897 | 143 | 3.3e−07 |

| Protein name | | | Locus Name | | | Acc# |
|---|---|---|---|---|---|---|
| cytochrome b | | | gp:GPA249395 | | | AJ249395 |

Description

*Globodera pallida* mitochondrial COII, ND4, COIII, ND6, ND1, ND3 and cytb genes.

| ORF Name | NTID | AAID | NT Length | AA Length | Score | Probability |
|---|---|---|---|---|---|---|
| 13838463_f2_11 | 4749 | 9971 | 69 | 210 | | |

| Protein name | | | Locus Name | | | Acc# |

Description

NO-HIT

| ORF Name | NTID | AAID | NT Length | AA Length | Score | Probability |
|---|---|---|---|---|---|---|
| 15709788_f3_17 | 4750 | 9972 | 405 | 1218 | | |

| Protein name | | | Locus Name | | | Acc# |

Description

NO-HIT

| ORF Name | NTID | AAID | NT Length | AA Length | Score | Probability |
|---|---|---|---|---|---|---|
| 21646915_f2_8 | 4751 | 9973 | 246 | 741 | | |

| Protein name | | | Locus Name | | | Acc# |

Description

NO-HIT

-continued

| ORF Name | NTID | AAID | NT Length | AA Length | Score | Probability |
|---|---|---|---|---|---|---|
| 22848775_c1_23 | 4752 | 9974 | 199 | 600 | 92 | 0.00035 |

| Protein name | | | | Locus Name | | Acc# |
|---|---|---|---|---|---|---|
| | | | | sp:DNU4_RHORU | | P15017 |

Description

PROBABLE TRANSCRIPTIONAL REGULATOR IN ATPASE CF (0) REGION (URF4)

| ORF Name | NTID | AAID | NT Length | AA Length | Score | Probability |
|---|---|---|---|---|---|---|
| 23444088_c1_24 | 4753 | 9975 | 85 | 258 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 25834567_f1_1 | 4754 | 9976 | 244 | 735 | 75 | 0.039 |

| Protein name | | | | Locus Name | | Acc# |
|---|---|---|---|---|---|---|
| | | | | gp:MUSIGKBJ | | M13606 |

Description

Mouse Ig active kappa-chain VJ2 mRNA from HP22.134.

| ORF Name | NTID | AAID | NT Length | AA Length | Score | Probability |
|---|---|---|---|---|---|---|
| 29859506_f2_7 | 4755 | 9977 | 183 | 552 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 34570927_f1_2 | 4756 | 9978 | 329 | 990 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 36142837_c3_40 | 4757 | 9979 | 65 | 198 | 78 | 0.021 |

| Protein name | | | | Locus Name | | Acc# |
|---|---|---|---|---|---|---|
| hypothetical protein C17F3.3 | | | | pir:T32879 | | T32879 |

Description

-continued

| ORF Name | NTID | AAID | NT Length | AA Length | Score | Probability |
|---|---|---|---|---|---|---|
| 4162818_f2_14 | 4758 | 9980 | 133 | 402 | 72 | 0.021 |

| Protein name | Locus Name | Acc# |
|---|---|---|
| conserved hypothetical protein BBI40 | pir:G70244 | G70244 |

Description

| ORF Name | NTID | AAID | NT Length | AA Length | Score | Probability |
|---|---|---|---|---|---|---|
| 5859640_f2_9 | 4759 | 9981 | 422 | 1269 | 88 | 0.0055 |

| Protein name | Locus Name | Acc# |
|---|---|---|
| unknown | gp:AF033858 | AF033858 |

Description

*Pediococcus pentosaceus* strain ATCC43200 plasmid pMD136, complete plasmid sequence.

| ORF Name | NTID | AAID | NT Length | AA Length | Score | Probability |
|---|---|---|---|---|---|---|
| 11769375_c2_42 | 4760 | 9982 | 681 | 2046 | 240 | 4.1e−25 |

| Protein name | Locus Name | Acc# |
|---|---|---|
| receptor antigen (RagA) | gp:PGI130872 | AJ130872 |

Description

*Porphyromonas gingivalis* W50 receptor antigen (rag) locus encoding a major immunodominant 55 kDa antigen.

| ORF Name | NTID | AAID | NT Length | AA Length | Score | Probability |
|---|---|---|---|---|---|---|
| 16579388_c3_46 | 4761 | 9983 | 190 | 573 | 401 | 2.8e−37 |

| Protein name | Locus Name | Acc# |
|---|---|---|
|  | sp:Y4PL_RHISN | P55617 |

Description

PUTATIVE INSERTION SEQUENCE ATP-BINDING PROTEIN Y4PL

| ORF Name | NTID | AAID | NT Length | AA Length | Score | Probability |
|---|---|---|---|---|---|---|
| 20265_c1_37 | 4762 | 9984 | 89 | 267 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 32501380_f3_28 | 4763 | 9985 | 130 | 393 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 34181512_c2_38 | 4764 | 9986 | 207 | 624 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 36429763_c1_34 | 4765 | 9987 | 79 | 240 | 66 | 0.011 |
| Protein name | | | Locus Name | | | Acc# |
| | | | gp:ATAC011020 | | | AC011020 |
| Description | | | | | | |

*Arabidopsis thaliana* chromosome I BAC F12B7 genomic sequence, complete sequence.

| ORF Name | NTID | AAID | NT Length | AA Length | Score | Probability |
|---|---|---|---|---|---|---|
| 4098562_f1_4 | 4766 | 9988 | 92 | 279 | 77 | 0.015 |
| Protein name | | | Locus Name | | | Acc# |
| probable sigK protein | | | pir:F70830 | | | F70830 |
| Description | | | | | | |

| ORF Name | NTID | AAID | NT Length | AA Length | Score | Probability |
|---|---|---|---|---|---|---|
| 5276442_c3_47 | 4767 | 9989 | 156 | 471 | | |
| Protein name | | | Locus Name | | | Acc# |
| Description | | | | | | |

NO-HIT

| ORF Name | NTID | AAID | NT Length | AA Length | Score | Probability |
|---|---|---|---|---|---|---|
| 85151_c2_41 | 4768 | 9990 | 299 | 900 | 436 | 7.4e−40 |
| Protein name | | | Locus Name | | | Acc# |
| 115K outer membrane protein precursor:SusC protein | | | pir:JC6027 | | | JC6027 |
| Description | | | | | | |

| ORF Name | NTID | AAID | NT Length | AA Length | Score | Probability |
|---|---|---|---|---|---|---|
| 14885458_f2_3 | 4769 | 9991 | 600 | 1803 | 563 | 1.9e−54 |
| Protein name | | | Locus Name | | | Acc# |
| | | | sp:BGAL_THETU | | | P26257 |
| Description | | | | | | |

BETA-GALACTOSIDASE, (LACTASE)

-continued

| ORF Name | NTID | AAID | NT Length | AA Length | Score | Probability |
|---|---|---|---|---|---|---|
| 10837887_c3_30 | 4770 | 9992 | 374 | 1125 | 1011 | 6.5e−102 |

| Protein name | Locus Name | Acc# |
|---|---|---|
| CDP-glucose-4,6-dehydratase | pir:D47070 | D47070 |

Description

| ORF Name | NTID | AAID | NT Length | AA Length | Score | Probability |
|---|---|---|---|---|---|---|
| 14640675_c3_31 | 4771 | 9993 | 298 | 894 | 950 | 1.9e−95 |

| Protein name | Locus Name | Acc# |
|---|---|---|
| CDP-tyvelose epimerase | gp:YPU29691 | U29691 |

Description

*Yersinia pseudotuberculosis* group
IVACDP-4-keto-6-deoxy-D-glucose-3-dehydrase (ddhC) gene, partial
cds, CDP-paratose synthetase (prt) and CDP-tyvelose epimerase (tyv) genes,
complete cds, and putative O antigen export protein (wzx) gene, partial cds.

| ORF Name | NTID | AAID | NT Length | AA Length | Score | Probability |
|---|---|---|---|---|---|---|
| 20312800_c1_22 | 4772 | 9994 | 306 | 921 | 225 | 1.3e−18 |

| Protein name | Locus Name | Acc# |
|---|---|---|
| dTDP-glucose 4,6-dehydratase | pir:H69105 | H69105 |

Description

| ORF Name | NTID | AAID | NT Length | AA Length | Score | Probability |
|---|---|---|---|---|---|---|
| 20507213_c3_29 | 4773 | 9995 | 86 | 261 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24880278_f2_12 | 4774 | 9996 | 81 | 246 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 391531_f1_5 | 4775 | 9997 | 69 | 210 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 46378150_c1_20 | 4776 | 9998 | 285 | 858 | 475 | 4.1e−45 |

| Protein name | Locus Name | Acc# |
|---|---|---|
| glucose−1-phosphate cytidylyltransferase, | pir:C47070 | C47070 |

Description

| ORF Name | NTID | AAID | NT Length | AA Length | Score | Probability |
|---|---|---|---|---|---|---|
| 13070915_c1_11 | 4777 | 9999 | 845 | 2538 | 679 | 3.4e−66 |

| Protein name | Locus Name | Acc# |
|---|---|---|
| 115K outer membrane protein precursor:SusC protein | pir:JC6027 | JC6027 |

Description

| ORF Name | NTID | AAID | NT Length | AA Length | Score | Probability |
|---|---|---|---|---|---|---|
| 4400952_c3_13 | 4778 | 10000 | 264 | 795 | 445 | 8.0e−41 |

| Protein name | Locus Name | Acc# |
|---|---|---|
| 115K outer membrane protein precursor:SusC protein | pir:JC6027 | JC6027 |

Description

| ORF Name | NTID | AAID | NT Length | AA Length | Score | Probability |
|---|---|---|---|---|---|---|
| 10635936_f1_15 | 4779 | 10001 | 419 | 1260 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 11829203_c1_283 | 4780 | 10002 | 270 | 813 | 132 | 2.5e−08 |

| Protein name | Locus Name | Acc# |
|---|---|---|
| | gp:D86934 | D86934 |

Description

*Staphylococcus aureus* genes, mec region, partial and complete cds.

| ORF Name | NTID | AAID | NT Length | AA Length | Score | Probability |
|---|---|---|---|---|---|---|
| 12298437_c2_380 | 4781 | 10003 | 321 | 966 | 252 | 1.7e−21 |

| Protein name | Locus Name | Acc# |
|---|---|---|
| | sp:YYAM_BACSU | P37511 |

Description

HYPOTHETICAL 32.9 KD PROTEIN IN TETB-EXOA INTERGENIC REGION

-continued

| ORF Name | NTID | AAID | NT Length | AA Length | Score | Probability |
|---|---|---|---|---|---|---|
| 13865675_c1_304 | 4782 | 10004 | 312 | 939 | 964 | 6.2e−97 |

| Protein name | Locus Name | Acc# |
|---|---|---|
| homoserine O-succinyltransferase | pir:C72324 | C72324 |

Description

| ORF Name | NTID | AAID | NT Length | AA Length | Score | Probability |
|---|---|---|---|---|---|---|
| 13868955_f3_200 | 4783 | 10005 | 111 | 336 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 1407956_c3_406 | 4784 | 10006 | 147 | 444 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 14640762_f2_103 | 4785 | 10007 | 86 | 261 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 14657700_c1_301 | 4786 | 10008 | 642 | 1929 | 155 | 2.3e−10 |

| Protein name | Locus Name | Acc# |
|---|---|---|
| conserved hypothetical protein | pir:E75439 | E75439 |

Description

| ORF Name | NTID | AAID | NT Length | AA Length | Score | Probability |
|---|---|---|---|---|---|---|
| 15703215_f3_266 | 4787 | 10009 | 61 | 186 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 159562_f1_41 | 4788 | 10010 | 74 | 225 | 209 | 6.3e−17 |

| Protein name | Locus Name | Acc# |
|---|---|---|
| | sp:FER_BUTME | P14073 |

Description

FERREDOXIN

| ORF Name | NTID | AAID | NT Length | AA Length | Score | Probability |
|---|---|---|---|---|---|---|
| 16615912_f3_261 | 4789 | 10011 | 67 | 204 | | |
| Protein name | | | | Locus Name | | Acc# |
| Description | | | | | | |

NO-HIT

| ORF Name | NTID | AAID | NT Length | AA Length | Score | Probability |
|---|---|---|---|---|---|---|
| 16832885_c2_358 | 4790 | 10012 | 431 | 1296 | 1723 | 2.3e−177 |
| Protein name | | | | Locus Name | | Acc# |
| hypothetical protein | | | | pir:JQ1020 | | JQ1020 |
| Description | | | | | | |

| ORF Name | NTID | AAID | NT Length | AA Length | Score | Probability |
|---|---|---|---|---|---|---|
| 19689075_c1_334 | 4791 | 10013 | 867 | 2604 | 453 | 1.5e−39 |
| Protein name | | | | Locus Name | | Acc# |
| hypothetical protein F10M10.30 | | | | pir:T04772 | | T04772 |
| Description | | | | | | |

| ORF Name | NTID | AAID | NT Length | AA Length | Score | Probability |
|---|---|---|---|---|---|---|
| 19710881_f1_89 | 4792 | 10014 | 216 | 651 | 79 | 0.012 |
| Protein name | | | | Locus Name | | Acc# |
| | | | | gp:TCU64729 | | U64729 |
| Description | | | | | | |

*Toxocara canis* TcH SLdT.460 mRNA, complete cds.

| ORF Name | NTID | AAID | NT Length | AA Length | Score | Probability |
|---|---|---|---|---|---|---|
| 19770066_c2_351 | 4793 | 10015 | 389 | 1170 | 652 | 7.1e−64 |
| Protein name | | | | Locus Name | | Acc# |
| potassium-dependent ATPase subunit D' | | | | gp:AF213466 | | AF213466 |
| Description | | | | | | |

*Anabaena* sp. L-31 kdp operon, complete sequence.

| ORF Name | NTID | AAID | NT Length | AA Length | Score | Probability |
|---|---|---|---|---|---|---|
| 20119033_f1_10 | 4794 | 10016 | 191 | 576 | 144 | 4.1e−20 |
| Protein name | | | | Locus Name | | Acc# |
| | | | | sp:PNUC_SALTY | | P24520 |
| Description | | | | | | |

PNUC PROTEIN

-continued

| ORF Name | NTID | AAID | NT Length | AA Length | Score | Probability |
|---|---|---|---|---|---|---|
| 204687_c2_352 | 4795 | 10017 | 64 | 195 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 22298176_f1_91 | 4796 | 10018 | 62 | 189 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 22306532_f2_123 | 4797 | 10019 | 530 | 1593 | 836 | 6.0e−87 |

| Protein name | Locus Name | Acc# |
|---|---|---|
| hypothetical protein | pir:S76076 | S76076 |

Description

| ORF Name | NTID | AAID | NT Length | AA Length | Score | Probability |
|---|---|---|---|---|---|---|
| 22860128_c3_415 | 4798 | 10020 | 83 | 252 | 64 | 0.031 |

| Protein name | Locus Name | Acc# |
|---|---|---|
| | sp:SPRC_XENLA | P36378 |

Description (OSTEONECTIN) (ON) (BASEMENT MEMBRANE PROTEIN BM-40)

| ORF Name | NTID | AAID | NT Length | AA Length | Score | Probability |
|---|---|---|---|---|---|---|
| 22860636_c3_431 | 4799 | 10021 | 415 | 1248 | 862 | 4.0e−86 |

| Protein name | Locus Name | Acc# |
|---|---|---|
| probable phosphonopyruvate decarboxylase, 1 | pir:D69154 | D69154 |

Description

| ORF Name | NTID | AAID | NT Length | AA Length | Score | Probability |
|---|---|---|---|---|---|---|
| 23626711_c3_404 | 4800 | 10022 | 687 | 2064 | 2134 | 6.4e−221 |

| Protein name | Locus Name | Acc# |
|---|---|---|
| potassium-transporting ATPase, B subunit | pir:A75627 | A75627 |

Description

| ORF Name | NTID | AAID | NT Length | AA Length | Score | Probability |
|---|---|---|---|---|---|---|
| 23632875_c3_403 | 4801 | 10023 | 573 | 1722 | 1228 | 6.5e−125 |

| Protein name | Locus Name | Acc# |
|---|---|---|
| potassium-translocating ATPase A chain | gp:AAC243194 | AF243194 |

Description

*Alicyclobacillus acidocaldarius* kdpA gene.

| ORF Name | NTID | AAID | NT Length | AA Length | Score | Probability |
|---|---|---|---|---|---|---|
| 23960013_c3_418 | 4802 | 10024 | 954 | 2865 | 935 | 2.4e−115 |

| Protein name | Locus Name | Acc# |
|---|---|---|
| putative secreted protein | gp:SCF41 | AL117387 |

Description

*Streptomyces coelicolor* cosmid F41.

| ORF Name | NTID | AAID | NT Length | AA Length | Score | Probability |
|---|---|---|---|---|---|---|
| 24007761_c1_297 | 4803 | 10025 | 986 | 2961 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24322063_c2_362 | 4804 | 10026 | 333 | 1002 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24322712_c1_295 | 4805 | 10027 | 1152 | 3459 | 754 | 5.3e−132 |

| Protein name | Locus Name | Acc# |
|---|---|---|
| 115 K outer membrane protein precursor:SusC protein | pir:JC6027 | JC6027 |

Description

| ORF Name | NTID | AAID | NT Length | AA Length | Score | Probability |
|---|---|---|---|---|---|---|
| 24334692_f3_240 | 4806 | 10028 | 222 | 669 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 24640915_f2_106 | 4807 | 10029 | 209 | 630 | 297 | 3.0e−26 |

| Protein name | Locus Name | Acc# |
|---|---|---|
| hypothetical protein jhp1211 | pir:C71832 | C71832 |

Description

| ORF Name | NTID | AAID | NT Length | AA Length | Score | Probability |
|---|---|---|---|---|---|---|
| 24642818_f2_187 | 4808 | 10030 | 118 | 357 | 98 | 3.6e−05 |

| Protein name | Locus Name | Acc# |
|---|---|---|
| | gp:SSK3MECA1 | Y13052 |

Description

*S. sciuri* mecA1 gene, strain K3 (MM2).

| ORF Name | NTID | AAID | NT Length | AA Length | Score | Probability |
|---|---|---|---|---|---|---|
| 24804691_c1_298 | 4809 | 10031 | 257 | 774 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24820326_c1_322 | 4810 | 10032 | 290 | 873 | 607 | 1.2e−58 |

| Protein name | Locus Name | Acc# |
|---|---|---|
| aspartate kinase, / homoserine dehydrogenase, T16H5.70:protein T16H5.70:protein T16H5.70 | pir:T04752 | T04752 |

Description

| ORF Name | NTID | AAID | NT Length | AA Length | Score | Probability |
|---|---|---|---|---|---|---|
| 24866706_c1_293 | 4811 | 10033 | 447 | 1344 | 423 | 1.5e−39 |

| Protein name | Locus Name | Acc# |
|---|---|---|
| VicK protein | gp:EFA012050 | AJ012050 |

Description

*Enterococcus faecalis* vic operon and flanking genes.

| ORF Name | NTID | AAID | NT Length | AA Length | Score | Probability |
|---|---|---|---|---|---|---|
| 25277_c3_411 | 4812 | 10034 | 798 | 2397 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 2557712_c1_333 | 4813 | 10035 | 208 | 627 | 167 | 1.8e−12 |

| Protein name | | Locus Name | Acc# |
|---|---|---|---|
| hypothetical protein sll0687 | | pir:S74416 | S74416 |

Description

| ORF Name | NTID | AAID | NT Length | AA Length | Score | Probability |
|---|---|---|---|---|---|---|
| 25835942_c2_385 | 4814 | 10036 | 336 | 1011 | 131 | 7.6e−06 |

| Protein name | | Locus Name | Acc# |
|---|---|---|---|
| | | sp:FECR_ECOLI | P23485 |

Description

FECR PROTEIN

| ORF Name | NTID | AAID | NT Length | AA Length | Score | Probability |
|---|---|---|---|---|---|---|
| 25945887_c3_417 | 4815 | 10037 | 401 | 1206 | 983 | 6.0e−99 |

| Protein name | | Locus Name | Acc# |
|---|---|---|---|
| | | sp:AAT_BACST | Q59228 |

Description

ASPARTATE AMINOTRANSFERASE, (TRANSAMINASE A) (ASPAT)

| ORF Name | NTID | AAID | NT Length | AA Length | Score | Probability |
|---|---|---|---|---|---|---|
| 29720927_c1_321 | 4816 | 10038 | 527 | 1584 | 788 | 2.8e−78 |

| Protein name | | Locus Name | Acc# |
|---|---|---|---|
| | | sp:AK_METJA | Q57991 |

Description

PROBABLE ASPARTOKINASE, (ASPARTATE KINASE)

| ORF Name | NTID | AAID | NT Length | AA Length | Score | Probability |
|---|---|---|---|---|---|---|
| 3001402_f3_222 | 4817 | 10039 | 212 | 639 | 115 | 1.9e−06 |

| Protein name | | Locus Name | Acc# |
|---|---|---|---|
| | | gp:SCU40158 | U40158 |

Description

*Staphylococcus carnosus* response regulator-like protein (orfx) gene, partial cds.

| ORF Name | NTID | AAID | NT Length | AA Length | Score | Probability |
|---|---|---|---|---|---|---|
| 30656255_c1_294 | 4818 | 10040 | 193 | 582 | 316 | 2.9e−28 |

| Protein name | | Locus Name | Acc# |
|---|---|---|---|
| RNA polymerase sigma factor SigZ-like protein | | gp:AF137263 | AF137263 |

Description

*Bacteroides thetaiotaomicron* 30S ribosomal protein S16-like protein, fucose gene cluster, and RNA polymerase sigma factor SigZ-like protein (sigZ) genes, complete cds.

-continued

| ORF Name | NTID | AAID | NT Length | AA Length | Score | Probability |
|---|---|---|---|---|---|---|
| 30661682_f2_185 | 4819 | 10041 | 486 | 1461 | 379 | 8.2e−35 |

| Protein name | Locus Name | Acc# |
|---|---|---|
| putative aspartate kinase | gp:ATAC010797 | AC010797 |

Description

*Arabidopsis thaliana* chromosome III BAC F28J7 genomic sequence, complete sequence.

| ORF Name | NTID | AAID | NT Length | AA Length | Score | Probability |
|---|---|---|---|---|---|---|
| 30720407_c2_349 | 4820 | 10042 | 234 | 705 | 359 | 8.0e−33 |

| Protein name | Locus Name | Acc# |
|---|---|---|
| | sp:ATKC_MYCTU | P96369 |

Description

C CHAIN)

| ORF Name | NTID | AAID | NT Length | AA Length | Score | Probability |
|---|---|---|---|---|---|---|
| 3125011_f3_223 | 4821 | 10043 | 811 | 2436 | 253 | 1.1e−29 |

| Protein name | Locus Name | Acc# |
|---|---|---|
| SftP | gp:AF126201 | AF126201 |

Description

*Pseudomonas putida* strain S-313 sulfate ester desulfurization genelocus, complete sequence.

| ORF Name | NTID | AAID | NT Length | AA Length | Score | Probability |
|---|---|---|---|---|---|---|
| 3132040_f2_120 | 4822 | 10044 | 385 | 1158 | 728 | 6.3e−72 |

| Protein name | Locus Name | Acc# |
|---|---|---|
| | sp:ASG1_ECOLI | P18840 |

Description (L-ASNASE I)

| ORF Name | NTID | AAID | NT Length | AA Length | Score | Probability |
|---|---|---|---|---|---|---|
| 32188_f2_186 | 4823 | 10045 | 836 | 2511 | 971 | 1.1e−97 |

| Protein name | Locus Name | Acc# |
|---|---|---|
| NADH oxidase (noxA-3) homolog | pir:H69299 | H69299 |

Description

| ORF Name | NTID | AAID | NT Length | AA Length | Score | Probability |
|---|---|---|---|---|---|---|
| 33486502_c3_408 | 4824 | 10046 | 340 | 1023 | 114 | 0.00068 |

| Protein name | Locus Name | Acc# |
|---|---|---|
| transmembrane sensor | gp:AF051691 | AF051691 |

Description

*Pseudomonas aeruginosa* stress factor A (psfA), ECF sigma factor (fiuI), transmembrane sensor (fiuR), and hydroxamate-typeferrisiderophore receptor (fiuA) genes, complete cds.

-continued

| ORF Name | NTID | AAID | NT Length | AA Length | Score | Probability |
|---|---|---|---|---|---|---|
| 35245635_c3_410 | 4825 | 10047 | 511 | 1536 | 129 | 2.4e−09 |

| Protein name | | | | Locus Name | | Acc# |
|---|---|---|---|---|---|---|
| unknown | | | | gp:U96771 | | U96771 |

Description

*Prevotella bryantii* putative polygalacturonase, B-1,4-endoglucanase, and mannanase genes, complete cds; and unknown genes.

| ORF Name | NTID | AAID | NT Length | AA Length | Score | Probability |
|---|---|---|---|---|---|---|
| 36375662_c1_323 | 4826 | 10048 | 451 | 1356 | 939 | 2.8e−94 |

| Protein name | | | | Locus Name | | Acc# |
|---|---|---|---|---|---|---|
| | | | | sp:THRC_HAEIN | | P44503 |

Description

THREONINE SYNTHASE,

| ORF Name | NTID | AAID | NT Length | AA Length | Score | Probability |
|---|---|---|---|---|---|---|
| 3912663_f2_122 | 4827 | 10049 | 462 | 1389 | 1242 | 2.1e−126 |

| Protein name | | | | Locus Name | | Acc# |
|---|---|---|---|---|---|---|
| | | | | sp:RADA_BACSU | | P37572 |

Description

DNA REPAIR PROTEIN RADA HOMOLOG (DNA REPAIR PROTEIN SMS HOMOLOG)

| ORF Name | NTID | AAID | NT Length | AA Length | Score | Probability |
|---|---|---|---|---|---|---|
| 3939387_c3_437 | 4828 | 10050 | 305 | 918 | 551 | 3.6e−53 |

| Protein name | | | | Locus Name | | Acc# |
|---|---|---|---|---|---|---|
| putative 30.6 kDa protein | | | | gp:AF037440 | | AF037440 |

Description

*Edwardsiella ictaluri* D-3 phosphoglycerate dehydrogenase (serA) gene, partial cds; ribose-5-phosphate isomerase (rpiA), inhibitor of chromosome initiation (iciA), putative 26 kDa protein (yggE), putative 30.6 kDa protein (yggB), and fructose 1,6-bisphosphatealdolase (fda) genes, complete cds; and phosphoglycerate kinase (pgk) gene, partial cds.

| ORF Name | NTID | AAID | NT Length | AA Length | Score | Probability |
|---|---|---|---|---|---|---|
| 3942202_c2_339 | 4829 | 10051 | 489 | 1470 | 267 | 2.9e−38 |

| Protein name | | | | Locus Name | | Acc# |
|---|---|---|---|---|---|---|
| | | | | sp:ARSF_HUMAN | | P54793 |

Description

ARYLSULFATASE F PRECURSOR, (ASF)

-continued

| ORF Name | NTID | AAID | NT Length | AA Length | Score | Probability |
|---|---|---|---|---|---|---|
| 4078255_c1_281 | 4830 | 10052 | 494 | 1485 | 496 | 2.4e−47 |

| Protein name | Locus Name | Acc# |
|---|---|---|
| tripeptidyl aminopeptidase | gp:STMTPAP | L46588 |

Description

*Streptomyces lividans* tripeptidyl aminopeptidase gene, complete cds.

| ORF Name | NTID | AAID | NT Length | AA Length | Score | Probability |
|---|---|---|---|---|---|---|
| 4103410_c3_390 | 4831 | 10053 | 657 | 1974 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 4414086_c1_289 | 4832 | 10054 | 467 | 1404 | 859 | 8.3e−86 |

| Protein name | Locus Name | Acc# |
|---|---|---|
| response regulatory protein (rrp-2) homolog | pir:B70195 | B70195 |

Description

| ORF Name | NTID | AAID | NT Length | AA Length | Score | Probability |
|---|---|---|---|---|---|---|
| 4694087_c2_359 | 4833 | 10055 | 415 | 1248 | 1213 | 2.5e−123 |

| Protein name | Locus Name | Acc# |
|---|---|---|
| GTP cyclohydrolase II, / 3, 4-dihydroxy-2-butanone 4-phosphate synthase, ribA:ribA protein | pir:C70331 | C70331 |

Description

| ORF Name | NTID | AAID | NT Length | AA Length | Score | Probability |
|---|---|---|---|---|---|---|
| 4881507_c3_439 | 4834 | 10056 | 960 | 2880 | 929 | 3.2e−93 |

| Protein name | Locus Name | Acc# |
|---|---|---|
| 115 K outer membrane protein precursor:SusC protein | pir:JC6027 | JC6027 |

Description

| ORF Name | NTID | AAID | NT Length | AA Length | Score | Probability |
|---|---|---|---|---|---|---|
| 5173192_c3_419 | 4835 | 10057 | 611 | 1836 | 1321 | 9.1e−135 |

| Protein name | Locus Name | Acc# |
|---|---|---|
| | sp:YDCP_ECOLI | |

Description

PUTATIVE PROTEASE YDCP PRECURSOR,

| ORF Name | NTID | AAID | NT Length | AA Length | Score | Probability |
|---|---|---|---|---|---|---|
| 5259838_f1_9 | 4836 | 10058 | 707 | 2124 | 123 | 3.9e−08 |

| Protein name | Locus Name | Acc# |
|---|---|---|
| heme receptor | gp:VIBHUTA | L27149 |

Description

Vibrio cholerae heme receptor (hutA) gene, complete cds.

| ORF Name | NTID | AAID | NT Length | AA Length | Score | Probability |
|---|---|---|---|---|---|---|
| 5272312_c2_350 | 4837 | 10059 | 120 | 363 | 88 | 0.0018 |

| Protein name | Locus Name | Acc# |
|---|---|---|
| hypothetical protein Rv0587 | pir:F70907 | F70907 |

Description

| ORF Name | NTID | AAID | NT Length | AA Length | Score | Probability |
|---|---|---|---|---|---|---|
| 5275425_f2_134 | 4838 | 10060 | 81 | 246 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 5290912_f3_221 | 4839 | 10061 | 124 | 375 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 5880050_c3_414 | 4840 | 10062 | 111 | 336 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 6366576_f1_13 | 4841 | 10063 | 65 | 198 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 6367805_f3_272 | 4842 | 10064 | 212 | 639 | 96 | 0.010 |

| Protein name | Locus Name | Acc# |
|---|---|---|
| outer membrane protein 21, Omp21 | gp:CAAJ1918 | AJ001918 |

Description

*Comamonas acidovorans* omp21 gene.

| ORF Name | NTID | AAID | NT Length | AA Length | Score | Probability |
|---|---|---|---|---|---|---|
| 6417192_c3_420 | 4843 | 10065 | 72 | 219 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 13757180_f1_23 | 4844 | 10066 | 60 | 183 | 70 | 0.033 |

| Protein name | Locus Name | Acc# |
|---|---|---|
| hypothetical protein APE1598 | pir:A72539 | A72539 |

Description

| ORF Name | NTID | AAID | NT Length | AA Length | Score | Probability |
|---|---|---|---|---|---|---|
| 16535830_f3_59 | 4845 | 10067 | 91 | 276 | 69 | 0.042 |

| Protein name | Locus Name | Acc# |
|---|---|---|
| hypothetical protein ORF87 | pir:T30436 | T30436 |

Description

| ORF Name | NTID | AAID | NT Length | AA Length | Score | Probability |
|---|---|---|---|---|---|---|
| 16603402_c2_78 | 4846 | 10068 | 337 | 1014 | 943 | 1.0e−94 |

| Protein name | Locus Name | Acc# |
|---|---|---|
| WbnF | gp:AF172324 | AF172324 |

Description

*Escherichia coli* GalF (galF) gene, partial cds; O-antigen repeat unit transporter Wzx (wzx), WbnA (wbnA), O-antigen polymerase Wzy (wzy), WbnB (wbnB), WbnC (wbnC), WbnD (wbnD), WbnE (wbnE), UDP-Glc-4-epimerase GalE (galE), 6-phosphogluconate dehydrogenaseGnd (gnd), UDP-Glc-6-dehydrogenase Ugd (ugd), and WbnF (wbnF) genes, complete cds; and chain length determinant

| ORF Name | NTID | AAID | NT Length | AA Length | Score | Probability |
|---|---|---|---|---|---|---|
| 21678500_c1_64 | 4847 | 10069 | 474 | 1425 | 1297 | 3.2e−132 |

| Protein name | Locus Name | Acc# |
|---|---|---|
| 3-isopropylmalate dehydratase, large chain | pir:T29083 | T29083 |

Description

-continued

| ORF Name | NTID | AAID | NT Length | AA Length | Score | Probability |
|---|---|---|---|---|---|---|
| 23631627_c2_74 | 4848 | 10070 | 201 | 606 | 462 | 9.7e−44 |

| Protein name | Locus Name | Acc# |
|---|---|---|
| | sp:LEUD_HAEIN | P44438 |

Description (ISOPROPYLMALATE ISOMERASE) (ALPHA-IPM ISOMERASE)

| ORF Name | NTID | AAID | NT Length | AA Length | Score | Probability |
|---|---|---|---|---|---|---|
| 23634425_c1_66 | 4849 | 10071 | 357 | 1074 | 1836 | 2.4e−189 |

| Protein name | Locus Name | Acc# |
|---|---|---|
| | sp:LEU3_BACFR | P54354 |

Description (IMDH) (3-IPM-DH)

| ORF Name | NTID | AAID | NT Length | AA Length | Score | Probability |
|---|---|---|---|---|---|---|
| 24270450_c1_67 | 4850 | 10072 | 528 | 1587 | 216 | 2.0e−14 |

| Protein name | Locus Name | Acc# |
|---|---|---|
| unknown | gp:AF036677 | AF036677 |

Description

*Salmonella typhimurium* putative operon regulated by PmrAB, necessary for 4-aminoarabinose lipid A modification and polymyxinresistance, PmrG (pmrG) gene, partial cds; PmrF (pmrF) gene and 6orfs, complete cds; and PmrD (pmrD) gene, partial cds.

| ORF Name | NTID | AAID | NT Length | AA Length | Score | Probability |
|---|---|---|---|---|---|---|
| 24335131_f1_25 | 4851 | 10073 | 63 | 192 | 106 | 5.1e−06 |

| Protein name | Locus Name | Acc# |
|---|---|---|
| hypothetical protein PH0219 | pir:A71245 | A71245 |

Description

| ORF Name | NTID | AAID | NT Length | AA Length | Score | Probability |
|---|---|---|---|---|---|---|
| 24337765_c1_68 | 4852 | 10074 | 1032 | 3096 | 617 | 2.6e−86 |

| Protein name | Locus Name | Acc# |
|---|---|---|
| 115 K outer membrane protein precursor:SusC protein | pir:JC6027 | JC6027 |

Description

| ORF Name | NTID | AAID | NT Length | AA Length | Score | Probability |
|---|---|---|---|---|---|---|
| 282708_f2_42 | 4853 | 10075 | 60 | 183 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 34081405_c2_71 | 4854 | 10076 | 88 | 267 | 110 | 1.9e−06 |
| Protein name | | | Locus Name | | | Acc# |
| hypothetical protein PHS004 | | | pir:F71245 | | | F71245 |
| Description | | | | | | |

| ORF Name | NTID | AAID | NT Length | AA Length | Score | Probability |
|---|---|---|---|---|---|---|
| 34407837_c2_73 | 4855 | 10077 | 500 | 1503 | 1207 | 1.1e−122 |
| Protein name | | | Locus Name | | | Acc# |
| | | | sp:LEU1_HAEIN | | | P43861 |
| Description | | | | | | |
| SYNTHASE) (ALPHA-IPM SYNTHETASE) | | | | | | |

| ORF Name | NTID | AAID | NT Length | AA Length | Score | Probability |
|---|---|---|---|---|---|---|
| 4805262_c1_65 | 4856 | 10078 | 512 | 1539 | 666 | 2.3e−65 |
| Protein name | | | Locus Name | | | Acc# |
| 2-isopropylmalate synthase (leuA-1) homolog | | | pir:E69369 | | | E69369 |
| Description | | | | | | |

| ORF Name | NTID | AAID | NT Length | AA Length | Score | Probability |
|---|---|---|---|---|---|---|
| 5332506_f1_24 | 4857 | 10079 | 95 | 288 | 73 | 0.034 |
| Protein name | | | Locus Name | | | Acc# |
| hypothetical protein PH0220 | | | pir:B71245 | | | B71245 |
| Description | | | | | | |

| ORF Name | NTID | AAID | NT Length | AA Length | Score | Probability |
|---|---|---|---|---|---|---|
| 5867141_c3_83 | 4858 | 10080 | 218 | 657 | 232 | 2.0e−18 |
| Protein name | | | Locus Name | | | Acc# |
| lipid A disaccharide synthase | | | pir:B72014 | | | B72014 |
| Description | | | | | | |

| ORF Name | NTID | AAID | NT Length | AA Length | Score | Probability |
|---|---|---|---|---|---|---|
| 5901877_c2_76 | 4859 | 10081 | 269 | 810 | 366 | 1.4e−33 |
| Protein name | | | Locus Name | | | Acc# |
| dolichol-phosphate mannosyltransferase | | | pir:G70463 | | | G70463 |
| Description | | | | | | |

| ORF Name | NTID | AAID | NT Length | AA Length | Score | Probability |
|---|---|---|---|---|---|---|
| 656551_f3_46 | 4860 | 10082 | 86 | 261 | | |
| Protein name | | | Locus Name | | | Acc# |
| Description | | | | | | |
| NO-HIT | | | | | | |

-continued

| ORF Name | NTID | AAID | NT Length | AA Length | Score | Probability |
|---|---|---|---|---|---|---|
| 10164677_c2_249 | 4861 | 10083 | 154 | 465 | 170 | 1.7e−12 |

| Protein name | Locus Name | Acc# |
|---|---|---|
| proline-rich protein precursor | pir:S23737 | S23737 |

Description

| ORF Name | NTID | AAID | NT Length | AA Length | Score | Probability |
|---|---|---|---|---|---|---|
| 10241436_f1_8 | 4862 | 10084 | 142 | 429 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 12360002_c2_228 | 4863 | 10085 | 169 | 510 | 111 | 1.4e−05 |

| Protein name | Locus Name | Acc# |
|---|---|---|
| arabinogalactan-like protein | pir:S52994 | S52994 |

Description

| ORF Name | NTID | AAID | NT Length | AA Length | Score | Probability |
|---|---|---|---|---|---|---|
| 12500183_f2_42 | 4864 | 10086 | 128 | 387 | 124 | 4.4e−07 |

| Protein name | Locus Name | Acc# |
|---|---|---|
| hypothetical protein Rv3864 | pir:E70656 | E70656 |

Description

| ORF Name | NTID | AAID | NT Length | AA Length | Score | Probability |
|---|---|---|---|---|---|---|
| 125037_f1_34 | 4865 | 10087 | 687 | 2064 | 439 | 3.2e−40 |

| Protein name | Locus Name | Acc# |
|---|---|---|
| receptor antigen (RagA) | gp:PGI130872 | AJ130872 |

Description

*Porphyromonas gingivalis* W50 receptor antigen (rag) locus encoding a major immunodominant 55 kDa antigen.

| ORF Name | NTID | AAID | NT Length | AA Length | Score | Probability |
|---|---|---|---|---|---|---|
| 13000040_f3_115 | 4866 | 10088 | 332 | 999 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 13069511_f2_47 | 4867 | 10089 | 121 | 366 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 13956536_c1_183 | 4868 | 10090 | 431 | 1296 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 14587753_c2_217 | 4869 | 10091 | 325 | 978 | 270 | 4.5e−22 |

| Protein name | | | | Locus Name | | Acc# |
|---|---|---|---|---|---|---|
| | | | | sp:TRC4_ECOLI | | |

Description

DNA PRIMASE TRAC, (REPLICATION PRIMASE)

| ORF Name | NTID | AAID | NT Length | AA Length | Score | Probability |
|---|---|---|---|---|---|---|
| 14727281_f2_72 | 4870 | 10092 | 119 | 360 | 98 | 5.8e−05 |

| Protein name | | | | Locus Name | | Acc# |
|---|---|---|---|---|---|---|
| | | | | sp:DH18_ARATH | | P30185 |

Description

DEHYDRIN RAB18

| ORF Name | NTID | AAID | NT Length | AA Length | Score | Probability |
|---|---|---|---|---|---|---|
| 15032692_c1_162 | 4871 | 10093 | 220 | 663 | 101 | 0.036 |

| Protein name | | | | Locus Name | | Acc# |
|---|---|---|---|---|---|---|
| exodeoxyribonuclease V, gamma chain (recC) homolog | | | | pir:A70179 | | A70179 |

Description

| ORF Name | NTID | AAID | NT Length | AA Length | Score | Probability |
|---|---|---|---|---|---|---|
| 20260_f3_137 | 4872 | 10094 | 589 | 1770 | 89 | 0.041 |

| Protein name | | | | Locus Name | | Acc# |
|---|---|---|---|---|---|---|
| unknown | | | | gp:U96771 | | U96771 |

Description

*Prevotella bryantii* putative polygalacturonase, B-1,4-endoglucanase, and mannanase genes, complete cds; and unknown genes.

-continued

| ORF Name | NTID | AAID | NT Length | AA Length | Score | Probability |
|---|---|---|---|---|---|---|
| 20506501_c2_202 | 4873 | 10095 | 269 | 810 | 235 | 1.1e−19 |

| Protein name | Locus Name | Acc# |
|---|---|---|
| hypothetical protein b1488 | pir:C64902 | C64902 |

Description

| ORF Name | NTID | AAID | NT Length | AA Length | Score | Probability |
|---|---|---|---|---|---|---|
| 20594841_f3_117 | 4874 | 10096 | 60 | 183 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 2119013_c1_147 | 4875 | 10097 | 400 | 1203 | 115 | 1.5e−08 |

| Protein name | Locus Name | Acc# |
|---|---|---|
| hypothetical protein SC6G4.36c SC6G4.36c | pir:T35587 | T35587 |

Description

| ORF Name | NTID | AAID | NT Length | AA Length | Score | Probability |
|---|---|---|---|---|---|---|
| 21507338_f1_11 | 4876 | 10098 | 736 | 2211 | 559 | 2.3e−89 |

| Protein name | Locus Name | Acc# |
|---|---|---|
| | gp:BFU63096 | U63096 |

Description

*Bacteroides fragilis* (bctA) gene, complete cds.

| ORF Name | NTID | AAID | NT Length | AA Length | Score | Probability |
|---|---|---|---|---|---|---|
| 21578375_c1_197 | 4877 | 10099 | 776 | 2331 | 197 | 3.2e−12 |

| Protein name | Locus Name | Acc# |
|---|---|---|
| | gp:AF083424 | AF083424 |

Description

Ateline herpesvirus 3 complete genome.

| ORF Name | NTID | AAID | NT Length | AA Length | Score | Probability |
|---|---|---|---|---|---|---|
| 22548191_f2_51 | 4878 | 10100 | 177 | 534 | 122 | 5.2e−06 |

| Protein name | Locus Name | Acc# |
|---|---|---|
| hypothetical protein T15B7.3 | pir:T32250 | T32250 |

Description

-continued

| ORF Name | NTID | AAID | NT Length | AA Length | Score | Probability |
|---|---|---|---|---|---|---|
| 22906506_c3_309 | 4879 | 10101 | 882 | 2649 | 315 | 5.4e−25 |

| Protein name | Locus Name | Acc# |
|---|---|---|
| mobilization protein C | gp:AF118243 | AF118243 |

Description

*Bacteroides fragilis* mobiliation protein C (mobC) gene, complete cds.

| ORF Name | NTID | AAID | NT Length | AA Length | Score | Probability |
|---|---|---|---|---|---|---|
| 23486336_c1_146 | 4880 | 10102 | 77 | 234 | 63 | 0.0098 |

| Protein name | Locus Name | Acc# |
|---|---|---|
| R07E5.1 protein (clone R07E5) | pir:S43604 | S43604 |

Description

| ORF Name | NTID | AAID | NT Length | AA Length | Score | Probability |
|---|---|---|---|---|---|---|
| 2350306_c1_144 | 4881 | 10103 | 100 | 303 | 111 | 1.5e−06 |

| Protein name | Locus Name | Acc# |
|---|---|---|
| hypothetical protein PH0217 | pir:G71244 | G71244 |

Description

| ORF Name | NTID | AAID | NT Length | AA Length | Score | Probability |
|---|---|---|---|---|---|---|
| 23860937_c2_219 | 4882 | 10104 | 186 | 561 | 149 | 1.4e−10 |

| Protein name | Locus Name | Acc# |
|---|---|---|
|  | sp:YPSA_BACSU | P50838 |

Description

HYPOTHETICAL 21.1 KD PROTEIN IN COTD-KDUD INTERGENIC REGION

| ORF Name | NTID | AAID | NT Length | AA Length | Score | Probability |
|---|---|---|---|---|---|---|
| 24265637_f1_12 | 4883 | 10105 | 131 | 396 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24480382_f1_35 | 4884 | 10106 | 154 | 465 |  |  |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 24489062_f3_120 | 4885 | 10107 | 286 | 861 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24504062_f1_14 | 4886 | 10108 | 211 | 636 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24642200_c2_262 | 4887 | 10109 | 192 | 576 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24693836_c2_230 | 4888 | 10110 | 191 | 576 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 25589017_c1_192 | 4889 | 10111 | 233 | 702 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 25627153_f3_143 | 4890 | 10112 | 74 | 222 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 25878812_f1_10 | 4891 | 10113 | 109 | 330 | 85 | 0.0044 |

| Protein name | | | | Locus Name | | Acc# |
|---|---|---|---|---|---|---|
| antigen 5401 | | | | pir:A60643 | | A60643 |

Description

-continued

| ORF Name | NTID | AAID | NT Length | AA Length | Score | Probability |
|---|---|---|---|---|---|---|
| 26442203__f3__104 | 4892 | 10114 | 278 | 837 | 125 | 2.0e−05 |

| Protein name | | | Locus Name | | | Acc# |
|---|---|---|---|---|---|---|
| chromosome partitioning ATPase Soj | | | pir:D75570 | | | D75570 |

Description

| ORF Name | NTID | AAID | NT Length | AA Length | Score | Probability |
|---|---|---|---|---|---|---|
| 26752162__f2__60 | 4893 | 10115 | 213 | 642 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 26761662__f2__71 | 4894 | 10116 | 359 | 1080 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 29354192__c2__253 | 4895 | 10117 | 349 | 1050 | 79 | 0.027 |

| Protein name | | | Locus Name | | | Acc# |
|---|---|---|---|---|---|---|
| | | | gp:S83195 | | | S83195 |

Description

.

| ORF Name | NTID | AAID | NT Length | AA Length | Score | Probability |
|---|---|---|---|---|---|---|
| 3136318__c1__189 | 4896 | 10118 | 226 | 681 | 108 | 2.3e−08 |

| Protein name | | | Locus Name | | | Acc# |
|---|---|---|---|---|---|---|
| sperm mitochondrial capsule selenoprotein | | | pir:A37199 | | | A37199 |

Description

| ORF Name | NTID | AAID | NT Length | AA Length | Score | Probability |
|---|---|---|---|---|---|---|
| 31423591__f1__17 | 4897 | 10119 | 116 | 351 | 116 | 7.5e−06 |

| Protein name | | | Locus Name | | | Acc# |
|---|---|---|---|---|---|---|
| major ampullate fibroin protein | | | pir:A36068 | | | A36068 |

Description

-continued

| ORF Name | NTID | AAID | NT Length | AA Length | Score | Probability |
|---|---|---|---|---|---|---|
| 31432007_c2_234 | 4898 | 10120 | 101 | 306 | 118 | 3.8e−06 |

| Protein name | Locus Name | Acc# |
|---|---|---|
| KIAA0775 protein | gp:AB018318 | AB018318 |

Description

*Homo sapiens* mRNA for KIAA0775 protein, complete cds.

| ORF Name | NTID | AAID | NT Length | AA Length | Score | Probability |
|---|---|---|---|---|---|---|
| 31836561_c1_166 | 4899 | 10121 | 596 | 1791 | 313 | 3.1e−27 |

| Protein name | Locus Name | Acc# |
|---|---|---|
| | gp:CBGIDPAB | Y10436 |

Description

*C. burnetii* put. genes for encoding glucose inhibited division protein A and B.

| ORF Name | NTID | AAID | NT Length | AA Length | Score | Probability |
|---|---|---|---|---|---|---|
| 33398568_c1_145 | 4900 | 10122 | 78 | 237 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 33792215_f2_67 | 4901 | 10123 | 457 | 1374 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 34119841_f2_54 | 4902 | 10124 | 240 | 723 | 111 | 0.00096 |

| Protein name | Locus Name | Acc# |
|---|---|---|
| troponin T | pir:S02708 | S02708 |

Description

| ORF Name | NTID | AAID | NT Length | AA Length | Score | Probability |
|---|---|---|---|---|---|---|
| 34181583_f3_116 | 4903 | 10125 | 194 | 585 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 34407575_f1_20 | 4904 | 10126 | 155 | 468 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 34413942_f2_55 | 4905 | 10127 | 101 | 306 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 34473416_c2_223 | 4906 | 10128 | 251 | 756 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 34495965_f1_31 | 4907 | 10129 | 110 | 333 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 34652032_f3_107 | 4908 | 10130 | 407 | 1224 | 162 | 3.0e−08 |

| Protein name | | | | Locus Name | | Acc# |
|---|---|---|---|---|---|---|
| hypothetical 119.5 K protein (uvrA region):ORF1 protein | | | | pir:JQ0405 | | JQ0405 |

Description

| ORF Name | NTID | AAID | NT Length | AA Length | Score | Probability |
|---|---|---|---|---|---|---|
| 35239458_c1_179 | 4909 | 10131 | 134 | 405 | 100 | 3.5e−06 |

| Protein name | | | | Locus Name | | Acc# |
|---|---|---|---|---|---|---|
| latent nuclear antigen | | | | gp:AF083501 | | AF083501 |

Description

*Macaca mulatta* rhadinovirus 17577 R1, dihydrofolate reductase, complement
binding protein, ssDNA binding protein, transportprotein, glycoprotein B,
DNA polymerase, R2, thymidylate synthase, R3, Bcl-2 homolog, capsid protein,
tegument protein, thymidinekinase, glycoprotein H, major capsid protein,
capsid protein, kinase, alkaline exonuclease, glycoprotein M, -continued

| ORF Name | NTID | AAID | NT Length | AA Length | Score | Probability |
|---|---|---|---|---|---|---|
| 35267567_c3_299 | 4910 | 10132 | 476 | 1431 | 89 | 0.0035 |

| Protein name | Locus Name | Acc# |
|---|---|---|
| beta-D-galactosidase | gp:BRPLACZ01 | M63097 |

Description

*Brugia malayi* beta-D-galactosidase (lacZ) mRNA, partial cds.

| ORF Name | NTID | AAID | NT Length | AA Length | Score | Probability |
|---|---|---|---|---|---|---|
| 36067343_c3_308 | 4911 | 10133 | 286 | 861 | 179 | 9.1e−12 |

| Protein name | Locus Name | Acc# |
|---|---|---|
| MocB (Tn4399) | pri:B48487 | B48487 |

Description

| ORF Name | NTID | AAID | NT Length | AA Length | Score | Probability |
|---|---|---|---|---|---|---|
| 36150277_c1_164 | 4912 | 10134 | 65 | 198 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 36442965_c3_270 | 4913 | 10135 | 69 | 210 | 63 | 0.014 |

| Protein name | Locus Name | Acc# |
|---|---|---|
| envelope protein | gp:HTVENVHE | M61052 |

Description

Human T-cell leukemia virus I (HTLV1) envelope (env) gene, 5' end.

| ORF Name | NTID | AAID | NT Length | AA Length | Score | Probability |
|---|---|---|---|---|---|---|
| 36509443_f3_131 | 4914 | 10136 | 684 | 2055 | 375 | 1.7e−31 |

| Protein name | Locus Name | Acc# |
|---|---|---|
| hypothetical protein slr1135 | pir:S77439 | S77439 |

Description

| ORF Name | NTID | AAID | NT Length | AA Length | Score | Probability |
|---|---|---|---|---|---|---|
| 36520337_c1_196 | 4915 | 10137 | 132 | 399 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 400767_c3_284 | 4916 | 10138 | 168 | 507 | 228 | 6.1e−19 |

| Protein name | Locus Name | Acc# |
|---|---|---|
| DNA repair protein RadC | pir:C70439 | C70439 |

Description

| ORF Name | NTID | AAID | NT Length | AA Length | Score | Probability |
|---|---|---|---|---|---|---|
| 4027135_f3_110 | 4917 | 10139 | 337 | 1014 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 500925_c3_266 | 4918 | 10140 | 442 | 1329 | 867 | 1.2e−86 |

| Protein name | Locus Name | Acc# |
|---|---|---|
| transposase | gp:AF038866 | AF038866 |

Description

*Bacteroides fragilis* transposon Tn5520 transposase (bipH) and mobilization protein BmpH (bmpH) genes, complete cds.

| ORF Name | NTID | AAID | NT Length | AA Length | Score | Probability |
|---|---|---|---|---|---|---|
| 593752_f1_16 | 4919 | 10141 | 104 | 315 | 81 | 6.7e−05 |

| Protein name | Locus Name | Acc# |
|---|---|---|
| hypothetical protein | pir:B40505 | B40505 |

Description

| ORF Name | NTID | AAID | NT Length | AA Length | Score | Probability |
|---|---|---|---|---|---|---|
| 813902_f3_132 | 4920 | 10142 | 112 | 339 | 83 | 0.0034 |

| Protein name | Locus Name | Acc# |
|---|---|---|
| putative resolvase | gp:DASOR | |

Description

*Desulfurolobus ambivalens* tnpA, tnpB, rfbD and sor genes and ORF2, ORF3, ORF4 and ORF5.

| ORF Name | NTID | AAID | NT Length | AA Length | Score | Probability |
|---|---|---|---|---|---|---|
| 12944067_f2_4 | 4921 | 10143 | 334 | 1005 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 4095192_f1_1 | 4922 | 10144 | 309 | 930 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 1226063_c3_5 | 4923 | 10145 | 174 | 522 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 183_c1_18 | 4924 | 10146 | 425 | 1278 | 1208 | 8.6e-123 |

| Protein name | | | | Locus Name | | Acc# |
|---|---|---|---|---|---|---|
| | | | | sp:KBL_ECOLI | | P07912 |

Description (GLYCINE ACETYLTRANSFERASE)

| ORF Name | NTID | AAID | NT Length | AA Length | Score | Probability |
|---|---|---|---|---|---|---|
| 25783462_f1_7 | 4925 | 10147 | 244 | 735 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 34181515_f2_8 | 4926 | 10148 | 349 | 1050 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 5189062_c2_27 | 4927 | 10149 | 139 | 420 | 77 | 0.018 |

| Protein name | | | | Locus Name | | Acc# |
|---|---|---|---|---|---|---|
| hypothetical protein PH0778 | | | | pir:D71126 | | D71126 |

Description

-continued

| ORF Name | NTID | AAID | NT Length | AA Length | Score | Probability |
|---|---|---|---|---|---|---|
| 5257762_f2_9 | 4928 | 10150 | 309 | 930 | 106 | 0.0078 |

| Protein name | Locus Name | Acc# |
|---|---|---|
| | gp:D42067 | D42067 |

Description

*Porphyromonas gingivalis* DNA for Fimbrilin, ORF1–4, complete cds.

| ORF Name | NTID | AAID | NT Length | AA Length | Score | Probability |
|---|---|---|---|---|---|---|
| 676887_f1_5 | 4929 | 10151 | 68 | 207 | 130 | 1.5e−08 |

| Protein name | Locus Name | Acc# |
|---|---|---|
| | gp:VCH231106 | AJ231106 |

Description

*Vibrio cholerae* z47f gene.

| ORF Name | NTID | AAID | NT Length | AA Length | Score | Probability |
|---|---|---|---|---|---|---|
| 785285_f2_11 | 4930 | 10152 | 324 | 975 | 570 | 3.5e−55 |

| Protein name | Locus Name | Acc# |
|---|---|---|
| hypothetical protein F08F3.4 | pir:T29433 | T29433 |

Description

| ORF Name | NTID | AAID | NT Length | AA Length | Score | Probability |
|---|---|---|---|---|---|---|
| 10757933_f2_49 | 4931 | 10153 | 589 | 1770 | 107 | 3.4e−07 |

| Protein name | Locus Name | Acc# |
|---|---|---|
| unknown | gp:U96771 | U96771 |

Description

*Prevotella bryantii* putative polygalacturonase, B-1,4-endoglucanase, and mannanase genes, complete cds; and unknown genes.

| ORF Name | NTID | AAID | NT Length | AA Length | Score | Probability |
|---|---|---|---|---|---|---|
| 10938205_c1_106 | 4932 | 10154 | 1060 | 3183 | 565 | 1.8e−57 |

| Protein name | Locus Name | Acc# |
|---|---|---|
| beta-N-Acetylglucosaminidase | gp:AB008771 | AB008771 |

Description

*Streptomyces thermoviolaceus* nagA gene for beta-N-Acetylglucosaminidase, complete cds.

| ORF Name | NTID | AAID | NT Length | AA Length | Score | Probability |
|---|---|---|---|---|---|---|
| 14657927_f3_70 | 4933 | 10155 | 242 | 729 | 563 | 1.9e−54 |

| Protein name | Locus Name | Acc# |
|---|---|---|
| | sp:Y796_METJA | Q58206 |

Description

HYPOTHETICAL ABC TRANSPORTER ATP-BINDING PROTEIN MJ0796

-continued

| ORF Name | NTID | AAID | NT Length | AA Length | Score | Probability |
|---|---|---|---|---|---|---|
| 17010202_f2_40 | 4934 | 10156 | 148 | 447 | 218 | 1.5e−17 |

| Protein name | Locus Name | Acc# |
|---|---|---|
| conserved hypothetical protein MTH695 | pir:F69192 | F69192 |

Description

| ORF Name | NTID | AAID | NT Length | AA Length | Score | Probability |
|---|---|---|---|---|---|---|
| 1995305_f3_73 | 4935 | 10157 | 261 | 786 | 214 | 1.8e−17 |

| Protein name | Locus Name | Acc# |
|---|---|---|
| RNA polymerase sigma factor SigZ-like protein | gp:AF137263 | AF137263 |

Description

*Bacteroides thetaiotaomicron* 30S ribosomal protein S16-liKe protein, fucose gene cluster, and RNA polymerase sigma factor SigZ-like protein (sigZ) genes, complete cds.

| ORF Name | NTID | AAID | NT Length | AA Length | Score | Probability |
|---|---|---|---|---|---|---|
| 19972762_c2_124 | 4936 | 10158 | 1007 | 3024 | 566 | 5.9e−58 |

| Protein name | Locus Name | Acc# |
|---|---|---|
| beta-N-Acetylglucosaminidase | gp:AB008771 | AB008771 |

Description

*Streptomyces thermoviolaceus* nagA gene forbeta-N-Acetylglucosaminidase, complete cds.

| ORF Name | NTID | AAID | NT Length | AA Length | Score | Probability |
|---|---|---|---|---|---|---|
| 212757_c1_80 | 4937 | 10159 | 466 | 1401 | 247 | 8.9e−24 |

| Protein name | Locus Name | Acc# |
|---|---|---|
|  | sp:MUTS_THEAQ | Q56215 |

Description

DNA MISMATCH REPAIR PROTEIN MUTS

| ORF Name | NTID | AAID | NT Length | AA Length | Score | Probability |
|---|---|---|---|---|---|---|
| 21681502_f3_74 | 4938 | 10160 | 310 | 933 | 200 | 3.2e−14 |

| Protein name | Locus Name | Acc# |
|---|---|---|
| transmembrane sensor | gp:AF051691 | AF051691 |

Description

*Pseudomonas aeruginosa* stress factor A (psfA), ECF sigma factor (fiuI), transmembrane sensor (fiuR), and hydroxamate-typeferrisiderophore receptor (fiuA) genes, complete cds.

| ORF Name | NTID | AAID | NT Length | AA Length | Score | Probability |
|---|---|---|---|---|---|---|
| 23475053_f1_20 | 4939 | 10161 | 1085 | 3258 | 583 | 1.8e−93 |

| Protein name | Locus Name | Acc# |
|---|---|---|
| receptor antigen (RagA) | gp:PGI130872 | AJ130872 |

Description

*Porphyromonas gingivalis* W50 receptor antigen (rag) locus encodinga major immunodominant 55 kDa antigen.

-continued

| ORF Name | NTID | AAID | NT Length | AA Length | Score | Probability |
|---|---|---|---|---|---|---|
| 24072250_c3_154 | 4940 | 10162 | 343 | 1032 | 512 | 4.9e−49 |

| Protein name | Locus Name | Acc# |
|---|---|---|
| glucose kinase | gp:BMGLUCKIN | AJ000005 |

Description

*Bacillus megaterium* glk gene.

| ORF Name | NTID | AAID | NT Length | AA Length | Score | Probability |
|---|---|---|---|---|---|---|
| 24651537_f2_41 | 4941 | 10163 | 368 | 1107 | 156 | 3.4e−16 |

| Protein name | Locus Name | Acc# |
|---|---|---|
| hypothetical protein slr1207 | pir:S77541 | S77541 |

Description

| ORF Name | NTID | AAID | NT Length | AA Length | Score | Probability |
|---|---|---|---|---|---|---|
| 25557818_f2_42 | 4942 | 10164 | 450 | 1353 | 662 | 6.2e−65 |

| Protein name | Locus Name | Acc# |
|---|---|---|
| immunoreactive 51 kD antigen PG52 | gp:AF175719 | AF175719 |

Description

*Porphyromonas gingivalis* strain W50 immunoreactive 51 kD antigen PG52 gene, complete cds.

| ORF Name | NTID | AAID | NT Length | AA Length | Score | Probability |
|---|---|---|---|---|---|---|
| 26600932_f1_17 | 4943 | 10165 | 119 | 360 | 299 | 1.8e−26 |

| Protein name | Locus Name | Acc# |
|---|---|---|
|  | sp:RL19_STRTR | O34031 |

Description

50S RIBOSOMAL PROTEIN L19

| ORF Name | NTID | AAID | NT Length | AA Length | Score | Probability |
|---|---|---|---|---|---|---|
| 267027_f1_26 | 4944 | 10166 | 117 | 351 | 86 | 0.027 |

| Protein name | Locus Name | Acc# |
|---|---|---|
| hypothetical protein BB0794 | pir:A70199 | A70199 |

Description

| ORF Name | NTID | AAID | NT Length | AA Length | Score | Probability |
|---|---|---|---|---|---|---|
| 26750178_c1_104 | 4945 | 10167 | 266 | 801 | 199 | 5.1e−15 |

| Protein name | Locus Name | Acc# |
|---|---|---|
| UDP-sugar hydrolase | pir:A72201 | A72201 |

Description

| ORF Name | NTID | AAID | NT Length | AA Length | Score | Probability |
|---|---|---|---|---|---|---|
| 3163392_f2_51 | 4946 | 10168 | 724 | 2175 | 1095 | 8.1e-111 |

| Protein name | Locus Name | Acc# |
|---|---|---|
| melibiase | gp:TEMELA | Y08557 |

Description

*T. ethanolicus* melA and lacA genes.

| ORF Name | NTID | AAID | NT Length | AA Length | Score | Probability |
|---|---|---|---|---|---|---|
| 35978253_c2_129 | 4947 | 10169 | 1029 | 3087 | 454 | 2.3e-73 |

| Protein name | Locus Name | Acc# |
|---|---|---|
| 115 K outer membrane protein precursor:SusC protein | pir:JC6027 | JC6027 |

Description

| ORF Name | NTID | AAID | NT Length | AA Length | Score | Probability |
|---|---|---|---|---|---|---|
| 4115927_c1_81 | 4948 | 10170 | 202 | 609 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 4305138_f1_22 | 4949 | 10171 | 538 | 1617 | 156 | 9.3e-14 |

| Protein name | Locus Name | Acc# |
|---|---|---|
| alpha-xylosidase | pir:A72394 | A72394 |

Description

| ORF Name | NTID | AAID | NT Length | AA Length | Score | Probability |
|---|---|---|---|---|---|---|
| 4409540_f2_39 | 4950 | 10172 | 436 | 1311 | 305 | 4.2e-27 |

| Protein name | Locus Name | Acc# |
|---|---|---|
| conserved hypothetical protein yknZ | pir:E69858 | E69858 |

Description

| ORF Name | NTID | AAID | NT Length | AA Length | Score | Probability |
|---|---|---|---|---|---|---|
| 5086542_f1_19 | 4951 | 10173 | 280 | 843 | 226 | 3.0e-18 |

| Protein name | Locus Name | Acc# |
|---|---|---|
| hypothetical protein | pir:S76946 | S76946 |

Description

-continued

| ORF Name | NTID | AAID | NT Length | AA Length | Score | Probability |
|---|---|---|---|---|---|---|
| 5273438_f3_76 | 4952 | 10174 | 183 | 552 | 150 | 1.8e−09 |

| Protein name | | | | Locus Name | | Acc# |
|---|---|---|---|---|---|---|
| putative alpha-glucosidase | | | | gp:AAC252161 | | AJ252161 |

Description

*Alicyclobacillus acidocaldarius* maltose/maltodextrine transport gene region (malEFGR genes, cdaA gene and glcA gene).

| ORF Name | NTID | AAID | NT Length | AA Length | Score | Probability |
|---|---|---|---|---|---|---|
| 5339381_f3_75 | 4953 | 10175 | 116 | 351 | 157 | 3.1e−10 |

| Protein name | | | | Locus Name | | Acc# |
|---|---|---|---|---|---|---|
| putative alpha-glucosidase | | | | gp:AAC252161 | | AJ252161 |

Description

*Alicyclobacillus acidocaldarius* maltose/maltodextrine transport gene region (malEFGR genes, cdaA gene and glcA gene).

| ORF Name | NTID | AAID | NT Length | AA Length | Score | Probability |
|---|---|---|---|---|---|---|
| 822127_c1_105 | 4954 | 10176 | 291 | 876 | 328 | 6.1e−29 |

| Protein name | | | | Locus Name | | Acc# |
|---|---|---|---|---|---|---|
| | | | | sp:5NTD_DISOM | | P29240 |

Description

5'-NUCLEOTIDASE PRECURSOR, (ECTO-NUCLEOTIDASE)

| ORF Name | NTID | AAID | NT Length | AA Length | Score | Probability |
|---|---|---|---|---|---|---|
| 10345327_c2_2 | 4955 | 10177 | 114 | 345 | 266 | 1.2e−21 |

| Protein name | | | | Locus Name | | Acc# |
|---|---|---|---|---|---|---|
| 115 K outer membrane protein precursor:SusC protein | | | | pir:JC6027 | | JC6027 |

Description

| ORF Name | NTID | AAID | NT Length | AA Length | Score | Probability |
|---|---|---|---|---|---|---|
| 13099158_c3_48 | 4956 | 10178 | 118 | 357 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 16589717_c2_28 | 4957 | 10179 | 301 | 906 | 167 | 2.2e−09 |

| Protein name | | | | Locus Name | | Acc# |
|---|---|---|---|---|---|---|
| | | | | gp:MMSAG | | X84710 |

Description

*M. mazei* surface antigen genes orf492, orf375 and orf783.

-continued

| ORF Name | NTID | AAID | NT Length | AA Length | Score | Probability |
|---|---|---|---|---|---|---|
| 24024182_f3_13 | 4958 | 10180 | 311 | 936 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24068841_c3_46 | 4959 | 10181 | 281 | 846 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 25422331_c3_47 | 4960 | 10182 | 518 | 1557 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 26370887_c3_45 | 4961 | 10183 | 179 | 540 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 29511635_c3_44 | 4962 | 10184 | 106 | 321 | 84 | 0.0076 |

| Protein name | | | | Locus Name | | Acc# |
|---|---|---|---|---|---|---|
| hypothetical protein BB0212 | | | | pir:D70126 | | D70126 |

Description

| ORF Name | NTID | AAID | NT Length | AA Length | Score | Probability |
|---|---|---|---|---|---|---|
| 3001566_f3_12 | 4963 | 10185 | 318 | 957 | 103 | 0.024 |

| Protein name | | | | Locus Name | | Acc# |
|---|---|---|---|---|---|---|
| probable chitinase | | | | pir:T42071 | | T42071 |

Description

| ORF Name | NTID | AAID | NT Length | AA Length | Score | Probability |
|---|---|---|---|---|---|---|
| 32040953_c1_22 | 4964 | 10186 | 64 | 195 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 35143_f3_14 | 4965 | 10187 | 624 | 1875 | 371 | 1.6e−44 |

| Protein name | Locus Name | Acc# |
|---|---|---|
| otnA protein | pir:S70958 | S70958 |

Description

| ORF Name | NTID | AAID | NT Length | AA Length | Score | Probability |
|---|---|---|---|---|---|---|
| 6495337_f1_1 | 4966 | 10188 | 132 | 399 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 13100885_f1_1 | 4967 | 10189 | 316 | 951 | 129 | 2.4e−05 |

| Protein name | Locus Name | Acc# |
|---|---|---|
| hypothetical protein slr1515 | pir:S75464 | S75464 |

Description

| ORF Name | NTID | AAID | NT Length | AA Length | Score | Probability |
|---|---|---|---|---|---|---|
| 1219538_c2_95 | 4968 | 10190 | 508 | 1527 | 195 | 7.9e−17 |

| Protein name | Locus Name | Acc# |
|---|---|---|
| unknown | gp:U96771 | U96771 |

Description

*Prevotella bryantii* putative polygalacturonase, B-1,4-endoglucanase, and mannanase genes, complete cds; and unknown genes.

| ORF Name | NTID | AAID | NT Length | AA Length | Score | Probability |
|---|---|---|---|---|---|---|
| 13672753_c2_88 | 4969 | 10191 | 572 | 1719 | 613 | 9.7e−60 |

| Protein name | Locus Name | Acc# |
|---|---|---|
| carboxyl-terminal proteinase | pir:F70369 | F70369 |

Description

| ORF Name | NTID | AAID | NT Length | AA Length | Score | Probability |
|---|---|---|---|---|---|---|
| 14492660_c2_98 | 4970 | 10192 | 71 | 213 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 14631626_f3_55 | 4971 | 10193 | 149 | 450 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 23548552_c2_90 | 4972 | 10194 | 772 | 2319 | 3902 | 0.0 |

| Protein name | | | | Locus Name | | Acc# |
|---|---|---|---|---|---|---|
| beta-glucosidase | | | | gp:AF006658 | | AF006658 |

Description

*Bacteroides fragilis* beta-glucosidase gene, complete cds.

| ORF Name | NTID | AAID | NT Length | AA Length | Score | Probability |
|---|---|---|---|---|---|---|
| 24806576_c2_89 | 4973 | 10195 | 948 | 2847 | 104 | 7.9e−05 |

| Protein name | | | | Locus Name | | Acc# |
|---|---|---|---|---|---|---|
| unknown | | | | gp:AF124349 | | AF124349 |

Description

*Zymomonas mobilis* ZM4 fosmid clone 41A4, complete sequence.

| ORF Name | NTID | AAID | NT Length | AA Length | Score | Probability |
|---|---|---|---|---|---|---|
| 26385883_c3_101 | 4974 | 10196 | 360 | 1083 | 419 | 3.5e−39 |

| Protein name | | | | Locus Name | | Acc# |
|---|---|---|---|---|---|---|
| | | | | sp:YZ37_SYNY3 | | Q55480 |

Description

HYPOTHETICAL SUGAR KINASE SLR0537

| ORF Name | NTID | AAID | NT Length | AA Length | Score | Probability |
|---|---|---|---|---|---|---|
| 33242062_c3_100 | 4975 | 10197 | 824 | 2475 | 802 | 8.8e−82 |

| Protein name | | | | Locus Name | | Acc# |
|---|---|---|---|---|---|---|
| hypothetical protein TM0280 | | | | pir:F72395 | | F72395 |

Description

| ORF Name | NTID | AAID | NT Length | AA Length | Score | Probability |
|---|---|---|---|---|---|---|
| 33864378_c1_78 | 4976 | 10198 | 1009 | 3030 | 432 | 1.3e−92 |

| Protein name | | | | Locus Name | | Acc# |
|---|---|---|---|---|---|---|
| receptor antigen (RagA) | | | | gp:PGI130872 | | AJ130872 |

Description

*Porphyromonas gingivalis* W50 receptor antigen (rag) locus encodinga major immunodominant 55 kDa antigen.

-continued

| ORF Name | NTID | AAID | NT Length | AA Length | Score | Probability |
|---|---|---|---|---|---|---|
| 441337_c2_97 | 4977 | 10199 | 576 | 1731 | 136 | 5.4e−06 |

| Protein name | | | | Locus Name | | Acc# |
|---|---|---|---|---|---|---|
| | | | | sp:XYNB_PRERU | | P48791 |

Description 1,4-BETA-XYLOSIDASE) (EXO-BETA-(1,4)-XYLANASE)

| ORF Name | NTID | AAID | NT Length | AA Length | Score | Probability |
|---|---|---|---|---|---|---|
| 4961578_c2_86 | 4978 | 10200 | 514 | 1545 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 984512_c2_96 | 4979 | 10201 | 437 | 1314 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 15797080_f3_1 | 4980 | 10202 | 113 | 342 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24806591_c1_2 | 4981 | 10203 | 89 | 267 | 226 | 6.0e−18 |

| Protein name | | | | Locus Name | | Acc# |
|---|---|---|---|---|---|---|
| | | | | sp:YNHE_ECOLI | | P77522 |

Description

HYPOTHETICAL 56.3 KD PROTEIN IN LPP-AROD INTERGENIC REGION

| ORF Name | NTID | AAID | NT Length | AA Length | Score | Probability |
|---|---|---|---|---|---|---|
| 25815841_c3_4 | 4982 | 10204 | 77 | 234 | 223 | 2.1e−18 |

| Protein name | | | | Locus Name | | Acc# |
|---|---|---|---|---|---|---|
| probable oxidoreductase | | | | pir:T34993 | | T34993 |

Description

-continued

| ORF Name | NTID | AAID | NT Length | AA Length | Score | Probability |
|---|---|---|---|---|---|---|
| 11854168_f3_1 | 4983 | 10205 | 187 | 564 | 317 | 2.2e−28 |

| Protein name | Locus Name | Acc# |
|---|---|---|
| 4-methyl-5(b-hydroxyethyl)-thiazole monophosphate biosynthesis protein (thiJ) homolog | pir:D70177 | D70177 |

Description

| ORF Name | NTID | AAID | NT Length | AA Length | Score | Probability |
|---|---|---|---|---|---|---|
| 21595663_c2_2 | 4984 | 10206 | 134 | 402 | 200 | 1.3e−14 |

| Protein name | Locus Name | Acc# |
|---|---|---|
| 115 K outer membrane protein precursor:SusC protein | pir:JC6027 | JC6027 |

Description

| ORF Name | NTID | AAID | NT Length | AA Length | Score | Probability |
|---|---|---|---|---|---|---|
| 10944505_f3_7 | 4985 | 10207 | 70 | 213 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 13707938_f1_1 | 4986 | 10208 | 374 | 1125 | 106 | 0.0014 |

| Protein name | Locus Name | Acc# |
|---|---|---|
| omp85 analog | pir:D72094 | D72094 |

Description

| ORF Name | NTID | AAID | NT Length | AA Length | Score | Probability |
|---|---|---|---|---|---|---|
| 17070300_c3_15 | 4987 | 10209 | 69 | 210 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24431268_f2_5 | 4988 | 10210 | 187 | 564 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 25786067_f3_8 | 4989 | 10211 | 68 | 207 | 104 | 0.00010 |

| Protein name | Locus Name | Acc# |
|---|---|---|
| | sp:YJDB_*ECOLI* | |

Description

HYPOTHETICAL 61.7 KD PROTEIN IN BASS-ADIY INTERGENIC REGION

| ORF Name | NTID | AAID | NT Length | AA Length | Score | Probability |
|---|---|---|---|---|---|---|
| 32031466_f1_3 | 4990 | 10212 | 133 | 402 | 100 | 0.00026 |

| Protein name | Locus Name | Acc# |
|---|---|---|
| | sp:YBIP_*ECOLI* | P75785 |

Description

HYPOTHETICAL 59.7 KD PROTEIN IN OMPX-MOEB INTERGENIC REGION

| ORF Name | NTID | AAID | NT Length | AA Length | Score | Probability |
|---|---|---|---|---|---|---|
| 10635006_f1_1 | 4991 | 10213 | 107 | 324 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 23475780_c2_2 | 4992 | 10214 | 288 | 864 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 23991662_f1_1 | 4993 | 10215 | 210 | 633 | 553 | 2.2e−53 |

| Protein name | Locus Name | Acc# |
|---|---|---|
| mobilization protein A | gp:AF118241 | AF118241 |

Description

*Bacteroides fragilis* mobilization protein A (mobA) gene, complete cds.

| ORF Name | NTID | AAID | NT Length | AA Length | Score | Probability |
|---|---|---|---|---|---|---|
| 12541385_c2_36 | 4994 | 10216 | 104 | 312 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 20588187_c2_30 | 4995 | 10217 | 276 | 831 | 91 | 0.047 |

| Protein name | Locus Name | Acc# |
|---|---|---|
| polymorphic outer membrane protein G family | gp:AB033794 | AB033794 |

Description

*Chlamydophila pneumoniae* pmp_3.1 gene for polymorphic outermembrane protein G family, complete cds.

| ORF Name | NTID | AAID | NT Length | AA Length | Score | Probability |
|---|---|---|---|---|---|---|
| 21914762_c2_32 | 4996 | 10218 | 61 | 186 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 22265701_f2_8 | 4997 | 10219 | 495 | 1488 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 24641877_c3_38 | 4998 | 10220 | 115 | 348 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 25597781_c3_40 | 4999 | 10221 | 555 | 1668 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 4110090_c3_37 | 5000 | 10222 | 358 | 1077 | 104 | 0.032 |

| Protein name | Locus Name | Acc# |
|---|---|---|
| hypothetical protein Y26D4A.9 | pir:T26569 | T26569 |

Description

-continued

| ORF Name | NTID | AAID | NT Length | AA Length | Score | Probability |
|---|---|---|---|---|---|---|
| 5164042_c1_28 | 5001 | 10223 | 209 | 630 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 15911275_c1_24 | 5002 | 10224 | 337 | 1014 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 26368757_c2_29 | 5003 | 10225 | 126 | 381 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 2736657_c2_31 | 5004 | 10226 | 71 | 216 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 4900250_f3_17 | 5005 | 10227 | 708 | 2127 | 929 | 3.3e−178 |

| Protein name | | | Locus Name | | | Acc# |
|---|---|---|---|---|---|---|
| conserved hypothetical protein ydcI | | | pir:G69773 | | | G69773 |

Description

| ORF Name | NTID | AAID | NT Length | AA Length | Score | Probability |
|---|---|---|---|---|---|---|
| 6054083_c2_36 | 5006 | 10228 | 108 | 324 | 75 | 0.0099 |

| Protein name | | | Locus Name | | | Acc# |
|---|---|---|---|---|---|---|
| E3 class 2 protein | | | pir:B46308 | | | B46308 |

Description

| ORF Name | NTID | AAID | NT Length | AA Length | Score | Probability |
|---|---|---|---|---|---|---|
| 6285817_c3_37 | 5007 | 10229 | 277 | 834 | | |

| Protein name | | | Locus Name | | | Acc# |
|---|---|---|---|---|---|---|

Description

NO-HIT

-continued

| ORF Name | NTID | AAID | NT Length | AA Length | Score | Probability |
|---|---|---|---|---|---|---|
| 14882768_f3_29 | 5008 | 10230 | 304 | 912 | 587 | 5.5e−57 |

| Protein name | | | | Locus Name | | Acc# |
|---|---|---|---|---|---|---|
| conserved hypothetical protein yisQ | | | | pir:H69837 | | H69837 |

Description

| ORF Name | NTID | AAID | NT Length | AA Length | Score | Probability |
|---|---|---|---|---|---|---|
| 15042062_f3_25 | 5009 | 10231 | 257 | 774 | 213 | 2.4e−17 |

| Protein name | | | | Locus Name | | Acc# |
|---|---|---|---|---|---|---|
| | | | | gp:SPU59236 | | U59236 |

Description

*Synechococcus* PCC7942 ribosomal protein S1 of 30S ribosome (rps1), ORF271, ORF231, ORF341, carboxyltransferase alpha subunit (accA), ORF245, ORF227, and GTP cyclohydrolase I (folE) genes, complete cds, and ORF205 gene, partial cds.

| ORF Name | NTID | AAID | NT Length | AA Length | Score | Probability |
|---|---|---|---|---|---|---|
| 16829637_f3_23 | 5010 | 10232 | 118 | 357 | 213 | 2.4e−17 |

| Protein name | | | | Locus Name | | Acc# |
|---|---|---|---|---|---|---|
| | | | | sp:YEBR_ECOLI | | |

Description

HYPOTHETICAL 20.3 KD PROTEIN IN PRC-PPHA INTERGENIC REGION

| ORF Name | NTID | AAID | NT Length | AA Length | Score | Probability |
|---|---|---|---|---|---|---|
| 24800063_c3_62 | 5011 | 10233 | 66 | 201 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 25943937_f3_28 | 5012 | 10234 | 152 | 459 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 29473527_f1_1 | 5013 | 10235 | 160 | 483 | 198 | 1.8e−14 |

| Protein name | | | | Locus Name | | Acc# |
|---|---|---|---|---|---|---|
| two component sensor | | | | gp:AF030352 | | AF030352 |

Description

*Pseudomonas aeruginosa* two component sensor (lemA) gene, partial cds.

-continued

| ORF Name | NTID | AAID | NT Length | AA Length | Score | Probability |
|---|---|---|---|---|---|---|
| 3398391_f3_27 | 5014 | 10236 | 463 | 1392 | 414 | 1.2e−38 |

| Protein name | | | | Locus Name | | Acc# |
|---|---|---|---|---|---|---|
| conserved hypothetical protein | | | | pir:G72220 | | G72220 |

Description

| ORF Name | NTID | AAID | NT Length | AA Length | Score | Probability |
|---|---|---|---|---|---|---|
| 3947162_f3_22 | 5015 | 10237 | 583 | 1752 | 540 | 5.3e−52 |

| Protein name | | | | Locus Name | | Acc# |
|---|---|---|---|---|---|---|
| 2',3'-cyclic-nucleotide 2'-phosphodiesterase, precursor | | | | pir:H64532 | | H64532 |

Description

| ORF Name | NTID | AAID | NT Length | AA Length | Score | Probability |
|---|---|---|---|---|---|---|
| 4477328_f2_13 | 5016 | 10238 | 112 | 339 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 4960936_f1_7 | 5017 | 10239 | 766 | 2301 | 252 | 7.1e−18 |

| Protein name | | | | Locus Name | | Acc# |
|---|---|---|---|---|---|---|
| | | | | sp:CIRA_*ECOLI* | | P17315 |

Description

COLICIN I RECEPTOR PRECURSOR

| ORF Name | NTID | AAID | NT Length | AA Length | Score | Probability |
|---|---|---|---|---|---|---|
| 86037_c1_32 | 5018 | 10240 | 224 | 675 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 13105192_c3_22 | 5019 | 10241 | 653 | 1962 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 26369015_c2_21 | 5020 | 10242 | 840 | 2520 | 440 | 7.4e−74 |

| Protein name | Locus Name | Acc# |
|---|---|---|
| 115 K outer membrane protein precursor:SusC protein | pir:JC6027 | JC6027 |

Description

| ORF Name | NTID | AAID | NT Length | AA Length | Score | Probability |
|---|---|---|---|---|---|---|
| 4408275_c3_23 | 5021 | 10243 | 62 | 189 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 25832158_f1_1 | 5022 | 10244 | 191 | 576 | 475 | 4.1e−45 |

| Protein name | Locus Name | Acc# |
|---|---|---|
| hypothetical protein jhp0042 | pir:H71981 | H71981 |

Description

| ORF Name | NTID | AAID | NT Length | AA Length | Score | Probability |
|---|---|---|---|---|---|---|
| 3382312_f1_1 | 5023 | 10245 | 202 | 609 | 127 | 1.3e−05 |

| Protein name | Locus Name | Acc# |
|---|---|---|
| TonB-dependent receptor HmuR | gp:PGU87395 | U87395 |

Description

*Porphyromonas gingivalis* TonB-dependent receptor HmuR (hmuR) gene, complete cds.

| ORF Name | NTID | AAID | NT Length | AA Length | Score | Probability |
|---|---|---|---|---|---|---|
| 1038140_f1_2 | 5024 | 10246 | 1095 | 3288 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 10585927_f1_12 | 5025 | 10247 | 89 | 270 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 10979687_c3_125 | 5026 | 10248 | 136 | 411 | 330 | 9.4e−30 |

| Protein name | Locus Name | Acc# |
|---|---|---|
| | sp:MSCL_ERWCA | O68284 |

Description

LARGE-CONDUCTANCE MECHANOSENSITIVE CHANNEL

| ORF Name | NTID | AAID | NT Length | AA Length | Score | Probability |
|---|---|---|---|---|---|---|
| 11751442_f1_1 | 5027 | 10249 | 93 | 282 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 13017676_c1_85 | 5028 | 10250 | 176 | 531 | 133 | 1.2e−07 |

| Protein name | Locus Name | Acc# |
|---|---|---|
| trsI protein (traI) | gp:AE001272 | AE001272 |

Description

*Lactococcus lactis* DPC3147 plasmid pMRC01, complete plasmid sequence.

| ORF Name | NTID | AAID | NT Length | AA Length | Score | Probability |
|---|---|---|---|---|---|---|
| 13781250_c2_106 | 5029 | 10251 | 67 | 204 | 202 | 3.5e−16 |

| Protein name | Locus Name | Acc# |
|---|---|---|
| hypothetical protein 1 | pir:I40237 | I40237 |

Description

| ORF Name | NTID | AAID | NT Length | AA Length | Score | Probability |
|---|---|---|---|---|---|---|
| 13932825_f3_50 | 5030 | 10252 | 721 | 2166 | 121 | 0.00075 |

| Protein name | Locus Name | Acc# |
|---|---|---|
| | gp:T7CG | |

Description

Genome of bacteriophage T7.

| ORF Name | NTID | AAID | NT Length | AA Length | Score | Probability |
|---|---|---|---|---|---|---|
| 14315933_c1_75 | 5031 | 10253 | 140 | 423 | | |

| Protein name | Locus Name | Acc# |
|---|---|---|

Description

NO-HIT

-continued

| ORF Name | NTID | AAID | NT Length | AA Length | Score | Probability |
|---|---|---|---|---|---|---|
| 16531331_c3_128 | 5032 | 10254 | 292 | 879 | 90 | 0.00059 |

| Protein name | Locus Name | Acc# |
|---|---|---|
| ras interacting protein RIPA | gp:AF159241 | AF159241 |

Description

*Dictyostelium discoideum* ras interacting protein RIPA (ripA) mRNA, complete cds.

| ORF Name | NTID | AAID | NT Length | AA Length | Score | Probability |
|---|---|---|---|---|---|---|
| 23636550_f2_25 | 5033 | 10255 | 281 | 846 | 154 | 7.3e−10 |

| Protein name | Locus Name | Acc# |
|---|---|---|
| tetracycline resistance element mobilization regulatory protein rteC | pir:A36927 | A36927 |

Description

| ORF Name | NTID | AAID | NT Length | AA Length | Score | Probability |
|---|---|---|---|---|---|---|
| 23674130_c2_107 | 5034 | 10256 | 415 | 1248 | 137 | 5.2e−06 |

| Protein name | Locus Name | Acc# |
|---|---|---|
| clostripain-related protein | pir:B72351 | B72351 |

Description

| ORF Name | NTID | AAID | NT Length | AA Length | Score | Probability |
|---|---|---|---|---|---|---|
| 23954136_c2_119 | 5035 | 10257 | 85 | 258 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24641637_c2_103 | 5036 | 10258 | 232 | 699 | 485 | 3.5e−46 |

| Protein name | Locus Name | Acc# |
|---|---|---|
| | sp:AQPZ_ECOLI | |

Description

AQUAPORIN Z (BACTERIAL NODULIN-LIKE INTRINSIC PROTEIN)

| ORF Name | NTID | AAID | NT Length | AA Length | Score | Probability |
|---|---|---|---|---|---|---|
| 24645261_c3_132 | 5037 | 10259 | 378 | 1137 | 395 | 1.2e−36 |

| Protein name | Locus Name | Acc# |
|---|---|---|
| | sp:YHCG_ECOLI | P45423 |

Description

HYPOTHETICAL 43.3 KD PROTEIN IN GLTF-NANT INTERGENIC REGION (O375)

-continued

| ORF Name | NTID | AAID | NT Length | AA Length | Score | Probability |
|---|---|---|---|---|---|---|
| 2537562_c1_69 | 5038 | 10260 | 120 | 363 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 26594087_f2_26 | 5039 | 10261 | 138 | 417 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 32317217_f1_4 | 5040 | 10260 | 143 | 432 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 32442125_c1_70 | 5041 | 10263 | 235 | 708 | 170 | 1.8e−13 |

| Protein name | | | | Locus Name | | Acc# |
|---|---|---|---|---|---|---|
| immunoreactive 42 kD antigen PG33 | | | | gp:AF175715 | | AF175715 |

Description

*Porphyromonas gingivalis* strain W50 immunoreactive 42 kD antigen PG33 gene, complete cds.

| ORF Name | NTID | AAID | NT Length | AA Length | Score | Probability |
|---|---|---|---|---|---|---|
| 32453507_c1_74 | 5042 | 10264 | 91 | 276 | 76 | 0.023 |

| Protein name | | | | Locus Name | | Acc# |
|---|---|---|---|---|---|---|
| elongation factor Ts | | | | gp:AF195952 | | AF195952 |

Description

*Phaeodactylum tricornutum* ribulose-1,5-bisphosphatecarboxylase/oxygenase large subunit (rbcL), ribulose-1,5-bisphosphate carboxylase/oxygenase small subunit (rbcS), and elongation factor Ts (EF-Ts) genes, complete cds; chloroplast genes for chloroplast products.

| ORF Name | NTID | AAID | NT Length | AA Length | Score | Probability |
|---|---|---|---|---|---|---|
| 33397331_c3_126 | 5043 | 10265 | 87 | 264 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 35292938_f3_53 | 5044 | 10266 | 143 | 432 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 4116262_c2_105 | 5045 | 10267 | 98 | 297 | 169 | 1.1e−12 |

| Protein name | | | | Locus Name | | Acc# |
|---|---|---|---|---|---|---|
| DNA-binding protein, HU | | | | pir:H72396 | | H72396 |

Description

| ORF Name | NTID | AAID | NT Length | AA Length | Score | Probability |
|---|---|---|---|---|---|---|
| 4159811_c1_93 | 5046 | 10268 | 81 | 246 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 5110942_c2_109 | 5047 | 10269 | 546 | 1641 | 912 | 2.0e−91 |

| Protein name | | | | Locus Name | | Acc# |
|---|---|---|---|---|---|---|
| DNA topoisomerase III topB | | | | pir:H69724 | | H69724 |

Description

| ORF Name | NTID | AAID | NT Length | AA Length | Score | Probability |
|---|---|---|---|---|---|---|
| 5250000_c2_108 | 5048 | 10270 | 517 | 1554 | 178 | 4.0e−10 |

| Protein name | | | | Locus Name | | Acc# |
|---|---|---|---|---|---|---|
| high molecular weight glutenin subunit | | | | gp:ASU39229 | | U39229 |

Description

*Aegilops tauschii* high molecular weight glutenin subunit (Glu-1-2) gene, complete cds.

| ORF Name | NTID | AAID | NT Length | AA Length | Score | Probability |
|---|---|---|---|---|---|---|
| 5895187_f1_5 | 5049 | 10271 | 165 | 498 | | |

| Protein name | | | | Locus Name | | Acc# |
|---|---|---|---|---|---|---|

Description

NO-HIT

-continued

| ORF Name | NTID | AAID | NT Length | AA Length | Score | Probability |
|---|---|---|---|---|---|---|
| 6525286_f2_30 | 5050 | 10272 | 69 | 210 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 13869003_f3_3 | 5051 | 10273 | 163 | 492 | 183 | 3.6e−14 |

| Protein name | | | | Locus Name | | Acc# |
|---|---|---|---|---|---|---|
| unknown | | | | gp:AF048749 | | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 22469452_f3_2 | 5052 | 10274 | 174 | 525 | 174 | 3.2e−13 |

| Protein name | | | | Locus Name | | Acc# |
|---|---|---|---|---|---|---|
| Unknown | | | | gp:AF048749 | | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 34266886_c1_4 | 5053 | 10275 | 122 | 369 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 781932_f1_1 | 5054 | 10276 | 308 | 927 | 528 | 9.5e−50 |

| Protein name | | | | Locus Name | | Acc# |
|---|---|---|---|---|---|---|
| 115K outer membrane protein precursor:SusC protein | | | | pir:JC6027 | | JC6027 |

Description

| ORF Name | NTID | AAID | NT Length | AA Length | Score | Probability |
|---|---|---|---|---|---|---|
| 23631887_c3_5 | 5055 | 10277 | 268 | 807 | 151 | 1.0e−08 |

| Protein name | | | | Locus Name | | Acc# |
|---|---|---|---|---|---|---|
| | | | | sp:HOLB_HAEIN | | P43748 |

Description

DNA POLYMERASE III, DELTA' SUBUNIT,

-continued

| ORF Name | NTID | AAID | NT Length | AA Length | Score | Probability |
|---|---|---|---|---|---|---|
| 16445326__f3__22 | 5056 | 10278 | 73 | 222 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 16603377__f2__15 | 5057 | 10279 | 559 | 1680 | 122 | 0.00036 |

| Protein name | Locus Name | Acc# |
|---|---|---|
| carboxyl-terminal proteinase ctpB:hypothetical protein slr0257:hypothetical protein slr0257 | pir:S74579 | S74579 |

Description

| ORF Name | NTID | AAID | NT Length | AA Length | Score | Probability |
|---|---|---|---|---|---|---|
| 187540__c2__32 | 5058 | 10280 | 171 | 516 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24412632__c3__35 | 5059 | 10281 | 84 | 255 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 24648941__c3__41 | 5060 | 10282 | 498 | 1494 | 755 | 8.7e−75 |

| Protein name | Locus Name | Acc# |
|---|---|---|
| putative TonB-dependent outer membrane receptor | gp:AF048749 | AF048749 |

Description

*Bacteroides fragilis* capsular polysaccharide biosynthesis operon, complete sequence.

| ORF Name | NTID | AAID | NT Length | AA Length | Score | Probability |
|---|---|---|---|---|---|---|
| 25785191__c3__34 | 5061 | 10283 | 60 | 183 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 29453375_c1_26 | 5062 | 10284 | 65 | 198 | | |

| Protein name | | Locus Name | Acc# |
|---|---|---|---|
| | | | |

Description

NO-HIT

| ORF Name | NTID | AAID | NT Length | AA Length | Score | Probability |
|---|---|---|---|---|---|---|
| 29739375_c1_25 | 5063 | 10285 | 931 | 2796 | 136 | 0.00047 |

| Protein name | | Locus Name | Acc# |
|---|---|---|---|
| hypothetical protein PFB0540w | | pir:D71612 | D71612 |

Description

| ORF Name | NTID | AAID | NT Length | AA Length | Score | Probability |
|---|---|---|---|---|---|---|
| 3145252_c1_24 | 5064 | 10286 | 278 | 837 | 139 | 1.3e−06 |

| Protein name | | Locus Name | Acc# |
|---|---|---|---|
| | | sp:APRF_PSEAE | Q03027 |

Description

ALKALINE PROTEASE SECRETION PROTEIN APRF

| ORF Name | NTID | AAID | NT Length | AA Length | Score | Probability |
|---|---|---|---|---|---|---|
| 35194686_f3_23 | 5065 | 10287 | 249 | 750 | | |

| Protein name | | Locus Name | Acc# |
|---|---|---|---|
| | | | |

Description

NO-HIT

| ORF Name | NTID | AAID | NT Length | AA Length | Score | Probability |
|---|---|---|---|---|---|---|
| 4335962_c3_40 | 5066 | 10288 | 228 | 687 | 92 | 0.0096 |

| Protein name | | Locus Name | Acc# |
|---|---|---|---|
| putative HSP20 | | gp:AF072875 | AF072875 |

Description

*Mycobacterium smegmatis* putative HSP20 (hsp) gene, complete cds.

| ORF Name | NTID | AAID | NT Length | AA Length | Score | Probability |
|---|---|---|---|---|---|---|
| 4892140_c3_39 | 5067 | 10289 | 475 | 1428 | 134 | 2.2e−05 |

| Protein name | | Locus Name | Acc# |
|---|---|---|---|
| ORF MSV261 leucine rich repeat gene family | | gp:AF063866 | AF063866 |

Description

*Melanoplus sanguinipes* entomopoxvirus, complete genome.

-continued

| ORF Name | NTID | AAID | NT Length | AA Length | Score | Probability |
|---|---|---|---|---|---|---|
| 10429567_f3_3 | 5068 | 10290 | 77 | 234 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 4103575_f3_4 | 5069 | 10291 | 394 | 1185 | 514 | 1.3e−54 |

| Protein name | | | | Locus Name | | Acc# |
|---|---|---|---|---|---|---|
| 115K outer membrane protein precursor:SusC protein | | | | pir:JC6027 | | JC6027 |

Description

| ORF Name | NTID | AAID | NT Length | AA Length | Score | Probability |
|---|---|---|---|---|---|---|
| 10995166_f2_44 | 5070 | 10292 | 63 | 192 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 14665963_f2_30 | 5071 | 10293 | 393 | 1182 | 255 | 4.8e−20 |

| Protein name | | | | Locus Name | | Acc# |
|---|---|---|---|---|---|---|
| conserved hypothetical protein | | | | pir:H72273 | | H72273 |

Description

| ORF Name | NTID | AAID | NT Length | AA Length | Score | Probability |
|---|---|---|---|---|---|---|
| 16676688_f1_1 | 5072 | 10294 | 492 | 1479 | 646 | 3.1e−63 |

| Protein name | | | | Locus Name | | Acc# |
|---|---|---|---|---|---|---|
| conserved hypothetical protein yngK | | | | pir:H69893 | | H69893 |

Description

| ORF Name | NTID | AAID | NT Length | AA Length | Score | Probability |
|---|---|---|---|---|---|---|
| 21521937_c1_70 | 5073 | 10295 | 301 | 906 | 231 | 2.9e−19 |

| Protein name | | | | Locus Name | | Acc# |
|---|---|---|---|---|---|---|
| | | | | sp:SCRK_SALTY | | P26984 |

Description

FRUCTOKINASE,

-continued

| ORF Name | NTID | AAID | NT Length | AA Length | Score | Probability |
|---|---|---|---|---|---|---|
| 24023457_f3_52 | 5074 | 10296 | 768 | 2307 | 373 | 8.2e−31 |

| Protein name | | | | Locus Name | | Acc# |
|---|---|---|---|---|---|---|
| | | | | sp:LEMA_PSESY | | P48027 |

Description

SENSOR PROTEIN LEMA,

| ORF Name | NTID | AAID | NT Length | AA Length | Score | Probability |
|---|---|---|---|---|---|---|
| 24298262_c1_74 | 5075 | 10297 | 282 | 849 | 752 | 1.8e−74 |

| Protein name | | | | Locus Name | | Acc# |
|---|---|---|---|---|---|---|
| | | | | sp:PROW_ECOLI | | P14176 |

Description

GLYCINE BETAINE/L-PROLINE TRANSPORT SYSTEM PERMEASE PROTEIN PROW

| ORF Name | NTID | AAID | NT Length | AA Length | Score | Probability |
|---|---|---|---|---|---|---|
| 24478388_c2_101 | 5076 | 10298 | 285 | 858 | 453 | 8.7e−43 |

| Protein name | | | | Locus Name | | Acc# |
|---|---|---|---|---|---|---|
| glycine-betaine binding permease protein | | | | gp:AF139575 | | AF139575 |

Description

*Lactococcus lactis* BusAA (busAA) and glycine-betaine binding permease protein (busAB) genes, complete cds.

| ORF Name | NTID | AAID | NT Length | AA Length | Score | Probability |
|---|---|---|---|---|---|---|
| 24644706_c1_71 | 5077 | 10299 | 909 | 2730 | 391 | 2.7e−55 |

| Protein name | | | | Locus Name | | Acc# |
|---|---|---|---|---|---|---|
| hybrid histidine kinase | | | | gp:AF029704 | | AF029704 |

Description

*Dictyostelium discoideum* hybrid histidine kinase (dhkD) mRNA, complete cds.

| ORF Name | NTID | AAID | NT Length | AA Length | Score | Probability |
|---|---|---|---|---|---|---|
| 24648432_f1_10 | 5078 | 10300 | 214 | 645 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 24660817_c3_113 | 5079 | 10301 | 281 | 846 | 1490 | 1.1e−152 |

| Protein name | | | | Locus Name | | Acc# |
|---|---|---|---|---|---|---|
| fructanase | | | | pir:A36915 | | A36915 |

Description

-continued

| ORF Name | NTID | AAID | NT Length | AA Length | Score | Probability |
|---|---|---|---|---|---|---|
| 26597136_c3_114 | 5080 | 10302 | 390 | 1173 | 268 | 1.3e−21 |

| Protein name | Locus Name | Acc# |
|---|---|---|
| | sp:GLUP_BRUAB | Q44623 |

Description

GLUCOSE/GALACTOSE TRANSPORTER

| ORF Name | NTID | AAID | NT Length | AA Length | Score | Probability |
|---|---|---|---|---|---|---|
| 2817217_c1_72 | 5081 | 10303 | 124 | 375 | 210 | 4.9e−17 |

| Protein name | Locus Name | Acc# |
|---|---|---|
| | sp:YBAZ_ECOLI | P75707 |

Description

HYPOTHETICAL 14.4 KD PROTEIN IN TESB-HHA INTERGENIC REGION

| ORF Name | NTID | AAID | NT Length | AA Length | Score | Probability |
|---|---|---|---|---|---|---|
| 30084532_c2_100 | 5082 | 10304 | 412 | 1239 | 1028 | 1.0e−103 |

| Protein name | Locus Name | Acc# |
|---|---|---|
| ATPase homolog GbuA | gp:AF039835 | AF039835 |

Description

*Listeria monocytogenes* ATPase homolog GbuA (gbuA), putative glycine betaine membrane transport protein GbuB (gbuB), and putative glycine betaine binding protein GbuC (gbuC) genes, complete cds.

| ORF Name | NTID | AAID | NT Length | AA Length | Score | Probability |
|---|---|---|---|---|---|---|
| 35681308_f1_14 | 5083 | 10305 | 102 | 309 | 125 | 5.0e−08 |

| Protein name | Locus Name | Acc# |
|---|---|---|
| hypothetical protein APE2061 | pir:G72510 | G72510 |

Description

| ORF Name | NTID | AAID | NT Length | AA Length | Score | Probability |
|---|---|---|---|---|---|---|
| 429511_f2_31 | 5084 | 10306 | 192 | 579 | 132 | 9.0e−09 |

| Protein name | Locus Name | Acc# |
|---|---|---|
| conserved hypothetical protein | pir:G75555 | G75555 |

Description

| ORF Name | NTID | AAID | NT Length | AA Length | Score | Probability |
|---|---|---|---|---|---|---|
| 4712825_c1_88 | 5085 | 10307 | 398 | 1197 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 547752_f1_9 | 5086 | 10308 | 1193 | 3582 | 3762 | 0.0 |

| Protein name | Locus Name | Acc# |
|---|---|---|
| pyruvate ferredoxin oxidoreductase | gp:CPA17727 | Y17727 |

Description

*Clostridium pasteurianum* genes encoding putative pyruvate ferredoxin oxidoreductase (8005 bp).

| ORF Name | NTID | AAID | NT Length | AA Length | Score | Probability |
|---|---|---|---|---|---|---|
| 2031461_c2_5 | 5087 | 10309 | 281 | 846 | 150 | 1.8e−08 |

| Protein name | Locus Name | Acc# |
|---|---|---|
| hypothetical protein aq_1477 | pir:D70428 | D70428 |

Description

| ORF Name | NTID | AAID | NT Length | AA Length | Score | Probability |
|---|---|---|---|---|---|---|
| 32431880_f2_1 | 5088 | 10310 | 280 | 843 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 21562667_f1_4 | 5089 | 10311 | 617 | 1854 | 2041 | 4.6e−211 |

| Protein name | Locus Name | Acc# |
|---|---|---|
| | sp:ILVD_HAEIN | P44851 |

Description

DIHYDROXY-ACID DEHYDRATASE, (DAD)

| ORF Name | NTID | AAID | NT Length | AA Length | Score | Probability |
|---|---|---|---|---|---|---|
| 23712785_f2_10 | 5090 | 10312 | 569 | 1710 | 1245 | 1.0e−126 |

| Protein name | Locus Name | Acc# |
|---|---|---|
| acetolactate synthase, large subunit | pir:B72362 | B72362 |

Description

| ORF Name | NTID | AAID | NT Length | AA Length | Score | Probability |
|---|---|---|---|---|---|---|
| 31908538_f2_7 | 5091 | 10313 | 235 | 708 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 35204656_f1_6 | 5092 | 10314 | 80 | 240 | 64 | 0.0053 |

| Protein name | | | Locus Name | | | Acc# |
|---|---|---|---|---|---|---|
| capsid portal protein | | | gp:B1U32222 | | | |

Description

Bacteriophage 186, complete sequence.

| ORF Name | NTID | AAID | NT Length | AA Length | Score | Probability |
|---|---|---|---|---|---|---|
| 4822001_f3_12 | 5093 | 10315 | 718 | 2157 | 269 | 2.4e−20 |

| Protein name | | | Locus Name | | | Acc# |
|---|---|---|---|---|---|---|
| | | | gp:AF083424 | | | AF083424 |

Description

Ateline herpesvirus 3 complete genome.

| ORF Name | NTID | AAID | NT Length | AA Length | Score | Probability |
|---|---|---|---|---|---|---|
| 6678425_f2_9 | 5094 | 10316 | 397 | 1194 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 23516942_c3_5 | 5095 | 10317 | 305 | 915 | | |

| Protein name | | | Locus Name | | | Acc# |
|---|---|---|---|---|---|---|

Description

NO-HIT

| ORF Name | NTID | AAID | NT Length | AA Length | Score | Probability |
|---|---|---|---|---|---|---|
| 25667631_c2_3 | 5096 | 10318 | 83 | 252 | 131 | 1.4e−08 |

| Protein name | | | Locus Name | | | Acc# |
|---|---|---|---|---|---|---|
| | | | sp:Y052_BORBU | | | O51081 |

Description

HYPOTHETICAL TRNA/RRNA METHYLTRANSFERASE BB0052,

| ORF Name | NTID | AAID | NT Length | AA Length | Score | Probability |
|---|---|---|---|---|---|---|
| 2442257_f1_1 | 5097 | 10319 | 80 | 243 | | |

| Protein name | | | Locus Name | | | Acc# |
|---|---|---|---|---|---|---|

Description

NO-HIT

-continued

| ORF Name | NTID | AAID | NT Length | AA Length | Score | Probability |
|---|---|---|---|---|---|---|
| 26289650_f1_3 | 5098 | 10320 | 140 | 423 | 257 | 5.1e−22 |

| Protein name | Locus Name | Acc# |
|---|---|---|
| | sp:YM64_ARCFU | O28020 |

Description

HYPOTHETICAL PROTEIN AF2264

| ORF Name | NTID | AAID | NT Length | AA Length | Score | Probability |
|---|---|---|---|---|---|---|
| 31913933_c3_27 | 5099 | 10321 | 304 | 915 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4164011_f3_8 | 5100 | 10322 | 320 | 963 | 377 | 9.9e−35 |

| Protein name | Locus Name | Acc# |
|---|---|---|
| | sp:YXEH_BACSU | P54947 |

Description

HYPOTHETICAL 30.2 KD PROTEIN IN IDH-DEOR INTERGENIC REGION

| ORF Name | NTID | AAID | NT Length | AA Length | Score | Probability |
|---|---|---|---|---|---|---|
| 6444402_f2_5 | 5101 | 10323 | 495 | 1488 | 1190 | 7.0e−121 |

| Protein name | Locus Name | Acc# |
|---|---|---|
| cysteinyl-tRNA synthetase | pir:A75368 | A75368 |

Description

| ORF Name | NTID | AAID | NT Length | AA Length | Score | Probability |
|---|---|---|---|---|---|---|
| 12125931_f2_4 | 5102 | 10324 | 214 | 645 | 220 | 4.3e−18 |

| Protein name | Locus Name | Acc# |
|---|---|---|
| 2,3,4,5-tetrahydropyridine-2-carboxylate N-succinyltransferase-related protein | pir:H72245 | H72245 |

Description

| ORF Name | NTID | AAID | NT Length | AA Length | Score | Probability |
|---|---|---|---|---|---|---|
| 12988762_f2_5 | 5103 | 10325 | 62 | 189 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 2813942_f2_3 | 5104 | 10326 | 73 | 222 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 12944677_c2_5 | 5105 | 10327 | 453 | 1359 | 302 | 7.3e−35 |

| Protein name | | | | Locus Name | | Acc# |
|---|---|---|---|---|---|---|
| TonB-dependent receptor HmuR | | | | gp:PGU87395 | | U87395 |

Description

*Porphyromonas gingivalis* TonB-dependent receptor HmuR (hmuR) gene, complete cds.

| ORF Name | NTID | AAID | NT Length | AA Length | Score | Probability |
|---|---|---|---|---|---|---|
| 22850381_c1_4 | 5106 | 10328 | 77 | 234 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 14664017_c3_4 | 5107 | 10329 | 210 | 630 | 379 | 9.1e−34 |

| Protein name | | | | Locus Name | | Acc# |
|---|---|---|---|---|---|---|
| receptor antigen (RagA) | | | | gp:PGI130872 | | AJ130872 |

Description

*Porphyromonas gingivalis* W50 receptor antigen (rag) Locus encodling a major immunodominant 55 kDa antigen.

| ORF Name | NTID | AAID | NT Length | AA Length | Score | Probability |
|---|---|---|---|---|---|---|
| 20164665_f1_1 | 5108 | 10330 | 68 | 207 | 51 | 0.0055 |

| Protein name | | | | Locus Name | | Acc# |
|---|---|---|---|---|---|---|
| 50 kDa lectin | | | | gp:BMO50KDAL | | D14168 |

Description

Silk worm mRNA for 50 kDa lectin, complete cds.

| ORF Name | NTID | AAID | NT Length | AA Length | Score | Probability |
|---|---|---|---|---|---|---|
| 2460837_f3_2 | 5109 | 10331 | 614 | 1845 | 556 | 9.9e−54 |

| Protein name | | | | Locus Name | | Acc# |
|---|---|---|---|---|---|---|
| adenylate cyclase homolog | | | | pir:T17197 | | T17197 |

Description

-continued

| ORF Name | NTID | AAID | NT Length | AA Length | Score | Probability |
|---|---|---|---|---|---|---|
| 14923563_c1_10 | 5110 | 10332 | 145 | 438 | | |
| Protein name | | | | Locus Name | | Acc# |
| Description | | | | | | |
| NO-HIT | | | | | | |

| ORF Name | NTID | AAID | NT Length | AA Length | Score | Probability |
|---|---|---|---|---|---|---|
| 15742327_f1_2 | 5111 | 10333 | 60 | 183 | | |
| Protein name | | | | Locus Name | | Acc# |
| Description | | | | | | |
| NO-HIT | | | | | | |

| ORF Name | NTID | AAID | NT Length | AA Length | Score | Probability |
|---|---|---|---|---|---|---|
| 24398917_c1_11 | 5112 | 10334 | 193 | 582 | 302 | 8.7e−27 |
| Protein name | | | | Locus Name | | Acc# |
| conserved hypothetical protein | | | | pir:G72380 | | G72380 |
| Description | | | | | | |

| ORF Name | NTID | AAID | NT Length | AA Length | Score | Probability |
|---|---|---|---|---|---|---|
| 33772907_c2_15 | 5113 | 10335 | 117 | 354 | 71 | 0.026 |
| Protein name | | | | Locus Name | | Acc# |
| HdcB | | | | gp:OOU58865 | | U58865 |
| Description | | | | | | |

*Oenococcus oeni* histidine decarboxylase (hdcA) gene, complete cds; and HdcB (hdcB) gene, partial cds.

| ORF Name | NTID | AAID | NT Length | AA Length | Score | Probability |
|---|---|---|---|---|---|---|
| 35267037_c2_16 | 5114 | 10336 | 117 | 354 | | |
| Protein name | | | | Locus Name | | Acc# |
| Description | | | | | | |
| NO-HIT | | | | | | |

| ORF Name | NTID | AAID | NT Length | AA Length | Score | Probability |
|---|---|---|---|---|---|---|
| 16541003_f3_3 | 5115 | 10337 | 64 | 195 | | |
| Protein name | | | | Locus Name | | Acc# |
| Description | | | | | | |
| NO-HIT | | | | | | |

-continued

| ORF Name | NTID | AAID | NT Length | AA Length | Score | Probability |
|---|---|---|---|---|---|---|
| 20500657_f3_4 | 5116 | 10338 | 515 | 1548 | 1069 | 4.6e−108 |

| Protein name | Locus Name | Acc# |
|---|---|---|
| inorganic pyrophosphatase | gp:D88820 | D88820 |

Description

*Acetabularia mediterranea* mRNA for inorganic pyrophosphatase, complete cds.

| ORF Name | NTID | AAID | NT Length | AA Length | Score | Probability |
|---|---|---|---|---|---|---|
| 10944500_c2_9 | 5117 | 10339 | 299 | 900 | 341 | 6.4e−31 |

| Protein name | Locus Name | Acc# |
|---|---|---|
|  | gp:PIGUFMR | M30284 |

Description

Pig uteroferrin mRNA, complete cds.

| ORF Name | NTID | AAID | NT Length | AA Length | Score | Probability |
|---|---|---|---|---|---|---|
| 834393_f1_1 | 5118 | 10340 | 163 | 492 | 407 | 6.5e−38 |

| Protein name | Locus Name | Acc# |
|---|---|---|
| hypothetical protein | pir:S76672 | S76672 |

Description

| ORF Name | NTID | AAID | NT Length | AA Length | Score | Probability |
|---|---|---|---|---|---|---|
| 1987750_f2_4 | 5119 | 10341 | 333 | 1002 |  |  |

| Protein name | Locus Name | Acc# |
|---|---|---|

Description

NO-HIT

| ORF Name | NTID | AAID | NT Length | AA Length | Score | Probability |
|---|---|---|---|---|---|---|
| 23704675_c3_10 | 5120 | 10342 | 300 | 903 | 1106 | 5.5e−112 |

| Protein name | Locus Name | Acc# |
|---|---|---|
| heat shock protein 60 | gp:BFO6516 | AJ006516 |

Description

*Bacteroides forsythus* groEL gene, strain ATCC 43037.

| ORF Name | NTID | AAID | NT Length | AA Length | Score | Probability |
|---|---|---|---|---|---|---|
| 4022312_c3_9 | 5121 | 10343 | 93 | 282 | 393 | 2.0e−36 |

| Protein name | Locus Name | Acc# |
|---|---|---|
|  | sp:CH10_PORGI | P42376 |

Description

10 KD CHAPERONIN (PROTEIN CPN10) (PROTEIN GROES)

-continued

| ORF Name | NTID | AAID | NT Length | AA Length | Score | Probability |
|---|---|---|---|---|---|---|
| 10394667_f2_16 | 5122 | 10344 | 123 | 372 | | |
| Protein name | | | | Locus Name | | Acc# |

Description

NO-HIT

| ORF Name | NTID | AAID | NT Length | AA Length | Score | Probability |
|---|---|---|---|---|---|---|
| 14496030_f1_8 | 5123 | 10345 | 227 | 684 | | |
| Protein name | | | | Locus Name | | Acc# |

Description

NO-HIT

| ORF Name | NTID | AAID | NT Length | AA Length | Score | Probability |
|---|---|---|---|---|---|---|
| 15742327_c2_71 | 5124 | 10346 | 60 | 183 | | |
| Protein name | | | | Locus Name | | Acc# |

Description

NO-HIT

| ORF Name | NTID | AAID | NT Length | AA Length | Score | Probability |
|---|---|---|---|---|---|---|
| 19562800_f2_14 | 5125 | 10347 | 327 | 984 | | |
| Protein name | | | | Locus Name | | Acc# |

Description

NO-HIT

| ORF Name | NTID | AAID | NT Length | AA Length | Score | Probability |
|---|---|---|---|---|---|---|
| 19814057_f1_7 | 5126 | 10348 | 224 | 675 | | |
| Protein name | | | | Locus Name | | Acc# |

Description

NO-HIT

| ORF Name | NTID | AAID | NT Length | AA Length | Score | Probability |
|---|---|---|---|---|---|---|
| 23438557_f1_13 | 5127 | 10349 | 397 | 1194 | | |
| Protein name | | | | Locus Name | | Acc# |

Description

NO-HIT

| ORF Name | NTID | AAID | NT Length | AA Length | Score | Probability |
|---|---|---|---|---|---|---|
| 23554057_f1_10 | 5128 | 10350 | 75 | 228 | 71 | 0.039 |
| Protein name | | | | Locus Name | | Acc# |
| | | | | sp:UCRH_YEAST | | P00127 |

Description (MITOCHRONDRIAL HINGE PROTEIN) (COMPLEX III POLYPEPTIDE VI)

-continued

| ORF Name | NTID | AAID | NT Length | AA Length | Score | Probability |
|---|---|---|---|---|---|---|
| 24024067_f1_5 | 5129 | 10351 | 810 | 2433 | 224 | 2.5e−28 |
| Protein name | | | Locus Name | | | Acc# |
| | | | gp:BFU63096 | | | U63096 |

Description

*Bacteroides fragilis* (bctA) gene, complete cds.

| ORF Name | NTID | AAID | NT Length | AA Length | Score | Probability |
|---|---|---|---|---|---|---|
| 24398917_f3_50 | 5130 | 10352 | 193 | 582 | 304 | 5.4e−27 |
| Protein name | | | Locus Name | | | Acc# |
| conserved hypothetical protein | | | pir:G72380 | | | G72380 |

Description

| ORF Name | NTID | AAID | NT Length | AA Length | Score | Probability |
|---|---|---|---|---|---|---|
| 24648436_f1_3 | 5131 | 10353 | 204 | 615 | | |
| Protein name | | | Locus Name | | | Acc# |

Description

NO-HIT

| ORF Name | NTID | AAID | NT Length | AA Length | Score | Probability |
|---|---|---|---|---|---|---|
| 253783_c1_64 | 5132 | 10354 | 73 | 222 | | |
| Protein name | | | Locus Name | | | Acc# |

Description

NO-HIT

| ORF Name | NTID | AAID | NT Length | AA Length | Score | Probability |
|---|---|---|---|---|---|---|
| 25442675_f1_4 | 5133 | 10355 | 140 | 423 | | |
| Protein name | | | Locus Name | | | Acc# |

Description

NO-HIT

| ORF Name | NTID | AAID | NT Length | AA Length | Score | Probability |
|---|---|---|---|---|---|---|
| 25633287_f1_9 | 5134 | 10356 | 62 | 189 | | |
| Protein name | | | Locus Name | | | Acc# |

Description

NO-HIT

| ORF Name | NTID | AAID | NT Length | AA Length | Score | Probability |
|---|---|---|---|---|---|---|
| 25633312_f3_47 | 5135 | 10357 | 434 | 1305 | | |
| Protein name | | | Locus Name | | | Acc# |

Description

NO-HIT

-continued

| ORF Name | NTID | AAID | NT Length | AA Length | Score | Probability |
|---|---|---|---|---|---|---|
| 26568908_f3_30 | 5136 | 10358 | 154 | 465 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 26758568_f3_43 | 5137 | 10359 | 283 | 852 | 94 | 0.045 |

| Protein name | | | | Locus Name | | Acc# |
|---|---|---|---|---|---|---|
| H+-transporting ATP synthase, protein 6 | | | | pir:T11121 | | T11121 |

Description

| ORF Name | NTID | AAID | NT Length | AA Length | Score | Probability |
|---|---|---|---|---|---|---|
| 26854156_f1_2 | 5138 | 10360 | 548 | 1647 | 143 | 7.1e−06 |

| Protein name | | | | Locus Name | | Acc# |
|---|---|---|---|---|---|---|
| hypothetical protein H02F09.3 | | | | pir:T33369 | | T33369 |

Description

| ORF Name | NTID | AAID | NT Length | AA Length | Score | Probability |
|---|---|---|---|---|---|---|
| 32066943_c1_62 | 5139 | 10361 | 148 | 447 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 32069681_f3_45 | 5140 | 10362 | 204 | 615 | 78 | 0.014 |

| Protein name | | | | Locus Name | | Acc# |
|---|---|---|---|---|---|---|
| ATP synthase, subunit F | | | | pir:H69227 | | H69227 |

Description

| ORF Name | NTID | AAID | NT Length | AA Length | Score | Probability |
|---|---|---|---|---|---|---|
| 32229662_f1_6 | 5141 | 10363 | 177 | 534 | 108 | 5.4e−05 |

| Protein name | | | | Locus Name | | Acc# |
|---|---|---|---|---|---|---|
| | | | | sp:YPI6_CLOPE | | P18017 |

Description

HYPOTHETICAL 19.7 KD PROTEIN (ORF6)

-continued

| ORF Name | NTID | AAID | NT Length | AA Length | Score | Probability |
|---|---|---|---|---|---|---|
| 4409433_c3_95 | 5142 | 10364 | 151 | 456 | 85 | 0.049 |

| Protein name | Locus Name | Acc# |
|---|---|---|
| ORF MSV223 hypothetical protein | gp:AF063866 | AF063866 |

Description

*Melanoplus sanguinipes* entomopoxvirus, complete genome.

| ORF Name | NTID | AAID | NT Length | AA Length | Score | Probability |
|---|---|---|---|---|---|---|
| 831463_c1_56 | 5143 | 10365 | 217 | 654 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 23612512_c2_5 | 5144 | 10366 | 204 | 615 | 141 | 9.2e−08 |

| Protein name | Locus Name | Acc# |
|---|---|---|
| integrase IntN1 | gp:BUU51917 | U51917 |

Description

*Bacteroides uniformis* insertion element NBU1 fragment, integrase IntN1 gene, complete cds.

| ORF Name | NTID | AAID | NT Length | AA Length | Score | Probability |
|---|---|---|---|---|---|---|
| 24219066_f3_2 | 5145 | 10367 | 71 | 216 | 52 | 0.015 |

| Protein name | Locus Name | Acc# |
|---|---|---|
| | sp:G3P_SCHMA | P20287 |

Description

LARVAL SURFACE ANTIGEN) (P-37)

| ORF Name | NTID | AAID | NT Length | AA Length | Score | Probability |
|---|---|---|---|---|---|---|
| 4103388_c3_9 | 5146 | 10368 | 79 | 240 | 62 | 0.0027 |

| Protein name | Locus Name | Acc# |
|---|---|---|
| neuroendocrine protein 7B2 | pir:S03938 | S03938 |

Description

| ORF Name | NTID | AAID | NT Length | AA Length | Score | Probability |
|---|---|---|---|---|---|---|
| 4960925_c3_10 | 5147 | 10369 | 150 | 450 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 5255160_c1_4 | 5148 | 10370 | 72 | 219 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 5266880_c2_7 | 5149 | 10371 | 205 | 615 | 276 | 1.1e−23 |

| Protein name | | | | Locus Name | | Acc# |
|---|---|---|---|---|---|---|
| methyl transferase | | | | gp:STRMTR | | L29323 |

Description

*Streptococcus pneumoniae* methyl transferase gene cluster, complete sequence.

| ORF Name | NTID | AAID | NT Length | AA Length | Score | Probability |
|---|---|---|---|---|---|---|
| 2812785_c2_6 | 5150 | 10372 | 276 | 828 | 286 | 3.8e−24 |

| Protein name | | | | Locus Name | | Acc# |
|---|---|---|---|---|---|---|
| | | | | sp:BGAL_HUMAN | | P16278 |

Description

GALACTOSIDASE)

| ORF Name | NTID | AAID | NT Length | AA Length | Score | Probability |
|---|---|---|---|---|---|---|
| 5867213_c1_4 | 5151 | 10373 | 217 | 654 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 13085162_f2_14 | 5152 | 10374 | 362 | 1089 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 20082962_f2_13 | 5153 | 10375 | 205 | 618 | 384 | 1.3e−34 |

| Protein name | | | | Locus Name | | Acc# |
|---|---|---|---|---|---|---|
| beta-glucosidase | | | | gp:RAU92808 | | U92808 |

Description

*Ruminococcus albus* beta-glucosidase (gluA) mRNA, complete cds.

-continued

| ORF Name | NTID | AAID | NT Length | AA Length | Score | Probability |
|---|---|---|---|---|---|---|
| 24644575_c1_33 | 5154 | 10376 | 292 | 879 | 227 | 2.6e−18 |

| Protein name | Locus Name | Acc# |
|---|---|---|
| | sp:YIBP_ECOLI | P37690 |

Description

HYPOTHETICAL 46.6 KD PROTEIN IN SECB-TDH INTERGENIC REGION

| ORF Name | NTID | AAID | NT Length | AA Length | Score | Probability |
|---|---|---|---|---|---|---|
| 4476427_c1_34 | 5155 | 10377 | 1050 | 3153 | 334 | 3.3e−26 |

| Protein name | Locus Name | Acc# |
|---|---|---|
| bZIP histidine kinase | gp:PPUY18245 | Y18245 |

Description

*Pseudomonas putida* todX, todF, todC1, todC2, todB, todA, todD, todE, todG, todI, todH, todS, todT genes.

| ORF Name | NTID | AAID | NT Length | AA Length | Score | Probability |
|---|---|---|---|---|---|---|
| 5275033_c2_40 | 5156 | 10378 | 301 | 906 | 232 | 2.3e−19 |

| Protein name | Locus Name | Acc# |
|---|---|---|
| response regulator DrrA | pir:D72228 | D72228 |

Description

| ORF Name | NTID | AAID | NT Length | AA Length | Score | Probability |
|---|---|---|---|---|---|---|
| 7129666_f1_1 | 5157 | 10379 | 649 | 1950 | 914 | 1.2e−91 |

| Protein name | Locus Name | Acc# |
|---|---|---|
| | sp:BGLS_AGRTU | P27034 |

Description

GLUCOSIDE GLUCOHYDROLASE)

| ORF Name | NTID | AAID | NT Length | AA Length | Score | Probability |
|---|---|---|---|---|---|---|
| 10251900_c1_94 | 5158 | 10380 | 216 | 651 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 10662758_f1_22 | 5159 | 10381 | 183 | 552 | 271 | 1.7e−23 |

| Protein name | Locus Name | Acc# |
|---|---|---|
| | gp:ATAC006202 | AC006202 |

Description

*Arabidopsis thaliana* chromosome II BAC T3B23 genomic sequence, complete sequence.

-continued

| ORF Name | NTID | AAID | NT Length | AA Length | Score | Probability |
|---|---|---|---|---|---|---|
| 10962692_c2_116 | 5160 | 10382 | 194 | 585 | 96 | 0.0022 |

| Protein name | Locus Name | Acc# |
|---|---|---|
| hypothetical protein c04040 | pir:S75406 | S75406 |

Description

| ORF Name | NTID | AAID | NT Length | AA Length | Score | Probability |
|---|---|---|---|---|---|---|
| 12194150_f2_41 | 5161 | 10383 | 235 | 708 | 131 | 3.9e−10 |

| Protein name | Locus Name | Acc# |
|---|---|---|
| | sp:YS29_MYCTU | P71786 |

Description

HYPOTHETICAL 27.1 KD PROTEIN CY277.29C

| ORF Name | NTID | AAID | NT Length | AA Length | Score | Probability |
|---|---|---|---|---|---|---|
| 12687826_f1_16 | 5162 | 10384 | 413 | 1242 | 1308 | 2.2e−133 |

| Protein name | Locus Name | Acc# |
|---|---|---|
| | sp:UXUA_HAEIN | P44488 |

Description

MANNONATE DEHYDRATASE, (D-MANNONATE HYDROLASE)

| ORF Name | NTID | AAID | NT Length | AA Length | Score | Probability |
|---|---|---|---|---|---|---|
| 14588387_c3_163 | 5163 | 10385 | 93 | 282 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 178405_f1_19 | 5164 | 10386 | 131 | 396 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 20593760_f3_62 | 5165 | 10387 | 254 | 765 | 228 | 6.2e−28 |

| Protein name | Locus Name | Acc# |
|---|---|---|
| dihydrodipicolinate reductase | pir:A72246 | A72246 |

Description

-continued

| ORF Name | NTID | AAID | NT Length | AA Length | Score | Probability |
|---|---|---|---|---|---|---|
| 21897192_f1_24 | 5166 | 10388 | 324 | 975 | 215 | 3.8e−16 |

| Protein name | Locus Name | Acc# |
|---|---|---|
| hypothetical protein 7 | pir:S20799 | |

Description

| ORF Name | NTID | AAID | NT Length | AA Length | Score | Probability |
|---|---|---|---|---|---|---|
| 2225275_c2_120 | 5167 | 10389 | 61 | 186 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 22381561_f3_59 | 5168 | 10390 | 411 | 1236 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 22851526_f1_6 | 5169 | 10391 | 528 | 1587 | 1117 | 3.8e−113 |

| Protein name | Locus Name | Acc# |
|---|---|---|
| hypothetical protein mexF | pir:T30830 | T30830 |

Description

| ORF Name | NTID | AAID | NT Length | AA Length | Score | Probability |
|---|---|---|---|---|---|---|
| 24005316_f1_15 | 5170 | 10392 | 284 | 855 | 696 | 1.5e−68 |

| Protein name | Locus Name | Acc# |
|---|---|---|
| oxidoreductase | gp:NOSHRMA | L37087 |

Description

*Nostoc* sp. ATCC 29133 oxidoreductase (hrmU) and HrmA (hrmA) genes, complete cds.

| ORF Name | NTID | AAID | NT Length | AA Length | Score | Probability |
|---|---|---|---|---|---|---|
| 24225682_f1_5 | 5171 | 10393 | 394 | 1185 | 493 | 5.0e−47 |

| Protein name | Locus Name | Acc# |
|---|---|---|
| | sp:YHIU_ECOLI | P37636 |

Description

PRECURSOR

-continued

| ORF Name | NTID | AAID | NT Length | AA Length | Score | Probability |
|---|---|---|---|---|---|---|
| 24509680_f2_40 | 5172 | 10394 | 312 | 939 | 152 | 7.8e−16 |

| Protein name | Locus Name | Acc# |
|---|---|---|
| prokaryotic type I signal peptidase SipF | gp:AF065159 | AF065159 |

Description

*Bradyrhizobium japonicum* putative arylsulfatase (arsA), putative soluble lytic transglycosylase precursor (sltA), dihydrodipicolinate synthase (dapA), MscL (mscL), SmpB (smpB), BcpB (bcpB), RnpO (rnpO), RelA/SpoT homolog (relA), PdxJ (pdxJ), and acyl carrier protein synthase AcpS (acpS) genes, complete cds; prokaryotic type I signal peptidase SipF (sipF) gene, sipF-sipS allele,

| ORF Name | NTID | AAID | NT Length | AA Length | Score | Probability |
|---|---|---|---|---|---|---|
| 24615787_f1_7 | 5173 | 10395 | 491 | 1476 | 503 | 4.4e−48 |

| Protein name | Locus Name | Acc# |
|---|---|---|
| OprM | gp:AB011381 | AB011381 |

Description

*Pseudomonas aeruginosa* gene for OprM, complete cds.

| ORF Name | NTID | AAID | NT Length | AA Length | Score | Probability |
|---|---|---|---|---|---|---|
| 24651437_f3_60 | 5174 | 10396 | 312 | 939 | 247 | 5.9e−21 |

| Protein name | Locus Name | Acc# |
|---|---|---|
| conserved hypothetical protein | pir:H72417 | H72417 |

Description

| ORF Name | NTID | AAID | NT Length | AA Length | Score | Probability |
|---|---|---|---|---|---|---|
| 25820437_f3_56 | 5715 | 10397 | 564 | 1695 | 827 | 9.8e−85 |

| Protein name | Locus Name | Acc# |
|---|---|---|
| hypothetical protein mexF | pir:T30830 | T30830 |

Description

| ORF Name | NTID | AAID | NT Length | AA Length | Score | Probability |
|---|---|---|---|---|---|---|
| 26360717_c1_109 | 5176 | 10398 | 208 | 627 | 321 | 8.5e−29 |

| Protein name | Locus Name | Acc# |
|---|---|---|
| phosphoglycolate phosphatase (gph) homolog | pir:C70184 | C70184 |

Description

| ORF Name | NTID | AAID | NT Length | AA Length | Score | Probability |
|---|---|---|---|---|---|---|
| 26617128_f2_47 | 5177 | 10399 | 171 | 516 | 354 | 2.7e−32 |

| Protein name | Locus Name | Acc# |
|---|---|---|
| polysialic acid capsule expression protein | pir:B70434 | B70434 |

Description

-continued

| ORF Name | NTID | AAID | NT Length | AA Length | Score | Probability |
|---|---|---|---|---|---|---|
| 26678200_f2_27 | 5178 | 10400 | 1030 | 3093 | 1827 | 2.2e−188 |
| Protein name | | | Locus Name | | | Acc# |
| beta-galactosidase | | | gp:AF055482 | | | AF055482 |

Description

*Thermotoga neapolitana* galactose utilization operon, complete sequence.

| ORF Name | NTID | AAID | NT Length | AA Length | Score | Probability |
|---|---|---|---|---|---|---|
| 3001251_c1_93 | 5179 | 10401 | 450 | 1353 | | |
| Protein name | | | Locus Name | | | Acc# |

Description

NO-HIT

| ORF Name | NTID | AAID | NT Length | AA Length | Score | Probability |
|---|---|---|---|---|---|---|
| 33593963_c2_136 | 5180 | 10402 | 74 | 225 | | |
| Protein name | | | Locus Name | | | Acc# |

Description

NO-HIT

| ORF Name | NTID | AAID | NT Length | AA Length | Score | Probability |
|---|---|---|---|---|---|---|
| 33625658_f2_30 | 5181 | 10403 | 275 | 828 | 453 | 8.7e−43 |
| Protein name | | | Locus Name | | | Acc# |
| | | | sp:LPXA_ECOLI | | | |

Description (EC 2.3.1.129) (UDP-N-ACETYLGLUCOSAMINE ACYLTRANSFERASE)

| ORF Name | NTID | AAID | NT Length | AA Length | Score | Probability |
|---|---|---|---|---|---|---|
| 34022832_c3_147 | 5182 | 10404 | 433 | 1302 | 508 | 1.3e−48 |
| Protein name | | | Locus Name | | | Acc# |
| | | | sp:YMXG_BACSU | | | Q04805 |

Description

HYPOTHETICAL PROCESSING PROTEASE, (ORFP)

| ORF Name | NTID | AAID | NT Length | AA Length | Score | Probability |
|---|---|---|---|---|---|---|
| 4484712_f1_14 | 5183 | 10405 | 498 | 1497 | 173 | 1.5e−21 |
| Protein name | | | Locus Name | | | Acc# |
| | | | sp:LEP_SALTY | | | P23697 |

Description

SIGNAL PEPTIDASE I, (SPASE I) (LEADER PEPTIDASE I)

-continued

| ORF Name | NTID | AAID | NT Length | AA Length | Score | Probability |
|---|---|---|---|---|---|---|
| 549091_c3_174 | 5184 | 10406 | 112 | 339 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 6035675_f2_49 | 5185 | 10407 | 371 | 1116 | 295 | 4.8e−26 |

| Protein name | | | | Locus Name | | Acc# |
|---|---|---|---|---|---|---|
| protein-tyrosine phosphatase | | | | gp:AB028630 | | AB028630 |

Description

*Clostridium perfringens* hyp27, bacH, ptp, cpd genes for hypothetical protein, bacterial hemoglobin, protein-tyrosine phosphatase, 2', 3'-cuclic nucleotide 2'-phosphodiesterase, partial and complete cds.

| ORF Name | NTID | AAID | NT Length | AA Length | Score | Probability |
|---|---|---|---|---|---|---|
| 6837782_c1_96 | 5186 | 10408 | 214 | 645 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 84790_f3_73 | 5187 | 10409 | 485 | 1455 | 880 | 4.9e−88 |

| Protein name | Locus Name | Acc# |
|---|---|---|
| ATP-dependent RNA helicase homolog ydbR | pir:D69772 | D69772 |

Description

| ORF Name | NTID | AAID | NT Length | AA Length | Score | Probability |
|---|---|---|---|---|---|---|
| 12402186_c3_12 | 5188 | 10410 | 144 | 432 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 15628378_c1_8 | 5189 | 10411 | 375 | 1128 | 356 | 4.5e−32 |

| Protein name | Locus Name | Acc# |
|---|---|---|
| histidine kinase | gp:AF114442 | AF114442 |

Description

*Nostoc punctiforme* histidine kinase (hepK) gene, complete cds.

-continued

| ORF Name | NTID | AAID | NT Length | AA Length | Score | Probability |
|---|---|---|---|---|---|---|
| 23633456_c3_10 | 5190 | 10412 | 124 | 375 | 302 | 2.6e−26 |

| Protein name | | | | Locus Name | | Acc# |
|---|---|---|---|---|---|---|
| 2,3-bisphosphoglycerate-independent | | | | gp:AF120091 | | AF120091 |

Description

*Bacillus stearothermophilus* 2,3-bisphosphoglycerate-independentphosphoglycerate mutase (pgm) gene, complete cds.

| ORF Name | NTID | AAID | NT Length | AA Length | Score | Probability |
|---|---|---|---|---|---|---|
| 10554662_f3_32 | 5191 | 10413 | 186 | 561 | 212 | 3.0e−17 |

| Protein name | | | | Locus Name | | Acc# |
|---|---|---|---|---|---|---|
| | | | | sp:YP20_BACLI | | P05332 |

Description

HYPOTHETICAL P20 PROTEIN

| ORF Name | NTID | AAID | NT Length | AA Length | Score | Probability |
|---|---|---|---|---|---|---|
| 11777161_c3_65 | 5192 | 10414 | 65 | 198 | | |

| Protein name | | | | Locus Name | | Acc# |
|---|---|---|---|---|---|---|

Description

NO-HIT

| ORF Name | NTID | AAID | NT Length | AA Length | Score | Probability |
|---|---|---|---|---|---|---|
| 14648512_f3_34 | 5193 | 10415 | 115 | 348 | 280 | 1.9e−24 |

| Protein name | | | | Locus Name | | Acc# |
|---|---|---|---|---|---|---|
| hypothetical protein MTH1452 | | | | pir:D69060 | | D69060 |

Description

| ORF Name | NTID | AAID | NT Length | AA Length | Score | Probability |
|---|---|---|---|---|---|---|
| 16676505_c2_62 | 5194 | 10416 | 404 | 1215 | 226 | 2.7e−16 |

| Protein name | | | | Locus Name | | Acc# |
|---|---|---|---|---|---|---|
| probable hydrolase | | | | pir:T37132 | | T37132 |

Description

| ORF Name | NTID | AAID | NT Length | AA Length | Score | Probability |
|---|---|---|---|---|---|---|
| 16832885_f3_43 | 5195 | 10417 | 310 | 933 | 1023 | 3.5e−103 |

| Protein name | | | | Locus Name | | Acc# |
|---|---|---|---|---|---|---|
| hypothetical protein | | | | pir:JQ1020 | | JQ1020 |

Description

-continued

| ORF Name | NTID | AAID | NT Length | AA Length | Score | Probability |
|---|---|---|---|---|---|---|
| 19610637_f1_6 | 5196 | 10418 | 229 | 690 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 19728433_c1_49 | 5197 | 10419 | 429 | 1290 | 244 | 4.2e−18 |

| Protein name | | | | Locus Name | | Acc# |
|---|---|---|---|---|---|---|
| DNA damage-inducible protein. PAB1438 | | | | pir:C75053 | | C75053 |

Description

| ORF Name | NTID | AAID | NT Length | AA Length | Score | Probability |
|---|---|---|---|---|---|---|
| 22860128_f1_8 | 5198 | 10420 | 83 | 252 | 64 | 0.031 |

| Protein name | | | | Locus Name | | Acc# |
|---|---|---|---|---|---|---|
| | | | | sp:SPRC_XENLA | | P36378 |

Description (OSTEONECTIN) (ON) (BASEMENT MEMBRANE PROTEIN BM-40)

| ORF Name | NTID | AAID | NT Length | AA Length | Score | Probability |
|---|---|---|---|---|---|---|
| 23601000_f1_3 | 5199 | 10421 | 84 | 255 | 75 | 0.039 |

| Protein name | | | | Locus Name | | Acc# |
|---|---|---|---|---|---|---|
| FAA | | | | gp:AC005565 | | AC005565 |

Description

*Homo sapiens* chromosome 16, cosmid clone 444B9 (LANL), complete sequence.

| ORF Name | NTID | AAID | NT Length | AA Length | Score | Probability |
|---|---|---|---|---|---|---|
| 24410687_c2_63 | 5200 | 10422 | 231 | 696 | | |

| Protein name | | | | Locus Name | | Acc# |
|---|---|---|---|---|---|---|
| | | | | | | |

Description

NO-HIT

| ORF Name | NTID | AAID | NT Length | AA Length | Score | Probability |
|---|---|---|---|---|---|---|
| 24415902_f2_18 | 5201 | 10423 | 630 | 1893 | | |

| Protein name | | | | Locus Name | | Acc# |
|---|---|---|---|---|---|---|
| | | | | | | |

Description

NO-HIT

-continued

| ORF Name | NTID | AAID | NT Length | AA Length | Score | Probability |
|---|---|---|---|---|---|---|
| 24625311_f3_42 | 5202 | 10424 | 277 | 834 | 1272 | 1.4e−129 |

| Protein name | Locus Name | Acc# |
|---|---|---|
| 7-alpha-hydroxysteroid dehydrogenase | gp:AF173833 | AF173833 |

Description

*Bacteroides fragilis* 7-alpha-hydroxysteroid dehydrogenase (hdhA) gene, complete cds.

| ORF Name | NTID | AAID | NT Length | AA Length | Score | Probability |
|---|---|---|---|---|---|---|
| 24726537_f3_39 | 5203 | 10425 | 71 | 216 | 56 | 0.021 |

| Protein name | Locus Name | Acc# |
|---|---|---|
| hypothetical protein C0510w | pir:T18460 | T18460 |

Description

| ORF Name | NTID | AAID | NT Length | AA Length | Score | Probability |
|---|---|---|---|---|---|---|
| 25600250_c2_57 | 5204 | 10426 | 320 | 963 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 26305349_c1_44 | 5205 | 10427 | 90 | 273 | 156 | 3.5e−10 |

| Protein name | Locus Name | Acc# |
|---|---|---|
| | sp:FEOB_METJA | Q57986 |

Description

FERROUS IRON TRANSPORT PROTEIN B HOMOLOG

| ORF Name | NTID | AAID | NT Length | AA Length | Score | Probability |
|---|---|---|---|---|---|---|
| 26595317_c2_59 | 5206 | 10428 | 156 | 471 | 302 | 8.7e−27 |

| Protein name | Locus Name | Acc# |
|---|---|---|
| hypothetical protein SCI30A.19 | pir:T36799 | T36799 |

Description

| ORF Name | NTID | AAID | NT Length | AA Length | Score | Probability |
|---|---|---|---|---|---|---|
| 36150277_f1_5 | 5207 | 10429 | 286 | 861 | 199 | 6.9e−15 |

| Protein name | Locus Name | Acc# |
|---|---|---|
| transcription regulator AraC/XylS family homolog ydeE | pir:G69777 | G69777 |

Description

-continued

| ORF Name | NTID | AAID | NT Length | AA Length | Score | Probability |
|---|---|---|---|---|---|---|
| 4953387_c2_58 | 5208 | 10430 | 134 | 405 | 279 | 2.4e−24 |

| Protein name | Locus Name | Acc# |
|---|---|---|
| | sp:YUXK_BACSU | |

Description

HYPOTHETICAL 15.7 KD PROTEIN IN PBPD-COMA INTERGENIC REGION (ORF2)

| ORF Name | NTID | AAID | NT Length | AA Length | Score | Probability |
|---|---|---|---|---|---|---|
| 6048462_f3_35 | 5209 | 10431 | 245 | 738 | 573 | 1.7e−55 |

| Protein name | Locus Name | Acc# |
|---|---|---|
| | sp:UNG_HUMAN | P13051 |

Description

URACIL-DNA GLYCOSYLASE PRECURSOR, (UDG)

| ORF Name | NTID | AAID | NT Length | AA Length | Score | Probability |
|---|---|---|---|---|---|---|
| 6053437_c3_71 | 5210 | 10432 | 1062 | 3189 | 564 | 2.2e−87 |

| Protein name | Locus Name | Acc# |
|---|---|---|
| 115 K outer membrane protein precursor:SusC protein | pir:JC6027 | JC6027 |

Description

| ORF Name | NTID | AAID | NT Length | AA Length | Score | Probability |
|---|---|---|---|---|---|---|
| 6735841_f2_25 | 5211 | 10433 | 105 | 318 | 444 | 7.8e−42 |

| Protein name | Locus Name | Acc# |
|---|---|---|
| hypothetical protein | pir:JQ1020 | JQ1020 |

Description

| ORF Name | NTID | AAID | NT Length | AA Length | Score | Probability |
|---|---|---|---|---|---|---|
| 6837837_c2_60 | 5212 | 10434 | 246 | 741 | 285 | 5.5e−25 |

| Protein name | Locus Name | Acc# |
|---|---|---|
| | sp:YTFE_HAEIN | P45312 |

Description

HYPOTHETICAL PROTEIN HI1677

| ORF Name | NTID | AAID | NT Length | AA Length | Score | Probability |
|---|---|---|---|---|---|---|
| 24417250_f3_7 | 5213 | 10435 | 67 | 204 | 79 | 0.029 |

| Protein name | Locus Name | Acc# |
|---|---|---|
| OmpK37 porin | gp:KPN011502 | AJ011502 |

Description

*Klebsiella pneumoniae* (strain SD8) ompK37 gene.

-continued

| ORF Name | NTID | AAID | NT Length | AA Length | Score | Probability |
|---|---|---|---|---|---|---|
| 6725192_f3_6 | 5214 | 10436 | 815 | 2448 | 159 | 3.1e−12 |

| Protein name | Locus Name | Acc# |
|---|---|---|
| colicin I receptor | gp:ECOCIR | |

Description

*E. coli* colicin I receptor gene, complete cds.

| ORF Name | NTID | AAID | NT Length | AA Length | Score | Probability |
|---|---|---|---|---|---|---|
| 2006400_f2_5 | 5215 | 10437 | 74 | 225 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 3218942_f1_1 | 5216 | 10438 | 134 | 405 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 34408328_f2_4 | 5217 | 10439 | 399 | 1200 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 4179002_f3_9 | 5218 | 10440 | 144 | 435 | | |

| Protein name | Locus Name | Acc# |
|---|---|---|
| | | |

Description

NO-HIT

| ORF Name | NTID | AAID | NT Length | AA Length | Score | Probability |
|---|---|---|---|---|---|---|
| 15625252_f1_1 | 5219 | 10441 | 253 | 762 | | |

| Protein name | Locus Name | Acc# |
|---|---|---|
| | | |

Description

NO-HIT

-continued

| ORF Name | NTID | AAID | NT Length | AA Length | Score | Probability |
|---|---|---|---|---|---|---|
| 2772937_f1_2 | 5220 | 10442 | 360 | 1083 | 526 | 1.4e−51 |

| Protein name | Locus Name | Acc# |
|---|---|---|
| 115 K outer membrane protein precursor:SusC protein | pir:JC6027 | JC6027 |

Description

| ORF Name | NTID | AAID | NT Length | AA Length | Score | Probability |
|---|---|---|---|---|---|---|
| 35351583_c1_3 | 5221 | 10443 | 71 | 216 | | |

| Protein name | Locus Name | Acc# |
|---|---|---|

Description

NO-HIT

| ORF Name | NTID | AAID | NT Length | AA Length | Score | Probability |
|---|---|---|---|---|---|---|
| 363038302_c3_12 | 5222 | 10444 | 752 | 2256 | 148 | 5.9e−07 |

| Protein name | Locus Name | Acc# |
|---|---|---|
| conserved hypothetical protein yknZ | pir:E69858 | E69858 |

Description

SEQUENCE LISTING (10444 sequences)

SEQ ID NO: 1 - DNA, 420 bp, B.fragilis
aacaaggaacggttcaggaccatcttccaccaggagacgaacgatcagaccaaagcggtacacttcctgctcgaccaaggcaaaaaaacaatcatcctcgtgggtgcaaccggtaaacgggaagaccataccctgggaaacatcagtctgctgatagactatatgaaagcaggagcgcaggtaacgatgctgacggaccacggaatgtttattccggcatcggggcggaactgtttcaagtcatatcccggacagcaaatctccatcttcaacttcaacgccaccggactgagggccgatgggctggtatatccgctcagtgacttcagtaactggtggcagggtacgctgaacgaagcgacaggcaccgaatttacgatccatgcggagggagactacttggtttatctgaattactga

SEQ ID NO: 2 - DNA, 1836 bp, B.fragilis
agccaccgttcgatacttccagccccgtggggaagacagacgacaggttttgagacggcagccgtccagaaatcggtaagcgtactccccacacaaacttactacacgtttacttgcggtccggtggaactggacctggtgtttaccgcacctttgatgatggacgacctcgatttgttgtctactcccgttaattatatttcttaccgcgttcgttcgctggacaaaaagcaacatgatgtgcagatgtatgtggagaccaccccgcagcttgccatcaatgaactgacgcaacctacccgttcgaaagtgatccgccgtaacggtatcaattatgtacaggcagggactatcgaccagcctatcctcgcacgaaaaggagacggtatctgtattgattggggatatgcttatctggcaggaaatataggtgccaatacagctgtcagcctgggtaactactatggtatgaagaacgagtttgctaccaagggttctttgttgcctacacaagccgagtgcgtgacccgtcgtgccgaccagatgccggctatggcctatactgacgatctgggtgaagtaggtaccgatggcaaatccggcttcctgatgttgggttacgatgatatttatgctatcgaatacttctatcaacctcgtatggcctactggaagcatgatggtaaggtaagcatcttcgatgcctttgagcgtgccaaagcaaactatgcgtctgtcatggaacgttgccgtgcttacgacgaaatgattctgaacgatgcagaaaaagcaggtggcaaagaatactctgaactgtgtgcattggcttaccgtcaggtgattgccgcccataagctgttcaaggatgcggatggtaacttactcttcttctctaaagagaacaatagtaacggttgtatcaatactgtcgacctgacttatccgtctgctccgctcttcctggcttataaccccgaattgcagaaaggcatgatgaccagtatctttgaatatagtgccagcggacgttggaacaagcctttcccggctcacgacctgggaacttatcctattgctaacggacaggtatacggtggtgacatgccgattgaagaaggcggaaatatggtagtcctggctgctgctattgccaaggtagaaggtaacgccgactatgctaagaagtattgggatttactgaccatttggactgattatctggcggaatacggacaagatcccgagaaccaactctgtactgatgactttgccggacactgggcacataacgccaacctttcggtaaaagcgatcatgggtgtagctgcttacagtgaaatggcccgtatgctcggtatggatgatgtagccgaccgatatgctgccaaagccaaagcaatggctaccaaatgggaacaaatggctcgtgagggtgatcattatcgtctggcattcgaccgtgagaatacctggagccagaagtacaatatggtttgggacaagatgtggaatctgaaccttttccccaataatgtgattgagaaagaaatttcttattatcagaccaaactgcaaaacccttatggacttccgttggattcccgcaaggaatatactaaatccgactggattatgtggactgctgccatgtcttctgataaggctactttcgagaaatttatttctccggtatataagtatgctaatgaaaccgtatcacgtgttccgctgagcgactggcatcataccgatagcggtaagtttgtcggtttcaaggcacgttccgtgatcggtggttattggatgaaggtattaatggataaaatgcagaagtaa

SEQ ID NO: 3 - DNA, 750 bp, B.fragilis
tgtggtggattatttcgctggcacgtgcttacgaaatcacgaatgacccgaaatacctggcacatgcctcttcgggattctacccatgtctggaaagagtcgtatgataaagaaagggggggcctgtggtggaacttcaagcacgatggaaagatggcttgcatcaactatccgactacggtgggcgccatgactctttataatgtgaccaaagatcccgattatctggaaaaggcaaaaagtgtatatgcatggtcgagggatgtttttttcgacaaggagaaaggccgcatagcagacaatatgcactatcatttccaaagacagaacggtatggacatagactggacaacccaactttataatcaggctacatttatcggttcggccgtgatgctgtacaaagcaaccggcgagaaagcttatctggacgatgccgttctggctgccgactacgtccgcaacgagatgtgtgatgccgatggattgcttccgttcaaaaatggcgtggaacagggaatttatgctgccatctttgcacagtacatcattcgcctgatagaagatggcaatcagccccaatatatggactggcttcgtcacaacatagacgtggcgtggaacaaccgggatgtaaaccgtaatgtgacattcaaggatgcaaccaaaccctgcccgacaggtgtgatggaaagctatgatgccagcggatgtcccgcactgatgcaagtgatttctccattcaaataa

SEQ ID NO: 4 - DNA, 1446 bp, B.fragilis
ctgaaattgtccgtccttattcttgccacgcatcagcttatgctctttatcgtacaggttcttgtagttcatggcacgctgtgcataaacggctatctcctcttcgggcttgttcaaggctttacccaactgatagatgcaccagtcatcataagcatattccagcgtacgggcggcattttcattgatgcctacattataaggtacgtagcccagttgattgtaatattcataaccgagacgtccggtagacgaaacctgcggatgaacagcatttgcaccgtgtttcacagcttcccaaagagtttctatatcgtaacctttcaatcctttcagataggcatcagccactaccgaagcggaattgttacctaccatacagcccctgtgcccgggacttgcccattcgggaaggaatccgctttccttgtaagtatttgccagtccctcctgcatcttttcgttcatcgaaggatacatcaggttgaggaacgggaacaggcagcggaatgtatcccagaaaccggtatcggtaaacatatatcccggcagcactttaccgttgtagggactgtaatgtaccggtttccctttggcatccagttcgtagaagcttctcgggaaaagtaccgaacgatagaggcaagagtagaatgtacggagatgatcggtattatcgtcttccacctcaatacgtcccagaaccttgttccattcctggcgtcctttggctgcaacagcttccagattgtctttacccaactctttcaagttctgttctgcctgctcggggctgataaaagaagaagccactcgtacgttgaccgtctctccacgacgtgtagagaacccgatgataccacctgcatgtttatctttcgattccagctcacccggacggatgttgccgttggtaactgctgcggtaaaagtgaacggcttatcgaacaccagtacaaaataattcttaaagttctccggcactcctccactgttcttggttgtgtagccgatgatcttgttctcttccggaatcactttcacatacgaaccgttgtcgaaagcatctaccactacataagaatccttactctcaggaaaagtgaaacgaaacatcgccgcacggctggtcggagcaatttcggtcgtgacatcatgatcggccagatatactttataataatacggtttggcaacctcagccttatgcgagaaccagctcgcacgctgatcctgatcgaacacgacctttcccgtaacaggcataatggcaaactgcccgtagtcattaatccacgggctgggctggtgagtctgcttaaatcccctgattttatcggcatcataggtataagcccatccatcacccatctttccggtttgtgccacccagaagttcattccccaaggcatggcaatagccggatatgtatttccggtagataa

SEQ ID NO: 5 - DNA, 2367 bp, B.fragilis
tcatttttcccattgatactgaagattaaaaaaactgtgttagtccgtgtaatctgtggtgaatttaaaactattaatatcatgaagaaattagcgctattacttgttggcgtattgggtactgctttctgcacttttgcaaagagtacgacagaaccggtggattatgtaagcccactggtcggtacccagtcaaagcatgctttatctaccggaaatacatatccggctattgccatgccttggggaatgaacttctgggtggcacaaaccggaaagatgggtgatggatgggcttatacctatgatgccgataaaatcaggggatttaagcagactcaccagcccagcccgtggattaatgactacgggcagtttgccattatgcctgttacgggaaaggtcgtgttcgatcaggatcagcgtgcgagctggttctcgcataaggctgaggttgccaaaccgtattattataaagtatatctggccgatcatgatgtcacgaccgaaattgctccgaccagccgtgcggcgatgtttcgtttcacttttcctgagagtaaggattcttatgtagtggtagatgctttcgacaacggttcgtatgtgaaagtgattccggaagagaacaagatcatcggctacacaaccaagaacagtggaggagtgccggagaactttaagaattattttgtactggtgttcgataagccgttcacttttaccgcagcagttaccaacggcaacatccgtccgggtgagctggaatcgaaagataaacatgcaggtggtatcatcgggttctctacacgtcgtggagagacggtcaacgtacgagtggcttcttcttttatcagccccgagcaggcagaacagaacttgaaagagttgggtaaagacaatctggaagctgttgcagccaaaggacgccaggaatggaacaaggttctgggacgtattgaggtggaagacgataataccgatcatctccgtacattctactcttgcctctatcgttcggtacttttcccgagaagcttctacgaactggatgccaaagggaaaccggtacattacagtccctacaacggtaaagtgctgccgggatatatgtttaccgataccggtttctgggatacattccgctgcctgttcccgttcctcaacctgatgtatccttcgatgaacgaaaagatgcaggagggactggcaaatacttacaaggaaagcggattccttcccgaatgggcaagtcccgggcacaggggctgtatggtaggtaacaattccgcttcggtagtggctgatgcctatctgaaaggattgaaaggttacgatatagaaactctttgggaagctgtgaaacacggtgcaaatgctgttcatccgcaggtttcgtctaccggacgtctcggttatgaatattacaatcaactgggctacgtaccttataatgtaggcatcaatgaaaatgccgcccgtacgctggaatatgcttatgatgactggtgcatctatcagttgggtaaagccttgaacaagcccgaagaggagatagccgtttatgcacagcgtgccatgaactacaagaacctgtacgataaagagcataagctgatgcgtggcaagaataaggacggacaatttcagtcaccgttcaatccgctgaagtggggcgatgccttcaccgaaggaaacagttggcactatacctggtctgtattccatgatcctcagggactgatcgacctgatgggcggacagcaagggttcaatcagatgatggattctgtctttatcctgcctcctgtatttgatgacagctattacggcggtgtgattcacgaaatccgtgaaatgcagattatgaatatgggacagtatgcacacggtaaccaacccatccagcacatgctatatctgtacaattactcgggacaaccgtggaaagcacagcattggattcgtgaagtgatggataaactctatacacccaatgccgacggttattgcggtgacgaagataacggacagacttcggcatggtatgtattttctgctatgggattctatcccgtttgccccggaacggatcagtacgtgatgggtacgccgtacttcaaacagatgaagctgcatctggagaatggcaagaccgtgcagatcagcgcaccgggcaatagcgatgaaaaccgttacattgcgtcaatgaccgtaaacggtaaaacattgactcgcaactacctgacacataaagaactgatgaacggagcgaagattacgatgaaaatgtcgtctactccgaacaaacagcgtggagtacgcgagtcggatttcccgtattcgttctctaaagaggtacgttga

SEQ ID NO: 6 - DNA, 2514 bp, B.fragilis
atggtaaaaactataaaaaaagaatctgaagttatgaagcttaaactatcgactctgttcttgggtgcagctgccatgctgagcagttgtggggcatcgcaggacgtcaagagtgaaaaaagtgagatgcgtgcaccggcctatccgttggtgatgattgacccttacaccagtgcctggtcgtttacggataatctgtatgacggaccggtgaaacactggaccggtaaggacttcccgttcttgggtgttgccaaggtagacggacagatttaccgtttcatgggaacggaagaacttgagctgcttccgctggttaagacctcggaacaaggcagatggacagctaagtatacaacaaagaaaccggctgacggctggcagaatgccgactttaatgatgcggcatggaaagaaggagaaggtgctttcggtactatggagaatgaaagtacagccaagacccagtggggagaagagtatatctggatacgccgtaaagcggatattaaagacaacctgcaaggtaaaaatgtatatctggaatattctcacgacgatgacgccatcatctatgtgaatggcgtgaaggtggtggataccggtaactcggctaaaaaacatatgcttgccaaactgccggaagaggctgtggccgcactgaaacagggagagaacctgattgcaatttactgtaacaaccgtgttgccaacggtctgatcgattgcggtctgttggtagagaaagacaatacacagaactttactcagacagcagtacagaaatcggtagacgtgcaggctatgcagaccaactacgaatttacttgcggaccggtggacttgaaacttgcgttcacttcacctctctttatggataatctcgatttgatgactcgtccggtgagctatcttacctatgaagtggcttcgaatgacggaaataaacataacgtagaactttatttcgaagcaggaccgcagtgggcactcgaccagcctcatcaggaagctgtagccgaaagctttacagaaggtaatttgctatacctcaagacgggaagccgcaaccaggaaatattgggtaaaaagggagatgatgtccgcattgactggggatacttctacatggctgccgataaggagaacagttcatgcgctaccggagagggaaagaccctaagaaagagtttcatcgacggaaaattgacatcatccaagaccgatggaagtgacaagctggcactggttcgctcactgggtgaaacgaagaaagcggaaggacacttgctgctgggttacgatgacttgtactctattcagtatttcggtgaaaatcttcgtccgtactggaaccgcaatggaaacgaaaccattcagtcgcagtttgcgaaagctgataaggaatatgatgcagtgatggataaatgtgctgcattcgatgctaacctgatgaaagaagctactgaagtaggcggacgtaagtatgccgaactctgtgcattggcttatcgccaggcaatcgctgcccacaaattggtggaagcccccaacaaagacctgctgttcctctcaaaagagaacttcagcaacggttcgatcggtacggtggatatcacttatccttctgctcctttgttcctggtatacaatccggaattggcaaaaggtctgatgaaccacatcttctattatagcgaaagcggaaaatggaataagccgttcgctgcacatgatgtaggtacttatccgttggctaacggccagacatacggtggagatatgccgatcgaggaatcgggaaatatgctgatcttgagtgcagccatcgccattgtcgaaggaaatgccgactatgcgcagaaacactgggatgtattgacaacctggaccgattatctggctcaatatgggctcgatccggaaaatcaactttgtacagacgactttgccggacactttgcacacaacgccaacctgtctatcaaagccatcctgggtgtagcgtcttatggctatctggccgataagttaggcaagaaagaagtggctgagaaatatacacagaaagccaaagaaatggctgccgaatgggtgaagatggcagacgacggcgatcactaccgcctgacttttgacaagcccggaacatggagccagaaatacaatctggtatgggataaactgatgaatctgcagatattccctgaaacagttgcacagaaagagatagcttactatcttggcaaacagaatcaatatggattgccgctggataaccgtgaaacttataccaagaccgactggattatgtggactgctacactggcaccggacaaagctacattcgagaagtttatcgatccggtttatctgttcatgaacgagacgaccgatcgcgtgccgatgtccgactgggtatttaccgatcgtccgaaccagagaggtttccaagctcgttcggtagtaggcggatactatatcaagatgcttgagaagaagttgaaaaaataa

SEQ ID NO: 7 - DNA, 1221 bp, B.fragilis
tttgtccttttgttcatctgtctaaaaaaactcagtgggactccgtgtcgctctgtggtgaataaaactcaaaacagtttaataatgagaaaattagctatgtgggcactgggtgccctctttgtagccggttgtgcagagacagaaaaggctactacggattccggtttggtaaagagcaatttccagactgaggtgggcggaaagaaaaccgatttgtatgtactccgtaatcagaacaacatggaggtttgcgtcactaattttggaggacgtattgtttcggtaatggttcccgataaagaaggggtgatgcgtgatgtagtgttgggcttcgactctattcaggattacatcagcaagccttcggacttcggtgccagcatcggtcgttatgccaatcgcatcaatcagggaaaatttactttggatggagttgaataccagttgccgcgcaataactacggacattgcctgcacggtggtccgaaaggattccaatatcaggtatacgatgccaagcaggtgggaccgcaggaacttgagttgacttatctttcaaaagacggcgaggaaggtttccccggtaatatcacctgtaaggttattatgaagctgacagatgataatgccatcgatatcaagtatgaggcagaaacggataaaccgaccattgtcaatatgaccaaccactcttatttcaatctggacggagatgcaggcagcaatgccgatcatctgctgactatcgacgccgatgcttatactcccgtggacagtacctttatgaccagtggcgagattgtaacagtggaaggtactccgatggacttccgcacaccgactccggttggaaaacgcattaatgatttcgatttcgtgcagttgaagaacggtaatggttacgaccataactgggtgttgaatgccaaaggcgatattacccgtaaggccgctactcttgaatcacccaaaaccggtatcgtactcgatgtatacactgacgaacccggtattcaggtatatgcaggaaacttccttgacggttcgctgaccggaaagaaaggtattacttacaatcaacgtgcttctgtctgtctggagactcaaaagtatcccgatactccgaacaaacctgaatggccttcggctgtattgcgtccgggtgaaacctacaatagtcattgtatcttcaaattctcggtagataacggaaaataa

SEQ ID NO: 8 - DNA, 3258 bp, B.fragilis
cgatgcttttatacattaaagatttatagaacctgttttttaaatttatgtactatgcgtaaaaaagaacaaatgttttggctcgcaagtcgtagcagaatgtggcgcataccactttgtatggctgccttttcgcttttgccaagtgcctacagtttcgccagtgccgaaaacccggcaacagaaactgtattggcagtgaactccgttcaacaacaacggactgtaaagggtatagttatcgacgccaatggcgaagcggtaattggtgctaacgtaaaagagccgggaagtacaactggtaccatcaccgatatgaacggtgaattctcgctgagtgtcggccctaaagctacacttgaaatctcatttattggttacacaacacaaaaagtaaacgtaggcgcatcaaacacagttaaagtaattctgcaggaagacacaaaagtacttgatgaagtcgttattaccggtttcggtatggcacaaaagaaagcgactttaacaggtgctgtttctgcaattaaatcaacagatatcgagcgttcagctgcatctactgcttcaggagcattagttggtaagattgcaggtttgaacactcgtatgcaagatggtcgtcctggtgcttctactgcattgcagattcgtaatatgggtaccccgttatttgtgattgatggtgtgcagtcggatgaagggcaatttaataatatggactttaatgatattgaaaatatttcaatattgaaagatgcctctgctgctatttatggtattcgtgctgctaacggtgtagtagtggtaactactaagaaagggcaacagaagagcaaaaatacagtttctgttaatgcttattatggttggcagaaaaactcaagatggattcaacccgctgatgctaaaacgtatgtaaatgcatatacggctgctgagacttgggccggccgaactgatggagaacgtaaattctcaagagaggattatgataagtggatggctggtacggagaaaggttatacaggatttgactggggagattatatttggaagacatctccacaatattatgtaaatactaacttttccggaggttcagataaagccaactattatgtatctgtatcacatattaatcaagatgctacagtgcgtaattacggtggattcaaacgtaccaatgttcagatgaatgttgatatgaaagtcaatgatcgttttaagatcggagcaagtatgaatggtcgtatcgaatcacgtaagaatcctggagttccgggaggtgatgattatgatcttcctttgtattctaacttgaagaactggccgacaatgggtccgtacgcaaatgataatcctctttatccgcaaaaggtttcaacagatattaataccaattttgcccttttgaactatgagaactctggtaaaatgacggatgattggcgtgtgcttcaaatgcaggctacagcagaatacgaactactgaaaggattgaaggccaagggaatggtgggatactatttcgcttatagagaaatggaaaatcatgaatatccttttaaattgtatcgatataatcaggctaatgatacttatgaagtagctgaatcaatgaatactccttatcgtgaacgtattcgtcatagaaatgaagatttattttctaatttccagttgaattttgatcgtaagtttggggatcattatattaatgctattgctggttttgaagcttctcaacgcaagagtccgaatttcaatataatctcaactccggtagctaataatttgaacttgattcaatttaaagaaattaaaacgtttaatgataacggaaatgatacccaagctcgaatgggatatttaggacgcatcaattatagttatgctgataaatatttagttgaatttattggtcgttgggatggttcttggaagttccgtccgggaaatcgttggggattcttcccttcggcatctttaggatggagaatttctcaggaaaaattctggcaagaaagtaaattggcaaatattttctcagactttaagattcgtggttcttatggtgtagtaggagatgataatgtaagtgactattctgcatttgattatttggccggttatgattataatagaggaggttcggttattgatggacagtatgttgtaggatctgctcctcgtggattgcccaatcagacattatcatggataaaagccaaaatattggatattggtgtggatatgggtttcttcaataatcggttgaccgctcagtttgacttcttccgccgattacgtacaggtatcccggaatcacgttatgatgtattgttaccttctgaagttggttttggattgccaaaagaaaatctgagatcagatcttcatatcggttatgatgcgatggtacgttgggcggataatatcaatgatttcaattatagtgttggtgctaatgttacttattctcgtttctatgattgggaacaatatgatgatcgtcgcagtaactcttgggatagatatcgtaatagtatttggcatcgtgtaggctatataaattggggatatgaggctgttggacgttttgaaaattgggagcagatagcgacttatcctgtagatattgaccgaaaaggtaatcgtacagtagttccgggtgatattatatacaaggatgtaaatggtgatggtgttattaactatatggatgaacgtcctattggttacagacaagatggaactcctaacttgaattttggtatcaatttatctgctagttggaaaggttttgatctttcaatggactggacaggttccggaatgacttcatggatgcaaaaatgggaaactgcacgtccattccagaatgatggaaatagtccgggtgaagtgttgaaggattcttggcatttagcagatgtttgggatgctgatagtgaattgattcctggtaaatatcctttgatacgtatgaataatgccgaaacatctgcttatgaaaagagcacgttctggctgcataatgtacgctatatcaagttgcgtaatttggagtttggatatactttaccgaaagctttgttggcaaaatctggtattagtaatttgcgtgtatatttgtcgggaactaacttggtgacattgactaatgtacctattattgatccggagggttctaaagataatggcttgatttacccaacgccgcgtattataaatcttggtattaacctcaaattttag

SEQ ID NO: 9 - DNA, 198 bp, B.fragilis
gggagtaaacatcagtatgctaccatacttctaatggtatgtatacctgtatgttatgtcttattctgtaatctttatcttgtctcgcgtacccgggctgccgtgcccgagtatgtggattcatgggcacaggcacccggactcatgggcccaggtatacaggacgaagtaaagatcgcaccatttccaactaattaa

SEQ ID NO: 10 - DNA, 2175 bp, B.fragilis
caacacaaacacatgagtaagagggtattagttttgattggtttgtttttggcctgtggcggcgtctattctcaaaccgccacaggcacaaaaacgaatttccagacagcagagtcgtggaaaccggaaacagatgtgcgtgccgatgccgtgatggtatacggaacgctggataagaaaggcgttacttttgagcaacgcgttcaatcgtggagagacaaagggtaccgggccgagtttatgacaggggtagcctggggagattatcaggattattttcttggaaaatgggatggggtgaaagatcacctcaaagagggtcagcgcgaccgcgaggggcgggagattgcgcacgggcacttgatcccctatattgtgcctactgagagtttcatccgttacatgcaggagaagcagattaaacgggtgatcgatgcgggcattacttctatttatctggaagaaccggaattctggatgcggggcggatacagtgaagccttcaaatccgaatggcaaaaatattatggattcccgtggagagctcaacatgaatctcctgagaatacatacttatcgaataaactgaaatattatctgtactacaacgcgcttaatcagatattcacgtatgccaaaacgtacggcaaatcgaaaggactggatgtgaagtgctttgtgcctacacattcacttgtcaactatacatcgtggcagatcgtaagtcccgaagcgagcctggcttcgctggattgtgtggatgggtatatcgcgcaggtctggacgggaaccgcccgcgaaccgaactattatgacggagtgaagaaagaacgggtatttgagaatgcttttcttgaatatggatgtatgaaatcgatgacagctccgttaaaccgcaagatgtacttcctgaccgaccccatcgaggaccgggcgaaagactggctcgattataaaataaattaccaggctacttttgccgcccaactgatgtatccggcggtagacacatacgaagtgatgccttggccggaccgtatttatcaggggctgtaccaagtagcgggaacagaccggaaagaacgtattccgcgtgactactccacacagatgcagattatggtgaatacgctgaacgacatacggacttcggaaactcaggtgagcggtacgcacggcatcggggtactgatggcaaattcgctgatgtttcagcgtttccccggtcatgatggctatgacgatccgcaattcagcagtttctatggacagaccctgccgttattgaaaagaggaataccggtggagttggtacatatggagaatactccgttcggagacacattcaaggggctgaaggtgcttgtaatgtcttattcgaacatgaaaccgatggaaccccgatatcatgattttctggcagactgggtgagaaaaggcggagcgctgatctattgcggcgaagatatcgatccttatcagtcggtgcttgaatggtggaattccaacggaaatcaatataaggctccttcggaacatttgttcgagaaactgggactggacagagtacctgctgccggaacttacccttgtggaaaaggtatggtgaccgttatacgtgaagatccgaaacactttgtgctgaaaagcggaaatgaccggcaatatttcgatgcggtttcggctgcttacagaaagagtgccgggaaagaagtagaactgaaaaacagtttcctgctcgaacggggaccatataccattgctgccgtattggacgaaagtgtatcggatgctccgatggaactttcgggggtgtatatcgacctgtttgataaagatcttccggtattgacacataaggtgattcgtccgggcgaacaaggttacttatataatgtcaaacggatttcgggacgggcaaaggcgaaagtgctttgcggtgcttccaggatatacgatgaaaaggcaggaaaacgaagttattcgtttgtggccaagagcccgttgcatacgactaatgcttcgaggatattgctccctaaacagccgatacgggtttgcgtgaacgggaaggaagagcctcagccggagaaattgtgggaagagcgttcgcgtaccctgctcttgaagttcgagaacgaccccgccggcgtgcaagtagatattgaatggtaa

SEQ ID NO: 11 - DNA, 258 bp, B.fragilis
cacagagttaaagcttgttctttggatgtgaataagaagtcctttaaatgcaaaagacttgttatttgcgcacaagaacctgccaacctgcaaaaggcgttaacaatgttaattgaaaaaaggtataaggatgaagataccggttcagacggcgtaaactcacttccggaacttgagctatcttattcagccggtgtctgttttttcttattaaagcaagcaaaaaggacaattatcaacttgaaaataaagaaataa

SEQ ID NO: 12 - DNA, 1482 bp, B.fragilis
aaaccaatcaagattatgccaggaaaaaactcaaagaaaatgatcggagcatgtgtcgttactgcggcactgctctgtgcgccttcagcactgaaggccgaaggtatgttgtcgcattatacttgtgtggcagatgctattcagaaagacaaccgtccggaacccgctaagcgtctgttccgttcgcaggctgtagaaaacgaaatcatacgtgtacagaaactgttgcgtaactcaaagctggcctggatgtttaccaattgtttccccaatacactggataccaccgtacacttccgcaaaggcaaagacggcaaacccgatacttttgtatatacaggagatattcatgccatgtggctccgtgactcgggggctcaggtatggccttatgtacaactggccaattccgatccggaactgaaaacgatgcttgccggagttatcaaccgccagtttaaatgtatcaatatcgatccgtatgccaatgcgttcaatgatggccctaaagggggtgaatggatgagcgacctgacggatatgaaacctgagttgcatgaacgcaaatgggagatcgactcgctttgctatccgttgcgcctggcttatcagtactggaagacaacaggggatgccagtatcttcgatgaagaatggatacaggcaatcaccaacatattgcgtacttttaaggaacaacagcgcaaagacggtgtgggtccgtataagttccaacgtaagacagagcgtgctctcgatacagtgaccaatgacggactgggtaatccggtgaaacctgtcggactgattgtttccactttccgtccttcggacgatgccacgacattgcagtatctggttccgtccaacttctttgccgtatcttcactccgcaaggcagccgagatactgacaaccgtgaataaaaagacggctttggccaatgaatgcaaggctttggcaaacgaggtggaaacagccctgaagaaatatgccgtttacaatcatcccaaatacggaaagatttatgctttcgaggtggacggttttggtaaccacatgctgatggacgacgccaacgttccgagcctgctggcaatgccttatctgggtgatgtgtcgattgatgatccgatttatcagaatacccgccgttttgtatggagcctcgacaatccttacttcttcaaaggtaaggcaggcgagggcattggcggaccacacatcggatacgatatggtatggcccatgagtatcatgatgaaagctttcaccagcaaggatgatgcggagatcaagtcgtgcatcgagatgctgatgaatacggatgcaggtacaggcttcatgcacgagtctttccataaagacaatcctgagaaatttacccgtgcctggtttgcatggcagaatactttgttcggtgagttgatcctgaaactggtgaatgaaggtaaagtggatatgctgaatagtatacagtaa

SEQ ID NO: 13 - DNA, 3624 bp, B.fragilis
gcaaacatgaaattacacattgctatgctggcagctaccctgctgttgtccggaggagcctcgtacgctcaagggaacaaacaggagaaaaaggcgaaagcctacatggtagcagatgcccatctggacactcagtggaactgggatgtacagactaccattaaagagtatgtatggaacacgatcaaccagaacctgtttctgctgaaaaagtatccgaactatgtattcaactttgaaggcggagtgaaatatgcctggatgaaggagtactatcctgcacaatacgaagaaatgaagaagtacatcggggaaggccgctggcacatttccggaagtagctgggatgcaacggacgctctggtaccttcgactgaatcgttcatccgcaatattatgctgggacaacagtattacagacaagaattcggagtggaaagcacggacatcttcctgcccgactgtttcggatttggctggacactgcctactatcgcttcgcactgcggcctgattggtttctcttcacaaaaactggactggcgtgtgcatccgttctatggtaagagcaagcatccgtttacaatcggcttgtggaaaggaatagacggatcgtctatcatgctggcacatggatatgattatggcagaagatggaacgacgaagacctttcagaaaacgaacaactgaaagaactggcaggccgtacacctcttaatacagtatacagatattacggtacaggcgatatcggcggatcaccgacactggcctctgtccgctcagtggaaaaaggacttcgcggaaacggtccggtagaaattgtcagtgcaaccagcgaccagctttacaaagattaccttccttataagaatcatccggaattaccggtattcgacggtgaactgttgatggatgttcacggtacaggatgctacacctcacaggctgccatgaaattgtacaaccgccagaacgaattattgggagatgcggccgaaagagctgccgtaactgccgaatggctgaatcaggccaaatatccgggaagcaccatcaatgaagcatggaaacgcttcatttatcatcagttccacgatgacctgacaggaaccagtataccgcgtgcctatgaattttcatggaacgatgaactgatctcactgaaacagttctccaatgtactgacttcttccattcatggtatcggcagggaattggatacacgggtcagcggtattccggtaatcctttataatgcactcggatttacggttacagatattgcggaaatagaacttgaccttccaaaagcccccaaagggataacggtgtacgatgaaaagggcaaaaaagtatcggctcagctcatttcttataccgacggaaaagcacgcatcctggtagaagcaacagttccggctacaggatatgtggtatatgacgtacgcacatcaggaaccggtgcaagcaacgtctcgacgaacgtcaataccttggaaaactctctgtacaagattacattggataaaaatggagatatcgtctctctgactgacaaaaagaacggcaaagagctggtgaaagccgggaaagcaatccgcctggcagtcttcactcagaacaagtcatacaattggccggcatgggaagtgttgaaagagacaaccgaccgtactccggtttcgattacgaatgacgtgaaaataactttggttgaagacggaactttacgtaaatcgctttgtgtcgagaaacgtcacggagaatctgtcttccgtcaatacatacgtctgtatgaaggtagccgtgcagaacgcatcgacttctataacgaaatagactggcaatcgaccaacgcattgttaaaagccgaattcccgctcaatattgaaaacgaaaaggctacgtacgacttgggtatcggcagcatacaacgtggcaacaataccgaaacagcttacgaagtatatgcacaatattgggccgacctgaccgatcgtgacggaagttatggtgtatcggtgatgaacgacagcaaatatggatgggacaagccggataaccatacgatccgtctcaccctgctccacacaccggaaacacgcggaggttacgcatatcaggatcatcaggatctcggtcatcataccttcacctacagcctgataccacatcagggagccttggataaacccgccactgtagagaaagccgaaaaactgaaccagcaactgaaagccttccgtacggaaaagcacaaaggaaatgccggaaaatcgttctcgtttgtcgcttcggacaaccgcaatgtattgatcaaggcactgaagaaagcggaagaaaccgatgagtatgtagtacgcgtatacgaaaccgaaggccggaaagcacagagcgccacactgacctttgcaggggaaatcatcagtgccagcgaagccaacggtacagaaaagacaatcggcaatgcaactttcgaaggaaacaagttgcaggtaaacatcactccttattctgtaagaacttacaaagtacgcctcaaaccatcgggacgtgagacgtctccgatcgaatatgccgctttaccgcttgactacgaccgcaaatgtgcttcttataatgaattccgtggagaaggcgacttcgaatcgggctattcttttgcagccgaacttctgccggactcactgatagccggtcagatcactttccgtttgggagaaaaagagattgcgaacggaatgacttgtgaaggtgataccttgcaactgcctgcgggaaacaaatacaaccgtctctatatcctcgccgcctctaccgaaggagacaatcaggccgacttccgcattggcaagcagaccgcttcattcgttgtaccttcttataccggcttcatcggccaatggggacataaaggacacaccgaaggatatctgaaagatgctgagattgcctatgtaggtacacaccgccatgcatccaacggtgatcagccttatgaattcacttatatgttcaaatttggtatggatattccgaagggagctaccagcgtaatcttgccccgaaatgagaaagtggttttgtttgctgctactctggttgccgaaaatgaaccggctacaaccgttgccggcactcttttccgcaccaataacgtaggtaatgcagctactgccggaaatgatgaagaagcagtacgcgaaaatatcctgaaaagagctaaaatcattgcttgctccggatataccaacgacgaagaaaaaccggacttcctgctggatggtaaaacggatacaaagtggtgtgacgtttcgcagactccgaactacgtagacttcgatctgggtgaagcacaaaacatcagtggttggaagatggtgaacgccggacaggaaagtcactcatacatcaccaatggttgcttcctgcaaggtaaaatgaacccgggcgatgaatggacgactctggatgctatcgacggtaaccatgcaaatgtcgtttcacgtccgctgaactatgacggaaaggtacgttacatccgtctgcttgtgactcgtcctacacagagcaccggaggcagagatacacgtatctacgaactggaagtttataaataa

SEQ ID NO: 14 - DNA, 1860 bp, B.fragilis
caaacaatgaaaaagagaaattttatagctgttgctgcttgtgcactggcattaagtagttgcagtggattcctggaccaaaagccagatcgtattatgacagaagatcaagtttatggagatgtcaatctgacaaaatctgtattggcaaatttctatgaacgtatatcactaggccaacatgtaggagatacggatgggttcgctctgttggatgaggccattacttatgatactaaagatgatcaggaagtagatcgtaactggtggcgtacatatgattatacattgatccgtaatatcaaccaattcttaaaagggttgagagaatcgactgcattgtctgaagttgagaaagctcctatggaaggagaggctcgttttatacgtgcatgggtttatttttgtacttgtcgtactttaggaggaatgccgattgtaggcgatgaagtatatgattatacttctggtatggacattactactcttcaagttcctcgtgcaacagaatctgcaatgtatgattatattatagaagagtgcaaaactattgcagaaatgttgccaaccgaaccttcaaagaatggagctcgcgcaactaaatgggctgcaaaaatgcttgaagcgagagctgctgtttatgcaggttctattgcccgatacaatacagttgccgattatccattgttgaacccggaaacaggagtagtaggtatctcttcagagaaagcaactgattattataagaaagcgttagctgctgcagaagaagttatcaatagtggaaaatattctttgatgagagttgctgatgatgctactccgcaagagaaagcagacaacttctttaaggctgtatgtgaaaaaaatggcaatacagaagtcatttggtcacgtgattatatttatccgggacaaactcatggttataccaagtctgtacagcctcatgatggtgccgaagatggagggaatagccgtttgtctgcattgctaaatttggtagaggcttttgaacctatagctacagatactccgggagaaggagctaagtttgatgttggtacaaaggataatcctaaattttatactaaccctgaagatctgtttgtaggtcgtgatcctcgtttggcagggacaattctgtatccaggttcttcttttagagatagaactgtcgttttacaaacaggacaatggattaagaattctgatggacaatgggaacagaagttgggacagagtttgggagaaaaagatgatcaaggaagatatgttacagccttgaatggtccgatggtacgtaatgaccaacgtgaatgtaatcgtacaggcttctatgttcgtaaatatcttgataaaacaacttctgcgggaactgaccgtggatctgaaatgtggaatgtttatttccgtctttctgaagcttatttgatagctgcagaagctgcttatgaacttaatggtggaagtgatgctactgctttgaaatatataaatgcagtacgttccagggcaggtgttaaagaattggcttctgttaaccatcaacagattatgcatgagaatcaagtagagtttgcctttgaaggtcatcgctggtgggatttgaaacgttggcgtcaagctgataagatctggacaggctcagaaatggatatcacggctacacgccgtggcttgtggcctttcttagttgtctctgacgatgataagaatggaaaatgggtgttctttgaagaaaacatgaatcgttattatagaaatccattgaaatgtctacctaaacattattatgctgagctagataatggttggctgaataacaatccgaaactggtgaagaacccgtatcaataa

SEQ ID NO: 15 - DNA, 1284 bp, B.fragilis
ggtccggcagatctgcttctatatccttatgcctctttttatatcctgtttttaattcatatcatgacacatacacaaacgatcacacctaaaaagcgtattaattcgatcgatgccttgcgggggttcgcactgattggcatcatgctcttgcattgcatggagcgtttcgacctgactttagctccggttgtggagtctcctttctggcaggcaatagatacggcagtatacgattcactctattttttgttttccgggaaatcatacgctatgttttcccttttgttcggtttgagctttttcatgcagatggagtctcaggcagctaaaggagtcgatttccggggacgcttcctctggaggcttgccttattgttcctgtttggctatatcaacggattggtctatatgggagagttttttatggtctatgccgtattaggagtcttcttgattcctctttataaagtttccaccagatggttgctggtgctatgcattttgctgtttctgcagataccggcagtcattagttttgtatctctgctcagcgacaatgtggctaacgaaccgactgctgcggcagcctatatggaccggctttttgaaagggcggccgatgtctttatcaatggatcactgatggatgtactgagtttcaatacgttcgacggacagtcggccaaatgcctgtgggtattcaataatttccgttacctccagttattgggactgtttattgccggaatgctgatcgggcgtcagggtattcacaaaagtgaggaaaagatggtgaagtacagtcgtctgtttttaccttattgtctggctttctgggcagtattttatgctgttgccttcctgcttccggtatggggagtggacgggtttgcgttgcgggtaggacagactcttttcaagacgtatggcaatctgggacagatgatggtttatttctgcggtttcactttgctgtattatcggtataaggggcagaaagtgctcgaccgtattgctccggtgggacgaatgagtgtgacgaactatatggcgcagtcgatagtcggagtttccctattctatggttttggcgggaactttgctgtcgagttcaactatttgcagagctttttgctgggagcggctttctgtgtcatccagattgcttatagcaattggtggattaagagattctactatggtcccatggagtggctgtggcgttcgcttacctggtttcaggtggtgccgttgtcaaggcgtaaagcttcgcttggataa

SEQ ID NO: 16 - DNA, 477 bp, B.fragilis
aacagatattggcttatgtttataaattctttaaggaaatcccctttttcctgttctctgggattgatcctgttgggggcgtttaccctgttatctgttcctgtgtatgggcagcagatacaacagtcggaaagacaggtgcagcaagttcctttccttcaattcaacttcgatgaacagggaggagagacagcccgtaacagtggaagaggaggctcaaaatatgatgcccggatcaccggaggtacggtggagtgggggccgggtctccagcagggatcggcaagactcagtaacaaaggacacttcaagtcaccggacggagtcctggcacatgtgaaagatttcactttgtctgtctgggtctatctgaatgaacagtctgacaaccaaacggtgtgtcttcaccacgggagctggaagatagggattgtaaatccagcttgtttctccgctcccatcgatcttggatattaa

SEQ ID NO: 17 - DNA, 1011 bp, B.fragilis
ataaggggacttttcttaatttatatattcagcatgaagaaacttttattttccctttttactgttttttctttctgtgttccttccattgcacagcagtattccaaccccgttattaattatagccttcccgaccctacggttatcaaggcagatgatggttattattacctgtacgcaacggaaaatatcagaaatcttcctattcaccgatcgaaagatatggtaaattggagctttgtgggtacggcttttaccaatgaaacccgccctacatttgagccgaaaggaaatctttgggcaccggatataaataaaatcggtgatcggtatgtgatgtattactccatgtctgtttggggtggagagtggacctgcgggattggtgtggctacggcagataaacctgagggatcttttaccgatcatggaaaactgttccggagcaatgaaatagggattcagaattgtatcgatcctttctatatagaagatggtggtaagaaataccttttttggggaagctttcatggcatttatggagcagaactaagtgatgacgggctctccctgaaagaaggaatgaaaccacagcaggtggcaggcacagcctatgaaggaacttatattcacaaacggggaggctattactacttgtttgcctctatcggtcgttgctgtgaaggattaaagagtacgtataccacagtggtggggcggtcgaaatacttatttggcccttatgtagataaaaaaggggaatcgatgctggagaatcatcatgaagtgctgattgataaaaatgaagcattcgtgggtcccgggcacaactcggagatcgtaacagatgataaaggagcggattgggtgttttatcacgctgtcagtgtggccaatcctgaaggaagagtgttgatgctcgaccgtgtaaactggaaaaaagggtggcctgttgtagagggtgatacaccgtcgttgcaagcaaaagcacctgttatccagcataaataa

SEQ ID NO: 18 - DNA, 444 bp, B.fragilis
attaattgtattatgaacaagaaattctttatcgcaatgttggcatttgcattatttggtatgacaaatgtaatggctaatacatcgaaggatgaagtagtagaagtaagtagcacgaataaagtgacagctactgagtattatttagaagctgcgggacagagtggatctggtcttttttattctattgaacttttagattcctctcaaagaaaactaaagattactgcaaaaagaggacttcgtattgaaataaattgtcacggacatggaattgttccagatgatcgtttattctatacatctgacagttggactggagaggtaataactgatgaaattaatactgaagcttttactataagtactagttataatgaaagtgctggtagtagctctacgactaaatatgaaactcggtattattatattagagaaagatag

SEQ ID NO: 19 - DNA, 486 bp, B.fragilis
ggcaaaaacatgaaaaacaaagtactgatcatagtagctatcttattacttcttcccaatgcaatggcatgggcacatcagcccgcagacggaaacctgaagcattttacaaagaaagacgcgacgacggcgatggatgcttttcattctactttttataatccggatatgaagttgtatgccatatcttcggatatgaaaggaagagctgccatctgggtacaggctatctattgggatatgattatgaacgcgtataaacgtacgaaggctcctaaatatcgccggttgatagaagaggtgtatcagggaggatacgaacaatacgataaatacaattgggacaataaaatcgaatggtttatttatgatgatatgatgtggtggattatttcgctggcacgtgcttacgaaatcacgaatgacccgaaatacctggcacatgcctcttcgggattctacccatgtctggaaagagtcgtatga

SEQ ID NO: 20 - DNA, 723 bp, B.fragilis
aaagaaataatgaaagcaatatccaaaattttttcagcactactattggtaatgatagttgttaccagttgtacaaaggataattatgatgctccggaatcaatgctgactggaaaggtcgtttatgaaggagaggctttgcaactgcgtggaaatgaggcggtccgattgttcctttatcaacgtggttatgaaaagcatgatccgattgaagtttttgtaaatcaagacggagcttattctgcatgtttatttgatggtgagtatcaattgatcaccaaaagcggtaatggcccttggtcagaagaaggccgtgatactattaatgttattgtctcaggcaatactgtacaaaatgtagaagttgttccttattacatggtcagaaatgctgagatgaaactaaatggtaatgttgtgacagcttccttcaatgtagaaaagattgcgggaaaagaaatagatcgtgtcttctttatgttaggaacaactcaatacataaatgatggtgaacacaatgttgatcgttttgatgatgcagatggcgccaaaatggctgaaatcaatgtaactggtgcacgttatgagtttactcctagagactatacagacaataaaatgtttcaaacagctttgaaaagaggtactctttttggccgtatttgtatatggccaaaaggttctgatcaaggaatttactctgaagtaatccgactgaaataa

SEQ ID NO: 21 - DNA, 429 bp, B.fragilis
cttctaatattatatataatgaacaaaagatttattattgtattattagcatttgtttttgtgagtatggcaaatgcaaaggctgatattcctaaagtttgggaagtaaatggggtttatacattagttgaagttgaatctcccagtggctatgggcttataaaatcaattacaattggaaatgagtatgcttacaattctactgaaataaaaattgttgttattgatggtgtaaacagcgttagaatagattgggttgcagaaggtaaccgatatcctgttacgtatagcgttggttatgacaataccgttataataccaaattttttgagacgtcgatttattgtgagtgtagaatatacatttgctggaagtatggctggaatacagtatgcttatgaaacgagagtttttgagataagatcttaa

SEQ ID NO: 22 - DNA, 1263 bp, B.fragilis
gaaattcccccttttggaggaattttttcaatcatggaaaaatttggactcatgcttttcacccgtaatggactcaccctgggtaaaagatgcaccagtttcttcggatatcagttcaggaggatagtccgttcgctgatgagcgtttatttctgtggcggttcatgcgtggaagatgtaacgtcacaactgatgcgccatctctcgtatcatcctacctttcgtacatgcagctctgataccatcctcagagccatcaaggaactgacacaggaaaacatctcctatacttccgaccaaggcaagacctatgatttcaatactgcagacaaactcaacacattgcttataaacgctttggtttctacaggcgagttgaaggaaattgaggaatacgatgttgactttgaccatcagttccttgaaacggagaagtatgatgcaaaaccgacctacaaaaagttcctcggctacaggcctggcgtatatgttatcggtgacaagatagtctatatcgagaacagcgatggtaacacgaatgtgcgttttcatcaggcagacacccataagagattcttcgctcttctggaatcccagaacatccgtgtaaatcgcttcagggcagactgcggttcctgctcgaaggaaatcgtcagtgagatagagaagcattgcaaacatttctacatccgtgccaaccgatgcagttcgctctacaatgacatctttgctctgagaggatggaagacggaggagattaacggcatccagttcgaactcaattccattctcgttgagaaatgggaaggcaagtgctatcgtcttgtcatccagagacaaagacgcaacagtggcgaccttgacctgtgggaaggcgaatacacttaccgttgtattctgaccaacgattacaagtcatcgacaagggacattgttgaattctacaatctgcgtggcggcaaggaacgtatctttgacgacatgaacaacggattcggttggagcaggctccccaagtcattcatggcggagaatactgtctttcttctgcttactgcattgatacacaatttctacaagaccatcatgagcaggcttgacaccaaggcttttgggctcaagaaaacgagtcgcataaaggcttttgtcttcagattcatctccgtacctgccaagtggatcatgactgcaaggcaatacgtgctgaatatctacacagagaaccgagcttatgcaaaacccttcaaaacagaattcggataa

SEQ ID NO: 23 - DNA, 2574 bp, B.fragilis
cgactaaaagaatcgcgtttcacgggccaacgttttcgggaggcacaagagcgggattatcggcattatgaccgttttgtcgaaaaaatcatcccggattctgtcaatttttaccggacttatgtaaactatcactctttcgagcgctatctggagcgtttgaagtggtataaacgcgggttagagaaacgttgggcaatacaggatgccaggaaacgtcgtccggaccctttgctgttgcgttttgatatgttcaaccgtcaggtaggcaggcgggacagcctgatgaaaagtcgtatgttggataactctcaacgaatgattacccggcagtggtggcgatacggtcgtgcatgggagcggatgaatgacaccttacagtttcaaagtaggcatctgctggaacgtttccgcttcttcaacaataaatgggccgataatgccgctttccaatccgatggactgatagcccgcaagaattattttcgcgacaaagcactgagtacccctatgtggcaggcaaagcgtgcactctataaagcggacccggatgctgcgatacgaatatatgcttctcgctttggctattttaatgataaaatggaacggctggatgctaccctttaccgatattatcgcaccaaaggcgcgcgtgctgaaagtagggaaggagtaagatttctgcgagcttttatggtgggacgtgatactactttgtcgtacctgaaccgcaaccaattaacggagaaatatattcgtcgctacgagaaggtgaaaaatttcttcccgatgtttcatttccgccgtccggatccggatacgttatctcctttgtgggagacgaggacacggatagatacaatgcagacacggcatacattgctgtcgaagctttcaaaagaagatatatacgaatattatgtccggcagcaacaaggggtatctgataggggaatgataggaccttttcgtggtcttctgcctctatatacctatcatcgtgatttgcccgattctatagtattgcgtgtcccgggacgtaaaacacggcgggattttgaactcagccggtttgattcagctactacggtcaatcgttatatcggtcgttacgagtttctgcgatcaacttatccgcaataccatttgatacgtaaattgtataacatacatccgcctgctctgcggcatgcggcccggcaggcgagctatgaagagcgactggcacgtatcaattctcttgattcgaccagtctgataaagatgttctataatacacagaaaattgcccgtaatgaggcgcgtaaggcgatgaaagatacaaaataccgtgatatcgttcgttttccgttcaatcctgaagcgcagctcgatacggtgatttatgctactgatcaggtacatttcctctactcgcagaaagtaccggcagatgaaaattcggcacgtatgaaggtatatgtagttggtgatgtgctgaatagtaatggaagcaggttttcccttccgtactcggatacgctgacttatctggtgagttcgatgactaagtttgttgacaggacgccacgctttgttcgaaaaatagttacccgtgatgcggaagcaaatgctagtgtaaacttttactttccaaaaaacagttttcgtatggatgaaactattgacataaaccggcagggagtgaagcaggtacataaccttactctggcattaatgaccgatccggtatatatcatagacagtctgacgcttttggctacctcgtcacccgaaggtaactggcacgttaatggagaaatatcccgaaaacgtgcggaatcaatccgtaatattttggtggaggacttcaaactgctttatgattcattggctatcggtgctgctatcgagatggatgagacgggcaacatcatccggcaggagatgaaggacgggattccgaacttgccggagttgataaagatacgtaccgtacctgaggggtgggagaaactgcgccgtctgattgtaaatgataaaaattttcaaggcaataaaggtgcaatcttgagaattattgatcgtgaacaggagcccgatcggcgcgaatggctgattaaaagtcagtataagacagaatatgcctatatgcttgacaaactctatccggcagtacgcagggtggatttccttttcagtctctcccgtcggggtatgcggcaggacacactctataccaatgaaccggatacaatgtatgcccgagctgtggattatctagagaaacgtaaatatgagcaagctttggaaattctgcgtccgtacgaggatgtaaatactgcaattgcctatatgtctttgggatatgataaggctgccttacgaatacttgaacaatcgtcgcagactgccgaaacccaatatatgcaggctattctgaatgctcgtctgggtaatgagcagcgggctgtatcgttgttgctcagtgcggcggaagtggatgaccggataagattccgagccaatctagatccggaattatctctattagtgaagaaatatggcttgtttaaagaggatgatttgtggtaa

SEQ ID NO: 24 - DNA, 883 bp, B.fragilis
gccatagagcgcgtctacttccagccccgtggtgaagacctattgaaaaacgatgctttgttacctttaaataaagaaaagattaaatctgtagccgtagtagggccgtttgccgattacaattatttggggggatatagcggacagcctccttattcggttagccttttgaaaggagtgaaggagctgataggtaaaaaagggaaagtcacttatctgaacggaatgggaacctctgcggattctatagcgcaagtggtaaaaggggcagatatagtacttgtagctttgggtagtgatgaaaaaatggcacgagaaaaccatgatatgccttctatttatttaccggagggacaagagaagcttctaaaagagatttatcaggtgaatccgagaattgtattggttttccacacgggaaatccgttgacttccgaatgggcggatacacatataccggctattatgcaggcttggtatccgggacaggaagcgggtagggctttggccaatttgctgtttggaaatgaaaatccgtcgggtaagttgcctatgactatctacagaaccgaagaacagttaccggatatactggattttgatatgtggaaagggcgtacttatcgttatatgaaaggggaacctttatatggtttcggccatggattgagttatacatcttttgagttcgataatatacaagggaatgatactttgcagccggatgcgattttacaatgttcggtcgagttatccaattcaggtcagttagcaggagaagaagtggtccaagtctatgtttcgagggagaatactcctgtttacacatatccgttgaaaaaattagtggcatttaaaaaagtaaaacttgctttcagtgaga

SEQ ID NO: 25 - DNA, 513 bp, B.fragilis
aaactgttacaatgtagaaaaagaaaagaggccctcatgacttcactttatgatttttccgttttgaaccaaaacaaccaagcaactcccttggatagctatcgtggcaaagttctcttgattgtcaacactgctactggatgtggtttaacgccccagtaccagggacttcaagaactctatgaacgctatcaagatcagggcttcgaaatattggatttcccttgcaatcagtttatgggacaagcacccggcagcgcagaggaaatcaacgccttctgtagcctacattttcaaaccaccttcccacgttttgccaagattaaggtcaacggtaaggaagcagaccctctctatgtctggttaaaagaccataaatctggcccactaggaaaacgaatcgaatggaatttcgctaagtttctcattagtcgtgatgggcaagtctttgaacgcttttcttcaaaaacagacccaaaacaaattgaagaggcgatacaaactctactataa

SEQ ID NO: 26 - DNA, 273 bp, B.fragilis
aaggaggaaaacaaattgaaaatttttaagggagagttttatcgaatctctgtattaacagacaagctagtaaggttagaatactctcaaactggaagttttgaggatagaacgacacaacttatctataatagagattttggccaagtttcgttagattatatcgagacatcaaacgtactagatattatgacggactattttcatctgcactttaataaaggagaatttaacgccgaaaatttatttatagaattaaaaggaaattttgcc

SEQ ID NO: 27 - DNA, 885 bp, B.fragilis
agacatgcccgtacgtacatgatgcgcaatgactggcagaacatgtataccgctgcgaccgatgtaatgaattcagggcaatacaatctgaatactccttatgatgtcatcttcaccgatgaaggcgagaacagcagtgagtcggtattcgagttgcaatgcgcatctactgccgctttgcccgcaagcgataaaatcggcagccagttctgcgaagtacaaggtgtacgcggttccggccaatgggacctcggctggggatggcacatgggaaccgagctgatgggtgaagcgttcgaaccgggcgacccccgcaaagatgctacgctgctttacttccgtcgttcggatactgatccgatcactcccgagaataccaacaaaccttatggagagtctccggtatctcaagccgacggtacttattttaacaagaaagcttataccaacccggcactccgtgaagagtttacccggcacggtttttgggtaaatatccgcattatccgctatggtgacgtggtgctgatggctgccgagtcggccaatgaattgggtaaaacaggtgaagcttccaactatctggaaatggtacgagcccgcgcccgtggcaacaacccggacattctgcctaaagtgacttcattagatcagaccgtgctgcgtgatgccatccgccacgaacgacgggtagaactgggactggaatcgggacgtttctacgacctggtacgctggggcatcgcttcgcaagtgctccatgctgcaggcaaaacgggttatcaacccaagaatgccttgctaccgctttcgcaggacgaaattgataaatcaaaaagcgtactggtacagaacccggattatttagagcacaccacagagtaa

SEQ ID NO: 28 - DNA, 1482 bp, B.fragilis
tcaacaaacacttttatgaatcaaaaattattgttcagtagcgcgttgcttgtcggcatagcaggaacacaacaggcgcttgcacaaaaaaagaaagtccaggatcaaaagagacccaacgtcgttttcatcctggccgacgacctcggattcggtgacctcagttgttacggacaagagaagttcgaaactcccaacatagacaagttggctcaggaaggaatgcgcttcacccagtgttattcgggtaccactgtcagcgccccttcgcgctcttgcctgctgaccggtacccacagtggacatacggccattcgtggaaatgtagaactcgatccggaaggacaattccctctaccggcagatgcacaaaccatcttccacgatttccagaacgcaggatacaagaccggcgctttcggtaaatggggactcggttttatcggttccacgggtgatcctaaaaaacatggcatcgacgagttctatggctacaactgccagttgctggcacacagttattatcccgatcatctgtgggacaatgacaaacgagtagaactgaaagataacacactggacgtacagtacggtaaaggtacttattctcaggatctgattcactcaaaggcacttgacttcctcgatcggatgggaaaaagcggagaatcgttctgcatgtggtatcccaccatcatcccccacgccgaactgattgtacccgaagacagcattataaagaagttccgcggcaaatatcccgaaaaacctttccatggaaccgaaccgggtaatcccgcattccgcaagggcggttactgctcacaattctatccacacgccacatttgcagctatggtctatcgtctggatgtatatgtaggtcagattgtacagaaattgaaagagatgggggtttatgacaatacgatcatcatctttgcaagtgacaacggtccgcacatggaaggtggagccgatccggacttcttcaacagcaacggaatctggcgcggatacaaacgcgacttgtacgaaggaggaatccgtgtaccgatgattatttcatggccgggacgtgtacagcccagtactcaaaccgacttcatgtgttcgttttgggatgtaatgcctacgttccgtgaaattctgaatccgaaagcaaagaatcagcaaatggatggtgtcagtctgctaccgttgctcgaaaaccgcaaagggcagaaagaacatgaatatctgtactttgaatttcaggagatgaacggacgccaagccgtacgcaaaggaccgtggaaactggtccacatgaatgttcgtggcaagaatccgtattatgaactctataatctcaattctgatccgtcggaacgacataatgtgctgaaccaatatccggaaaaggtgacggaattgaaggctatcatgcagtcatcgcatatacctaacccgaacttcccgttacttccgggagaaaaataa

SEQ ID NO: 29 - DNA, 1653 bp, B.fragilis
accatgaacaagaaactactatcccgtttagctcccggtttgtttgccgttgtgctattcacagcctgccgcccggcagccaccgtaaagggtaatttggacgtaatccctcaaccgcaggagattgtccttgcccgggacactactccttttattattgaccgcagcactacgattgtctacccggcaaccaatgaaaagatgcatcgtactgctgattttctggctacttttattaaagaaatgaccggaaccgaggttcgtgtatcggacaaagagaaaagcagcaatgctattattcttgctgtagactccacaatggggcatccggaaggttataaacttcaaatcactcctgaaaaggttcttttgacgggaggcagtgaagccggtgtcttttatggtatccagactattcataaagctcttccgatcctgaaagacggtaaggtggcagctgcccttcctgccggtacggttaccgactttccccgtttccgttaccggggattcatgatcgatgtaggccgtcacttcttcccggtcagctaccttaagcagatgattgacctgatggcactgcataacatcaactactttcattggcacctgaccgaagatcagggatggcgaatcgaaatcaagaaatatcccaaactgacagagatcggttctaaacgagactctaccattatcgattgggaaaccaagaaattcgacgggaagccccatagcggattttatacacaggacgaagctcgtgagattgttcgctatgctgccgaccgtttcattacggtagttcccgaaattgaccttccgggacatactactgctgcactggcttcttatccggaactgggatgtacaggtggtccgtacaaagtactttgctcattcggtgtcttccccgatgtactctgtgcgggtaatgaccagacacttcagttcaccaaagatgtattggatgaaattatggatatcttcccttccgaatatattcatatcggcggtgacgaatgtccgaaaagccgttgggagaagtgccccaaatgtcaggctaaaattaaggagttgggtatcaaagccctgcctaaacattcgaaagagaatcagttgcaaacctacttcatgtccgagctggagaaagaaatcaatgctcacggacgccgtatgctgggatgggatgaggtattggaaggaggtctgactccgaactccactatcatgtcatggagaggaatccagggaggaatcgaagctgcccgccagcatcatgatgtcattatgactcctattcagcggctctatttcagtaatccgcgtatcaataaaatgacgggattcgaatggatgaaccgtgtatacaactttgaaccggtacctgcagaactgaccgatgcggaaaagaagtttgtgattggtactcaaggatgtatctggaccgaatggacagccgattcaacgaagatggagtggcagattctgccccgaatggctgctttgtccgaaatacaatggacattgccggagcataagaactttgagcgtttcatggagcgcctacccgagatgctgaagatttattcttctctggattatggttatcgggaagatgtattcgcggcggataccttgaagactcataaataa

SEQ ID NO: 30 - DNA, 2943 bp, B.fragilis
cgtgatagaaaaacatccatgaaaaacaatccatataccggctttctgacctggctgaccgtactttttactgtctgttgcctcccgctgaaagccagccattactactataaacaaatttccctgaaggagggacttccctctactgtacgttgtgtctataccgagccaaaaggatttgtatggataggaaccaatgcaggattgggacgatttgacggacaaaagctgagaaaatatgtccaccggcaagaggacgtacattcgttgccgcacaactacatccatcaaattaccgaagatattcaacataatatatggatactgacagacggtggaatagcgcaatatcgcaggtcaagtgacgatttcgccattccgctagacgatcgggggcatccgatcctcgcctactctgcctgcctgacagaacaaggggtaatcttcggcggacgcaaccgcatctatcgctacgactatgacagccgatcgataaaactcctgctggattttagttccgatccttatttcgctatctccgccatcagtcggtgggatgaagagactctgctctgttgcagccgttggcaagggctccgactgatcaatctccgttcgggcgaacgccgtctcccccctttcgactgcggaaaggagatcatggcactcctgatcgattctcacaaccgcatctggctggctccttataatgaaggactccgctgcttcaaccccgaaggccgactgctggcctcgtacaccaccgacaattccgggctcagcaacaacgtggtgctgagcatggccgaacgggactcacacatctgggtcggtacagacggaggaggcatcaacatcatacacccggacagccatcgaatcacagtactcgaacatattccgggagataactattcgcttccggttaactccatcttgtcactctacaatgacaattacaataacatgtgggcaggcagtatccgcaaaggattgatcaatatccgagaagtgtccatgaagacctataccgatgtctttcccggaagcacccaaggcctgagtgaccccaccgtgctgagtctgtatcaagacgaaccgaacggacgaatctggataggtacagatggtgggggtgtcaacagcctcgaccctgtcaccgaagagttccgtcacgaccgttctacctggggtgacaaagtggtctcgatcaccggatttacccgagaatccatccttttatcggtcttttccaggggattgtttgtttataacaaagagaacggtaagcggaaaccgctacctattgaccatcccgacctcaaacaatatatttactatagcggtatggcggtcaatatctaccaggacgaaccgggcagcgtacttttgttggcaggacatacttaccggtatgacatcggttcgcagaaaatacgcgtagtaaatgaagaagaaggtatggagatcgcaggcagtatgaatgccattgcgcataacgaacgtttcacttacctgcacgacagtcgtaccctctacgaactggatcgaaccggcaataggctgaaaaaacttttcagctgcacgggcgacacactgctctactccgtttcgatggacgagaaaggtgatttctggataggcagcaatacagggttgggacaatacagcatccggacccggcaatatcacccattgatcacttcactgttcggcgaagccagttcggtgatatgtgatcatcggggaaaagtatggattggtgcagaccacatgttatttgcctggatgctgcaatcccggaagttcattcttttcggtgaatcggacggggtcattccgaatgaatatcttgccaagccccggctcgtctcagggaagggtgaagtctatatggggggtgtcaatgggttgctctgtatcgataaccgctttccggcaacttcctccaactatccggaagtagtactgaccgatgtacgtgtaaacggtgaaccggccacgaaccggacggcaggaaatcccgacaaactcaccctaccacaagacagccgggcaatcaccctgcgcgtgatgtctcacgaagaagacatcttccgaaaaaaaagataccgctaccggatagacggactcaatgaggaaccgatcgaatcatacgatccggaactggtcatccgctcactaccggcaggcaactaccgcatacaggctgcatgcagtactcaaaatggcgactggactcccttccacccgatcctgtcactgaccatactccctccctggtaccgaagcggatggttcatcatctgcttgttactatttgtgtcgggaggcatcaccgctatcatcttcgccattttgcgccgtaggaagaaccggttgaaatgggaattaaaagaacgggaattgcaggaatatgaagaaaagattcgattcctcgtcaatgtcagcaatgaactcctcccatcgttcacggagaagggggaacgggaactgcaaatcgtagaactgatacgtaaccgtctccgtaacggcgaaaaaagcaaagcacctgccgaaatagcaagcagtccgaatattgtcaaggaggaactcagccaacccgatgaaactttcctacggaagctgaaccagttgatcaccgaccatctggacagtcccgaactggacgtcacattcctctgcacggagatgggattgagccgcgcctcactctataacaaactaaaagcaatgaccaatatgggagccaacgattacatcaataaattccgtatggaaaaggccatccaactgatatcaaccaccgatctcactttcacagagatagcagaaaagataggatttacaacatcccgctatttcagtacatcatttaagcaatataccggagaaacaccgactcagtataaagagaaaataaggaaaagcagtaaggtgtag

SEQ ID NO: 31 - DNA, 2361 bp, B.fragilis
ttcctaaatgaacaacacatgagaaagctcttttttccattactactattcgtatccggtctgctatccgcccaaacagagataacactctatgtatcaccttcgggtagcgaccatcatcccggaacagcggaaaagccgatggctactttagaatatgcctggaaaaaggcctcacggcaggccggccggcgttccatcaccatctactgcgaaggcaccaactacctgtccgctccgattcttatcacaaacgagacttcgggcacacccgaacatccgatccgtttttcttcgtatcccggacaaaaggcggtcatcagcggttcgcgtatactccggaacctgcgttggaaagagtataaaaacggtatcatgcaggccaaagtggaagaagaactgatccccgaccagctctttgtgaacgggaaaaaacagatatcggcacggtatccgaattttgatccggatatacgcatcttcaacggatatgcagctgacgcctgctcacccgaacgtgtgaaaaactggagtaaccccgcgggaggttatctgcacgccatgcacagcagagaatggggaggctaccaatacagcatcgaaggcaaagacgccaagggcgaactgatactgaaaggcggatttcagaacaaccgccagatgggtatgcaccacacctaccacatggtagaaaacatctttgaagagttggatgccgaaggggaatggtattttgataaagaaacccatacactctatttctatccgccgcgagaactcgacctgcaaaccgccttgttcgaagtgccgcaggcagaaaacctctttatcctgaaaggaaaaaccggaagtccggtccgtcacgtatccgtagaccatttggaactgacacaaaccctgcgcacctttatgaaaaccaatgaacccctattgcgcagtgactggaaaatctatcggggaggagccctgataattgaaaatgccgaaaaatgctctgtaaacggctgctacctgcacgatataggaggcaatgctatcttcttctccaattataaccgcaaccaccgtgtcagccaaaatcatatcacccgtataggagccagtgctgtttgctttgtaggctctccggatgccgtccgttcccctctgttcgagtacggaaagtcgcaaacctgggagcagatggataaagggacaggtcccctcacccccgactatccctcagactgcctggtggacgacaatctgattcactcgatcggagagacagaaaagcagggagccggtatccaactatctatgtccgcacgaatcaccatccgtaacaacagtatttacgacctgccccgtgccggcatcaacgtcagtgaaggtacctggggaggacatctgatagaaggaaacgatgtgttcgacaccgtacttgagacaggcgaccacgggtccttcaactcctggggacgcgaccgctattggcatcccgaccggaatgtgatggatgaattcgcgaaagaacatcctcaaatggtattccgggacgctaccgaaacgactgtcatccgcaacaaccgctggaggtgcgaccatggatgggacatcgatctggacgacggttcttccaactatcacatctacaacaacctctgcctacacggaggattgaaattgcgcgaaggcttcgcgcgaacggtggaaaacaacattatggtcaacaacacattccatccgcacgtatggtttgcaaactctcaagacattttccgtcataacatcgtcacgactccctatcgccccattcaggtaaaggaatggggaaaggaaacagacactaacttttttgtcaccaagcaaggactggaacaggcacaaaagagaggaacggacctccattcactttacggtgatccgctcttcatcgctcctgaaaaaggagactaccgggtaaaagaaaattcgcctgccttgaagacggggttccggaatttcgatatggagcacttcggcgtacaatgcccacacctgaaagctttggcggctactccgaaattgccggttttcaaaattccggaagaaaagccggagacggtacagacgtattcgtggaaggggttaacattgaaagaggtgtcgaccgaaggagaacgttcggccacggggctcgacaaaatacgaggcatactggtagtgcaggtcgaaaagggaataaccgccctgcaagccaacgacgtgattctgcgcattaacggcaaaccggtagataaccggacggatatggaaaccgagatccggaagtcacccgaaggcaataagttccggatcatcttcttccgaaatcagaaagaaaatgcggtaacgatgtaa

SEQ ID NO: 32 - DNA, 1608 bp, B.fragilis
tccctaatagaaaaactacttatgatgaacaatctaccatccggaattctctactcgctgaccggtgcggcagctgtagcttctttgacttcatgtgccacgggcaaacagaaagaagagcaaaaacctctgaacattgtttatattatgacggacgatcatacggcgcaaatgatgagctgctacgatacccgttatatagaaactcccaacctcgatcgcattgcccgcgatggcgtgcgctttacgaattcttttgtagccaactcactgagcggccccagccgtgcctgcatgatcaccggcaaacatagctgtgccaataaattctacgacaatacgacttgcgtgtttgacagtgcccagcaaactttcccgaaactgcttcagaaagccggttaccaaaccgctcttgtaggtaagtggcacttggagagcctgccctcaggcttcaattattgggagattgtgcccggacaaggcgactattataatcccgacttcattacacaagataacgataccgttcagaaacacggttatatcaccaacctgatcactgatgacgctatcgactggatggagaataagcgtgacgagagcaaaccgttttgcctgttgattcatcataaagctattcaccgtaactggatggcagatacttgtaacctggctttgtacgaggacaaaaccttcccgctacccgataacttctttgacgattacgaaggccgtccggctgctgcggcacaggagatgagtatcgtgaaggacatggacatgatttatgacctgaagatgctgcgtccggataaggactcacgtctgaaatcactttatcagaagtttctgggacgtatggacgaaggacagcgtgcggcatgggacaagttctatggtccggtgatcgatgacttctacaagcaaaacctgagtgggaaggaattggctgactggaagttccagcgctacatgcgcgactacatgaagactgtgaagtcactggatgacaatgtgggacgtgtgctcgactatcttgaaaagaagggattactggacaacacgttggtggtctatacctccgaccagggcttctatatgggcgaacacggttggtttgacaagcgtttcatgtatgaagagtccatgcgtacaccgctgatcatgcgtatgccgaaaggattcgaccgtcgtggtgacatcaccgagatggttcagaacattgactatgcacctactttcctcgaactggccggtgctcccgttcctgctgatatacagggtatgtcattgctgccattgctgaaaggcgaacagcccaaagactggcggaatgcattatactatcacttctatgaatatccggccgagcacatggtgaaacgtcattatggaatacgtaccgaacgctataaactgatccatttctataacgacatcaattggtgggaactgtatgacatgcaagccgacccgacggaaatgcacaatctgtacggacagaaagagtatgagcctgtggtgaaagagctcaaagagcagatgctgaagttgcaggaacaatacaatgatccggtgcgcttctctccggagcgggataaagaatag

SEQ ID NO: 33 - DNA, 183 bp, B.fragilis
agttgtagtttatctacaaaaaacgttgtgttactctgtgttactttgtattactccgtgttactctgtggtgaaaaagcttttggtgaacttttatttatgagtcttcaaggtatccgccgcgaatacatcttcccgataaccataatccagagaagaataaatcttcagcatctcgggtag

SEQ ID NO: 34 - DNA, 1530 bp, B.fragilis
aaaaagaaactaatcatgaaaagaatagaaatctatatcggactgtccgttttcgctttatcggccaaaagccaggtgaaagaatctcgacccaatgtcatatatatcataatggatgatctgggctacggggatatcggttgttatggttcggagaaaatagaaacaccgaacatcgatcggttgtataaggatggcatcagtttcacacagcattacacaggttcacccgtttcggcacccgcccgctgtgtgttgatgacaggtatgcactcgggacatgcgcaaatccgggctaatgatgaaatggcttatcggggcgctatcatgaattacgactccatgtatgtacatcccggtttggaggggcagtatcctttgaaagcccataccatgactctcggaagaatgatgcagcaagccggatacgtcaccggatgctttggaaaatggggactgggggctccgggcacggaaggtactcccaacaaacagggattcgacagtttctacggatacaactgccagcggcaggcacacagttattaccccgcctttttgtataagaatgaagaccgggtatacttggccaataaagtgctcgatcctcacacgaccaagctggatgcaggagccgacccccgtgatgaagccgcctatgccaagttctcgcagaaagagtatgccaatgatcttattttcgatgaactgatttcgtttgtcgggcagaacagaaagaaaccgtttttcctgatgtggactactccgctaccgcacgtgtcgttgcaggcaccggagaaatgggtgaagtattatgtcgggaagtttggagacgaagccccctacatcggaaaagccggatatatgccttgtcgctatccgcatgcgacttatgctgctatgatcagttattttgacgagcaaataggcaagctgatagagaagctgaagaaggaacgtctgtacgacaatacggttatcatgtttacttccgataatggaccgacttttaatggcggtagcgattctccgtggttcgacagcggaggtcctttcaggtctgagtatggttggggaaaatgttttgttcacgaaggaggaatacgtatccctgctattgtcacctggcccgggaaaatcaaaccgtctacccagagcgatcatatctgcggatttcaggatgtgatgcctaccttggcggatatcgtaaacattgcttgtccggagaccgatggcatcagtttcttgcctgctttgcttggcgaaacggaacgccagaaagaacacgaatatttgtattgggaatatcccgatcccacaatcggcctcaaagccattcgcatgggtaagtggaaaggaattgtcaacaacatccgtaagggcaactctacaatggagctttatgacttggagagtgatcttagggaagaacatgatgtggctgccgaacatcccgatatcgtccggaaactgacgaggttgatggaaaagtcacataccgagccggagaatcccaaattcaggttctga

SEQ ID NO: 35 - DNA, 1272 bp, B.fragilis
gtgcacggactcttccagccccgtggtgaagacgatgatgccggctttatctatgccattcaaagtctgaggcaatggaacacgggtgaggaaagaggactgatatttccttgtgtcgagatcaccgattttccacgggtgaaatggcgcagctttatgctggattccggacgccagtatcagaaagtgtctacgatcaagaaatatatcgacatggcttcgatgctgaagatgaattactttcattggcatctgaccgaaggacttggctggcgcatcgaaataaaacgctatccgttcctgacccgtataggagcttttgtagggcaggggccggaacagcagggcttctactctcaagaagaggtgaaagagatcatcggctatgcggcggaccggggcattacggttgttcccgagattgacatgcccggacatgccgaagcggcacttaatgcatatccccggctgggatgtttcaatgttgcggtaaaggttccccaaagcggatttacgcagaatatattttgtgcgggaaaagacagtacactcatcttcctgaagaatgtgttggacgaagtatgccggatgtttccgtccgcttatattcatctcggaggcgacgaagcacctaaagggaattgggataaatgtcccgattgccggtcacggattgaaaaagaaaaactaaaagacagtcatgacctacaattgtggttttcggcccggatggccgattatctgaaacaaaaagggaggaaggccatcttttggggagatgtgatttacaaagacggctattccttgccggacaatgtggtgatacagtggtggaactggagaggacaccgggatctggccttgaagaatgccgtcagacataattatccggtgatttgcggtacaaactattatacgtatctgaacttcccgcttaccccctggaagggatatactcaagctcgcactttcgatctggaagatgtgtatttgcgtaatccttcttataggccccgggaggaaaatccgcttattctcggaatgagctctgccttgtggacggacgacggggtgacggaaagcatgatcgatcgtcgggtctttccgcgtattctcgcacttgccgagcagatgtggcattccggcaatccggaaaattttgatgagttttatggcaaagtactctctaagcaactgtggtttgaacagcaggggtattcattcgggcctgcattgaaggaagatgcgggtacaaattataaatgggactaa

SEQ ID NO: 36 - DNA, 1464 bp, B.fragilis
aataggattatggaacaatacacattcaatatagcgggtggcgtggcacgcaacccgcttgtgcgtttggcacaacctgtcacagcacaaatcgctaccggcgaacatatcgccatcgtaggacccaatgggggagggaaaagcttgtttgtagacacgcttttgggtaaatatcctttgcgtgagggtacattggactacgatttttctccttcttctacccggacggtatatgataacgtgaaatatattgctttccgtgacacctatggggcggcggatgccaactattactatcagcaacgctggaatgcccacgatcaggaagatgcccctacggtgcgggagatgttgggagagatcaaggatgaaagactgaaagaggaattgttcgaactcttccacatcgagccattgttggacaagaagatcattcttctttccagtggcgaattacgtaaatttcaactgactaaaaccctcctgacagctccccgggtattgattatggacaatccttttatcggtttggatgcacctacccgtgaattgcttttctcgctgctcgaacgtctcacccgcttgtcatccgtgcaaatcattcttgtgctttcgatgctcgatgatatcccttcgttcattacccatgtgattccggtagaagacctgcacgtgcttccgaaaatggaaagggaggcttatctggcttcattttgtgtgaccgatgaggccgaagtcctggacgcactgcaacagcgtatagccggattaccttatgacggagcaaactatgactccggggaggtggtaaaattaaataaggtaagtattcgttatgatgaccgcactatcctgaaggagctcgactggacagtccgccggggtgaaaagtgggcattgagtggagaaaacggtgccggtaaatctacactgctcagcttggtttgtgcggacaaccctcagtcgtacgcctgtgacatcagtcttttcggacgtaagcggggtacgggcgaaagcatttgggagattaaaaaacacatcggttacgttagtcccgaaatgcaccgtgcctatctcaaaaatctgccggccattgagattgtggcttccggattgcatgacagcatcggtttgtacaaacgcccgcaggaaagccagatggctgcctgcgagtggtggatggatgtgttcggcattgtggctctgaaggacaaaccttttcttcagctgtcgagcggtgagcagcgcctggcattattggcccgtgcttttgtgaaagatccggaattgcttattctggacgagccgctgcacggactcgatacgtacaatcgccggcgggtgaaaaagattatcgaagctttttgccgtcggcaggacaagacgatgattatggtaacccattacgaatcggaactcccttctaccatcaccgaccgccttttcctgaaaagaaatcgttga

SEQ ID NO: 37 - DNA, 1113 bp, B.fragilis
gagaaaataatctctgtggaactctgtgtaatctgtggtgaactcaaaaccattacaattatgaataaaataatagaactgttgggaaatcaggctgaatattacctgaaccacacttgcaaaaccattgataaatcactgattcacgtaccgtcaccggatacaatcgataagatatggattgactctgaccgtaacatacagactttgcgcagtttgcagacattgctggggcatggtcgtctggcaaacaccggatatgtatccattcttccggtcgatcaggacatcgaacatacggccggagcttcgttcgctccgaatccgatttatttcgatccggaaaacattgtgaagcttgccattgaaggcggttgtaatgcagttgcatccactttcggcaatctgggtgctgttgcccgaaaatatgcgcataagataccgtttgtagtaaaactgaaccataatgagttgttgtcttatcccaatacttacgatcaggttctgtttggcaccgtcaaggaggcttgggaaatgggggcagtggctgtaggtgctactatctatttcggttccgaacagagtcgccgccaattggtggaaatcgctgaggctttcgattatgcgcatgaactgggtatggccaccatcctgtggtgctatctgcgtaacaacgagttcaagaaagatggtatagactatcatgcggctgctgaccttaccggacaagccaaccgtctgggagttaccatcaaggccgatatcgtaaaacagaaattgccgactaacaatggtggtttcaaagcgattcatttcggaaagacggatgaaagaatgtataccgagctgactacggaccatccgatcgatctttgccgctatcaggtggccaatggatatatgggacgtgtcgggctgatcaactccggtggagagtcacatggagcgtccgacctgaaggatgctgtcgttacggcagtagtaaacaaacgtgccggcggtatgggattgatcagcggacgtaaagctttccagaaacccatgaacgaaggagtggagttacttcacgccattcaggatgtctatctggatgcgtctgtcaccattgcctga

SEQ ID NO: 38 - DNA, 747 bp, B.fragilis
atgaaaaagattgtattgctccgtcatggagaaagtgcatggaacaaagagaaccgttttaccggttggacagatgtcgatctgacagaaaaaggaattgccgaagcctgtaaagcaggcgaactactgaaagagaatggatttaacttcgataaagcttatacgtcataccttaaacgagcggtgaaaacgctgaattgcgtactcgaccggatggatcaggactggattccggtagagaaaagctggcgcctgaatgaaaaacattacggcgatctgcaaggactgaacaaaagcgaaacagccgctaaatacggggatgaacaggtgcttatctggcgcaggagttatgatatagctcccaatgccctgtcggaagacgatccgagaaatccccgctttgagaatcgttatcaggaagtacccgatgcggaacttccccggacagaatctctgaaagataccatcgaacgtatcatgccttattggaagtgtatcatcttcccgaatctgaaaacggctgatgaaattctggttgttgcccacggaaatagtttgcgcggcatcatcaagcacttgaagcacatctccgatgaagagatcgtaaaactgaatctgccgactgccgtcccttacgtatttgagttcagtgacgaactgaatctggaaaaagactatttcctgggtgatcccgaagaaatccgtaagttgatggaagcggttgccaaccagggaaagaaaaaataa

SEQ ID NO: 39 - DNA, 2307 bp, B.fragilis
aagccactatctgccggagaacgcttaagcaacagagctctgaaccacaaacatccatttggttcttcccgtttcatttgtgaatataatgaagtatatcttactttgcacacacaatgcatatttcataacatcaacaacaataccatgaaaaaattacttgcaacattactgattcttgtagcttgtattcatgtcaatgcacaagagtccatacagattcgcatctcgacagatcggacggaccttatcctggaagttgctccggacggacgtctgtatcaatcttatctgggtgacagactactgaacgaacaagacctgaaaaacctttccggctcctcacgaggatgggaagtctatccgggttcgggtggagaagattatttcgaaccggctgtagccattacgaacaacgatggcaatctcagcacgatcctgcgttatgtatcttcggaacagaaagcagtggaaggtggaacagaaaccatcatccggatgaaagatgaccaatatccggtggacgtcacactgcactatgtagcctatcctaaacaaaatgtcatcaaaacatggagcgagatcaagcatcaacaaaagaagccggtcgtgttatggcgttatgcttcgacaatgctttacttctcaaaccaaaaatattatctcaccgaattcagcagtgactgggctaaagaggtgcagatgagtacacagcaattgcaacccggcaaaaagattctcgatacgaagttaggtagccgtgctgccatgcacatgcaacctttttttgaactcggactggaacagcccgctcaggagcatcagggacaagtagtattgggcaccatcggatggacaggcaactaccagtttactttcgaagtggacaatgaaggcgacttacgaatcatccctgctatcaatccatacgcctcggactatcaattgaaagcaaacgaaacatttaccaccccggagtttatctttacgttgagtaacaacggtacgggtgaagccagccgtaatctgcacaattgggcacgcaactaccaactgaaagacggcaagggagaccgaatgactctgcttaataattgggaaaatacttacttcaccttcgatgaagaattactgggcaaactgatgaaagaggccaaacacctgggcgtagatatgttcctgcttgacgacggatggtttggcaacaaacatccgcgcaacgatgaccatgccggcctgggcgattgggaagcgatgaaaagtaagcttcccggaggaatccctgcattagtagagaaagcgaaagaagccggtgtcaaattcggtatctggattgaaccggagatggtgaatcccaaaagtgacctgttcgaaacacatccggaatgggctatccattacccgaaccgggaaacttattatttccgtaatcagttggtacttgacctgagcaatcctaaagtacaagacttcgtgtttggtgtcgtagataagattatgacggagaatcccgatgtagccttctttaaatgggattgcaacagtccgattactaatatttattcgccttacctgaaagataaacaaggacagctctacatcgaccacgtgcgcggtatatataatgtattgaaacgggtaaaagagaaatatcctaatgtgcccatgatgctttgctccggtggaggtgcacgttgtgattatgaagcactgaagtacttcaccgaattttggtgttcggataataccgatccggtagaacgcttattcattcagtggggcttctcacagttctttccggccaaagcgatgtgtgcacacgtaacaagctggaacagcaaaacaagtgtgaaattccgcaccgatgttgccagtatgtgtaaactcggtttcgacatcggactgaaagacatgaaagcagatgaacttacttattgccaggaagcagtagccaattataaacgcttgaaacctgtcattctagatggtgatcaatatcgtctcgtatctccatatgatggcaaccacatggcagtgatgtatactgcccccgatgcttcgaaagccgtcctctttacctacgacatccatccgcgtttcggcgagaaactactaccggtaaagctccgggggcttgatgcccaaaagatgtaccgggtgaaggaaattaatctgatgccgggtcggaaatccaatttgtcgggtaatgaaaaaatcttctccggtgactatctgatgaaaataggattgaatgcatttacaacttcacaaaccaatagccgggtaatagagttggtagcagagtaa

SEQ ID NO: 40 - DNA, 1218 bp, B.fragilis
atgatgaagttgttccgcgagatattgattatttgtcttcttgggaagttaatagcttgttcgccattagcttccggggagataaatgatgtttggggacataaacaagtggctacgattgaaatggcaggctctgatagcgtttgggtctgccacttgtctatgttgaaggatacggttactgtacctcttagttattttgtcgaggagctggaaatggtcaaacttgataatcgggatgctgcattggtatcttcttccaaaacaattattggcaaacaatatattttagtacataaaatggggcatgtccctttcaaactttttactaaaagcgggacttatttgagggatatcggttcctttggtcaaggtgcgggtgaatatggcttagcttatgatgcacagatggatgaggagaataaccgactttatgtgttatgttggcaggccgaccatatcttggtattcgatttacaaggaaatatacttcaaccgattcgattggcgcattggtcacctaaaggggtatttcatgtagaaacggaacgaggacgagtgcatgtttgtgctctttcttttaatcgtgactttgtaggtgataggcattcgcctatgatttggacgcaaagtttggatggcaagattataaaagaacttccggcagggtatttggccgtgaatgattatggaaatgaaatcaaatctctaaataatgggacggtgatggacattggtttctggtttggaggccaatatcgtaacgattcattatatcactataataaccaggagtttaggcttcttccgcgttttacgcttgattatggaggacatgaattgaccccacacagcttcggagagttgccgaatcacttctggggagaaatatcatatcctgtaaggctaagtccacattcgtcaactaccactcctccggaatattatatggttgataaacatactttacgaggcgcttttgttgaaatatacaatgatttcttagggggcattcctgctgactggttcttttcatctcatgacggatattatgtttggaatgttgaacctgtacgattgaagcaaatggttgaggatcgtttgtcttcaggtgagattgtctcggattcggaccgaagaaagctaaccgaactgcttaggagtactaaagaaaacgataacaattatattttctatggtcgattgaaatgtagatag

SEQ ID NO: 41 - DNA, 1203 bp, B.fragilis
ctgatatttgccaccccactcttctacgagataattcatctgagccaatgtctctttaattttctcgggattagcatgaggcttatctattttattaatagcaaatacgataggaacacctgctgctgctgcatgattaatggcttctttggtctggggcattacatcatcatcggcagctacaataataattgcgatatcggtcacctttgcaccacgggcacgcattgcagtaaatgcctcatgtcccggagtatcgaggaacgtaatcttacgtccatcttccaatgtaacatgatatgcaccaatatgctgtgtgatacctccggcttcacctgcaattacatttgctttacgaatgtagtcaagcaacgaagttttaccatggtctacgtgtcccatgactgtaacaatcggagcacgatgttccagatcttccggcgcatcttcctcttcaacaatggcttgggctacttctgcactgacatattcagtcttaaatccaaattcttcagccacaagattaatcgtttctgcatccagacgctgattgatagaaaccatcataccaatgctcatacaagttccgataacctgatttacagatacgttcatcatgcttgccaattcattagcagtcacaaattctgtcagtttcagtaccttgctttctgccatttcctgatcttccagttcctgcatacggttggacgccatgtcacgtttttctttacgatatttggcacctttgttcttacctttgcttgtcagacgagccaacgtttctttaacctgctttgctacatcttcttcgcttacttcctgctttactacaggctttttgaagcggtctttattattgttattacggtttctattctgtccgccgccaccttgttgatttcctccacggttattattcgtacgctcactgtttggagtagggtgtgcaaaattagaagcaacattgttcacatctactttttccttattattgttgatgcgattacgtttcttcttaccgttaggatcaaggttttccttaccaacgaccttagcttgtttactatcttctttacggatttccttgatgatggcttccttcatctgtttcttctgatcctgacgaagcttttccttctcttcacgctctttccgcttttcctctttcgatttcttcttcggacgtgtcgactgatttaa

SEQ ID NO: 42 - DNA, 525 bp, B.fragilis
tttaatgcagccaagtcaatctgcccgataacattaatcttagatacaaactcagtcggacggatcttaaatacgccctcctcttccttctctactggagtaaccggtgcttctgctaccggtttctcttctttcttctctgttttttctggagacaccacgacttttggttcttctttcttgacttcctcaaccactttcttttctgtttcaacaggcttttcaaccaccaccggtttcggttcttctttcaccggtttcggttccgaagtagcaggagtcacagtgacttcttcttttttcacttcgattacaacaggcttaacctcttccgctactttcttttcctcagcagctacaggttgtggttttggctcttctttcatcggttctttctcaaccttccggttcagtttatctaaatcaatttttccgacaggtttaaacttcggacgcacatcttccggaatgaccgtcttaatcacatcgtcagcaacagtcttctccggttccttcttatcataa

SEQ ID NO: 43 - DNA, 1269 bp, B.fragilis
ataattatggccaagaaagaagaaacaatcagcttgattgatacattttcggaatttaaggaactgaagaatatcgatagaaccacgatggtaagcgtgctcgaagagtcgttccgcagtgtgatcgcgaaaatgtttggcactgatgaaaattacgacgtaattgtgaacccggataagggtgactttgaaatatggcgtaaccgtgaggtagtggcagacgaggatttgactaacccgaatatgcaaatttcgttgactgaagcacaaaaaatcgatgcttcttacgaagtgggtgaagaagtaaccgatgaagtgattttcgctaagttcggtcgccgtgctattttgaatcttcgtcagacactggcttctaaaattcttgagcttgaaaaggacagtatttataataaatacattgataaagtaggtactatcatcaacgcagaagtataccagatctggaaaaaagagatgttgttgcttgacgatgaaggaaacgagttattgttgccgaaaacagagcagataccaagcgatttttatcgtaaaggagaaactgcccgtgcagtggtggcacgcgtggacaacaaaaacaacaatccgaaaattatcctctcgcgtacttctccggttttcctgcagcgcttgttcgagatggaagtacctgaaataaacgatggcctgattaccatcaaaaagattgcccgtattcccggtgaacgtgccaagattgcggtagaatcttatgatgacagaattgaccctgtaggagcctgcgtaggtgtaaagggaagtcgtattcatggcatcgtacgtgaacttcgcaatgaaaacattgatgtgattaattatacatctaatatttcattgtttatccagcgtgctttaagcccggctaagatttcttctattcgtctgaatgaagaagaacgtaaagcagaagtattcttgaaaccggaagaagtatcgttggctattggtaaaggcggtttgaatattaaactggccagtatgttgactgagtacaccattgatgtgttccgtgagttggatgaaaacgcgcaggatgaagatatttatttggacgagttcagagatgaaatcgacggatgggtgatcgatgctatcaaggctattggcattgatacggctaagtctgtattgaatgcacctcgcgaaatgctgattgaaaaaacggatcttgaagaagaaacggtggacgaggtattacgcattttgaaatcggagtttgaagataatgaataa

SEQ ID NO: 44 - DNA, 855 bp, B.fragilis
cttcccttttactattacgcagacggacggaaattccatattacaatggttggacgaggttatttttggaaaagaatagataatgaaataattgataagatcatgttagagataaaagacctgcatgccagcattaacggcaaagagatattgaaaggcattaacctgacggtgaagccgggcgaagtacatgccattatgggacctaacggttcgggtaaaagtacgctttcgtctgttctggtaggtaatcctgctttcgaagtgacgaaaggaagcatcacgttctatggtaaaaatcttttggaattgagccctgaagatcgcagtcacgaaggtatttttcttagttttcagtatccggtggagatcccgggcgtgagcatggtgaactttatgcgtgctgctgtcaatgaacagcgtaagtacaaaggattacccgctttgacagccagtgagttcttgaaattgatgcgtgaaaagcgtgcagtggtcgagttggataataaattggccaatcgttcggtaaatgaaggtttctcgggtggagagaaaaaacggaatgagatttttcagatggctatgctcgaaccccgtctcagtatcttagacgagactgattccggactcgatatcgatgcgcttcgtattgtagccgaaggagtaaataaactgaaaactcccgataccagttgtattgtcatcacccactatcagcgtctgctggactatataaagccggacattgtacatgttctttacaaaggacgtattgtaaagactgccggtccggaactcgctcttgagttggaagagaagggatatgattggattaagaaggaattaggagaatga

SEQ ID NO: 45 - DNA, 195 bp, B.fragilis
ttgtggggctattggcagcaaaagcctttgtacacctcactggctgtgaagttatgccctacggtgaccgactccatgactgtggcgcagatactggcatttatcattatctggatcgctgtggccgctaatctttacattggtggcttcagtattaaccaaggcattggaggcggtttcacttggctggcctga

SEQ ID NO: 46 - DNA, 348 bp, B.fragilis
tataaacctctaaatgaaacaagaattatgttattagcaaccactccaatcatcgaaggaaaacgaataaccacttattatggcattgtgtccggagaaactattataggtgccaatgtcttccgtgacttttttgccagtattcgtgatatagtaggcggacgctccggttcatacgaagaagtgcttcgtgaggcaaaagatactgctttgaaagaaatgtctgaacaggctcgccaaatgggcgctaatgctgtgatcggagttgatttggattacgaaacagttgggggaagtggcagtatgttgatggtaactgctagtgggacggctgtgttcttggaataa

SEQ ID NO: 47 - DNA, 1662 bp, B.fragilis
attagcctgtatatacctaccaccggacagggatatacaggctattttaccttacaaaaacaacaccttatgaaaaagaagaaagttactacttattgctgcctcctgttattggcaagctttttcacaactgtcacggcacaaaacacaaatactcccatgatggggtggagttcatggaacaccttccgagtacatattaatgaagaactaattaaagagacagctgatgccatggtcaaccggggtctgaaggatgtaggctatggatatgtgaacatagacgacggatactttggaggacgaaattcggaaggacgtctttttgccaataagaaaaaattcccgaatgggatgagagtcctgtccgactatattcattcaaagggattgaaagccggtatatattctgatgcgggcagcaacacttgtggctccatctatgacgcagatacactcggtatcggtgtagggctttggaaacacgatgatatagactgccaaaccttcctcaaagactggggatatgatttcattaaaatagactggtgtggcggtgaagcaaccggacaaagtgagcagcaacgttatacggatatctacaaagcgatcagacggacaggacggacagatgttcgatataatatatgccgttggcagtttccgggcacttgggctacccagttggcaggttcctggcgaatccatacagacatcaatccacgattcacaacaatcgaccgaatcattgaaagaaatctctacttagcaccttacgcaagcccggggcactataatgacatggatatgcttgaagtaggaagagggctcacggaagacgaagaaaaaactcattttggaatatggtctatcttgtcctccccgttaatgatcggatgcgatcttcgtacaattcctgaaaaaactttatcgatcattaccaataaggaagtgatcgcattaaatcaggattcattaggtctgcaggctgaagccattgaacggggaaaagactatctgattttatcaaaagccattcagaaacgtgaaggcaaactacgtgcagtagcactatataacagaagcaatacagatcagcagatcagagtcgatttcgataagctctatttatcaggggatgtacgagtgagagatctatggaaccatcaagaaatgggaacattcaccgattactatgaaacgctagttcctgcacatggaacagctttaataagacttgaaggtagcaaacgtcacgaccggacatgttatgaagctgaatatgctttcatgcaagaatttctgccagacaacaaacaggcagctcattttacaccaaaatcaggagcctcaggagaatatattatgaaaaatcttggaaattcaccttccaattgggcagaattcagaaacgtgtatattagcaaaggaggagattatcaacttaagttaacttattattcaggtgataaacgcgatatccaaatagctgtaaacggaacagaatataaacagtctaacctttattccggtacatgggatcaagcagctacaacaactatcaaggttaaacttcgcaaaggctataacacgatacgtctgtataattcgtacgggtgggcacccgatattgataaaatggaaatcatcaaaggtcgttaa

SEQ ID NO: 48 - DNA, 1350 bp, B.fragilis
ataacccgacaattcatgaaaaacaccaaccgttccattctccataaagatggagtaagttatatcctaccatttatcttagtgacctcttgttttgctctatgggggtttgctaacgatattaccaatccaatggtgaaggctttctcgaaaatattccgtatgagcgtcactgatggagcactagtacaagtcgctttttacgggggatactttgcaatggcctttcctgctgcaatgtttattcgcaaatactcttataaagccggtatcctgttgggactggggctatatgctttgggtgccttgctgtttttcccagcaaagatgacaggcgattattacccttttctgctcgcttattttattttgacatgtggactctcgtttctggaaacaagtgctaatccttatatattatcgatgggtacagaagagacggcgacccgacgattgaatctggcgcagtcgtttaatccgatgggatcattgctcggcatgtatgttgccatgaatttcattcaggcgcgtctgaatcctatggatacggtagaacgcagccaattgtctccggcagagtttgaagtattgaaagagtcggatctctctgtgttgattgctccttatctgattataggattagtaattctagcgatgctttttgtgatacgtgccgttaaaatgcctaagaatggcgataagaaccataatattgattttatacccacattgaagcgtatctttaaaattccccattatagagaaggagtcatagcacaatttttttatgtaggtgcacagattatgtgttggacttttgttatccaatatggaacgcgcttgtttatgtcgcagggaatggaggagaaggctgctgaagtgctttcccaggaatataatataattgctatgattattttttgcataagcccgtttcgtgtgtacatttattcttcgctacctgaatccggggatgcttctcaagattcttgcgattgcgggtggtgcttttacgttaggtgtgatttttttgcaagacatatggggattgtattgtttagtagctgtttcggcttgtatgtcactaatgtttcccacgatttatggccattgctcttcgtggtttgggtgatgatgccaaatttgggggctgccggtttgattatggcaattctgggaggctctgtgttgccaccattacaggcttgtattattgaccaacatacattgttgggtatgcctgctgtaaacttgtctttcatacttccttttatctgtttcgtagtgattatcatttatggacatcgtacgtgtgcacgtgtgaagaagataaaagcagcacgaaagtaa

SEQ ID NO: 49 - DNA, 1722 bp, B.fragilis
gcaaagcggcatataccattaatacggctttcgaactggaacagaaacttgacttcccttaccaaaggattgaattttaaagcactggtttcttttaaaaactggtcgaagacgactgtcaatcgctccttttcaccttacttttatgaattacagaatcctcaggagcaagaagacggaagctatctttatgattataactctatcagtaagggacgtaccgctcttgagacatcgacttccactactggcgaccgtctgatgaacctgcaggctacactgaactatcagcgcatgttcggtgataaacatgatgtcggagcaatgttggtatatcttcagcgcgaatacaatctgaacaatcctgacaataactattacaatacattgccggaacgtaatcaggggctggccggacgtgttacctatgcttatgacggacgctatttggctgaattcaatttcggctacaatggtagtgagaacttcgaaaaaggaagccgttacggattcttcccttcactcgctgtcggctatcttatctccaacgagaaatttttcgaaccattgacaaaagttatctccaacttaaaaatacgcgcttcgtacggattggtaggtaatgcggatatcggctccaaccgtttcccctatcttactaaagtagatttgggtggagccggatttgtattcggtgaccagtggcaaacctcatctaacggagctaccatcactacttacggagctgaaaaggtgacatgggaaatcggtaaaaagtataatgtaggattcgacctgggattattcaacaaattaagcctcaacgtagatttctttagagaagaccgtaaagacatcttccttagacgtaatacaatccctgcagaaagtggtatcaccggagatctccgaccctatggtaatctgggtaaggtacgcaatcaaggcgttgacatgtcattggactataatcacgctgtcagcaaagacttcatgatctctgccaaaggtactttcacatacgctaagaaccaatatatggaaatagacgaaccggactacgaatatgcatacatgtcacaagtaggacgccccctgaatcagtataaaggctatattgcattaggactcttcaaagatcaggaagagattgacaacagtccaaaacaaatactaaccggagttgtgcaaccgggtgatattaaatatgcagacctcaataatgacggaaagatcgacggaaacgatcaaacttacattggtaatccggaattaccccaaatcagctatggtctgggagtcagtatccagtacaaaaaatgggatgcttccatcttctttcaaggagtaggcaaaagaagcatcatgttgagcgacatccatcctttcggtggagaatcgtatggtgtcatgcaatttgttgccgataatcattggacagaggcaaacccgaaccccgaagcaatgtatccgagactgacaaacgggaaaaacaacaataataaccccaactctacttactggctgagagatggttcgtatatccgacttaaaaacgtggaattaggatactcttataaatttttacgtgcctatatcagcggacaaaacctgctgacattctctaaatttaaattatgggatccggagctctatacctcaaacggattaaaatatccgacacaaatcatgggttccatcggtttacagttcactttttaa

SEQ ID NO: 50 - DNA, 1668 bp, B.fragilis
  unsure (1640): Identity of nucleotide sequences at the above locations are unknown.
aatcaatgtaaatgtatgaaaaagaaagcaattccttgtcataaggcagggaggattacgtccttttttttattaattagtatttttttacttataccgagtatcactactccggtttatgctgtagaaacttatacccagcaaactgtttttacgcttcacgcaactaataaaacagtaaaagaagtgtttgaatacatcgaaaaaaacagtgaatttgtcgttttgtattcaaaagatcttttacctgtactgcagaagaaagtgtctgtttcgatagataaacagaatgtagaatcgattctgaatatcttgtctaaagaagcgggattgaagtacaacatcaacgaccgtcagatcacaattaccaaagttacggcagaagcacctcaacaggaaaaaaaaatcaaaatcaccggtcaagttcttgacgaaaacggagaagggattccgggagcaaatatcgtaataaaaggcaatagtacattgggaacagtaaccaatgtcgaagggaactttacattaatggctccggaaaatagcacattagtagcctcctttatcggatatacccctgttgaaattccgctaaaagggaaaaagatagttgttttcaaattggtacctgacgcccagagtctggaagaagtagtggtagtaggattcggaacacagaaaaaagccagtgttgtaggtgctgtacaatccatcaaaccggctgaacttcgagtaccttccagtaacctgagtacatcatttgccggacgtatagcaggcgtgatttctatgcaacgcaccggtgagccgggtgccgatggagcaaacttctggatacgcggtgccgcaaccttcagcggaacgactgatcctctgatcttcatcgatggtgtcgaagtttcggcaggagatatgaacgctattccctcggaagctatcgaaaacttctcaatattgaaagatgcctcggctacagccctctacggagcacgcggtgccaatggtgtcatcctgatcactacccgaaccggtaaagatcttgaaaaagcacgcatcaacgtacgcatcgataatacatttaccgcaccgacacgtacactcaaactggcagatgcagtaacagccatgaaattgagaaatgaagccattctgacccgtaacccggatggtacaccggctttctcagatgataaaattcaaggaacgcttgaaggcagaaatcagtatgtatatcccaacgttgattggttcgactatatgtttaaagactactccatgaaccaatcagccaacctgaatgtaatgggtggtacaaagaaagtagactatttcatcagcgcctccatcaataatgataatggtatgctgaaaaaagatccgaataacacattcgacaacaatatacagaatcttcgctactcgttccaaagtaacgtgggagcatggttgacatcaagtaccaaagtaaatgtgagaatcaactcgcaaatagtcaattacaatggtccgtcaaccagtatggacgatttgtataaatacgtaatggaagctccgtcaatgtattttgcacctgtatatccgaatatcaaccgtgaagatcacactatattcggaaacaaatcaggtggtcctatcggttccgnaggattcagtatttatcgcaacccttaa

SEQ ID NO: 51 - DNA, 411 bp, B.fragilis
atattaagaaaagaagtttatattttatatttttgcagcgcacatatggtaaccattactctatatatgaacaacaacatagaatatatcagcaagataaagaaaggagaagagacttctttccgtcattttgttaatagctattcgaaagacttgttctactatgcacagtgtttcgtacgaagcaaagaaaccgctgaagaagtagtcagcgacgtctttctggatgtatggagacaccgcgaagaaatagatgaaatcaagaatataaaagcttggttgctcacattaactcataacaaagccatcttctatctgagaaaagcggaaaattcaagtgaaattgcttcatgggaagaaatagatgattttcaaataatcggaaatctgcaactccccatgaagagatga

SEQ ID NO: 52 - DNA, 1851 bp, B.fragilis
  unsure (920): Identity of nucleotide sequences at the above locations are unknown.
ataattatgaaactaaaaaatataattgtagctttactaatcggagctagcttacactcttgtgattatctggacattgtacccgatgacacccctattttggctgatgcgttcaagaacgaacagactgccgagaactttgtcttcgcctgctattctttcattcccaattatctgaacttccgtcagaacttcagttggtgcacaactccggaaactgtcggatctgcccactggaccactacttggttcacctttatgagaatgcaacaaggattgtacaattctgctgatccaatcattgatgtgtggcaaagttcatacaacggtatccgccaatgttatacgttcttggataatattgatgatgtaaagccatcacaaatctcagaggcagacctcgcagccaagaaagtactttggaaaggtgaagtaaaatttctgattgcctactaccactacctgctattacagaactacggtcctatagtcatactggacgaagcaatccctcttaatgcacccaaagaagaacttttcaagccgcgtgtaccctatgatgaatgcgttagccgaattgctcaaatgttcgataatgcctctgccgacctgcctatgacagtgaaagcttccaactacggtcgtgctacaaaagtcattgcacaagcactaaaggcaagaatgtacttgtacgcagccagcccacagttcaatgggaatgctgatatgtataagaatttcaagaacaaggacggacagttgctcatgaacctgacttatgacaagaataaatggaaaactgccatggacgaatgtaaaaaggcaatcgacatggcacatcaagccggagcagaattgtataagtatacaaagaaaggtaatctgccggaattcaaccaagccattgccaatgcacgtanacctgttgtagacgcatggaataaagaactgatctggggatatagtggctggaaagaaacatgggccgatggaaactctattcaaacacacgtaattcccaaaggtatcagtacttcctcgggagcaccttatggagctttaggtgcaacggctttcagtgcggacatgtatctgaccaagaacggacttccgatagatgaagatccagagtttgattatgcacatcgtttcacagtagccgaaggggattcggtagcagtgctccatcgcaaccgtgaaccacgtttctatggttctatcggcttcaaccgcggggactacctgatcaacggagacaccattaacctcaaaatgcgcttcaaagagcaaaatggaacacgtgatgcgggaagtgaccaattatatggatcgtatgctatcgccaaactggctcatccagaaacttttgttagtggtaccagcaactctctggtagctttccctttccctatcatccgcttaggagaattgtatttggactatgcagaggcttactttgaatacaatggaacactggaaggagatgcacttacttacttcaacctgatccgccagagagccggtattcctaatgtagaagtttcctacaaaggacttccgtccggagacaaacttcgtgaggtaattcatcgtgaaagaaccatagagctgatgttcgaaggacatatgtcatacgactatcgccgttggctgattgccctgaaagaatggagcggtatggaaaatggtatgatcggattgaactcttacggtacaaccaacgaagagtattataaaaatgcacgtttggatgctcaaccattcatcttcagggatgaacagtatttgagtccaatcaaacaggattacctgaatgtaaattcaaatctggtccagaatccgggttggtaa

SEQ ID NO: 53 - DNA, 339 bp, B.fragilis
acgataaagaaagaaaaaggttgcaggaatccttcatttattatctatttatacggatcggtcgttggaagtaatactgtacggtacttgctccgccttcccttggttgacggaggaaaaacagacctcctccccaaaaaagttaaagacagagccctaaagtcattcaacacatttcagcaagcccctatcaaacataaaaaaatgtcgcaaaagcaacaactttcacgacacttcaatatctgtcagaatacacatgcctcagaacatcttactgacccgttcgataccagctacaagagcatcaacttcctcttttgtattatacacggcaaatga

SEQ ID NO: 54 - DNA, 1134 bp, B.fragilis
aagcagcacgaaagtaatattgagaatcggatgcggtgtttgacgattcttctgggcaactgttttcttctgcttgtgtcattagcctcttgcgggaaagtgtcattagcggaagaagcagtgttttctataccggtggatacgacatttatgaggcttcgtcaatgggagtggtattgtcagaaacgggctgacagttgtctgacagagaataattatcagggagctttatcttggctggattccgctcgtatccaagtggaacattacggacgtccttattatatattggcacgcggggacgtatattattccatccatcaatatgattctgcccgtcgttattttagtatggcagtccattccattcatccacatattgctatcgaagcttggaggaaacttgcagaactggaacttatggaaggaaatgagaagcaagggttctattctacgcagaaggcagatgcacttttccgggtggagataggccatgtgcagagtgataacagtgaagctctatatcaggaagagaggttgaaaaacgagttaaaccaattgaagattgccaaacagaatagggaaattgccatgttaactttgagcctttgtctgattatactgattgctttgtttattttctaccggcaaaataagataaagcgtgaaaaagagcgtctgcttcttgaagagaaagccaagttggagcaagagaaccaaatactgaaacaaactgaagagttaagtgctttgagagaaaaagaggcggttttgcgagagtctttgttccgtaaggtcgatgttttgcgtaaaataccctccctcaatgaagaagaacaggagagtggtgaacatcgcatagctttgtcggaaagggagtgggaggaaattcgtcagacagtggataatgcttatgatgggttttcacaacggttgcttgcacgctttcctttgttgaccttaaaagatatttatttctgttgtctggtgaagatcaatgtcagtataaaggacctttccgatatttattgtattagtcgtacctcggttagtaaaaagaaatttcgcatcaagcgagagaagcttggagcagaggattcggactctttagatgactttttacgtggtttttag

SEQ ID NO: 55 - DNA, 471 bp, B.fragilis
  unsure (228): Identity of nucleotide sequences at the above locations are unknown.
tcaatgatagaaaaaagaactgtttgtcagattgttgaagaatggctggaggataaagactattttctggtagaagtgaccgtcagccctgatgacaagattgtggtcgaaattgaccatgcagaaggtgtttggattgaagactgtgtggagttgagtcgcttcattgagtcgaaactgaaccgtgaagaggaagattatgagctggaagtacgttctgccggaatncgacagccatttaaagtattgcaacagtactataaccacatcggcctggaggtggaagtgctgactaaaggcggacgcaaactgagcggggtcttgaaagatgctgatgaagaaaagtttgttgtgaccgtacaaaagaaagtaaaacccgaaggagccaaacgtcctcaattggtagaagaggatgaaaccttcacctatgatgatataaaatatactaaatacttaattagttttaaataa

SEQ ID NO: 56 - DNA, 1566 bp, B.fragilis
ccaaacaaagaaggagcagtccttgttatattatcttatggaaagctttgcggggatcttctttcctgcagcaaaagaggttacacaacaatatatattcaaataaaaatgatgcaacaagaagaacccaataaatatgtaaaagaactcacgcaggagaagtataaatacggcttcactacggaggtacatacagatatcatagagaagggactcaatgaagacgtggtacgtttgatctcgtctaaaaagaacgagccggagtggttgctggagttccgtctgaaagcttatcgtcattggttaacgctggagatgcctacttgggcacatttgcgtataccggaaattgactatcaggcaatctcatattatgccgatcctacgaaaaagaaggagggcccgaagagtatggatgaagttgatccggaattgataaaaacattcaataaactcggcattccactggaggagcagatggcattgagtggtatggctgtggatgcagtgatggactctgtgtcagtgaaaacgacctttaaggaaacactgatggagaaaggtattattttttgctcattcagtgaagctgtgcgtgaacatcccgacttggtgaaaaagtatctcggatctgttgttgggtatagagacaacttcttcgcggcattaaactcggctgtattctcagacggttcttttgtctatatccccaagggggtacgttgtcctatggaactctctacttatttccgtattaatgctgccaataccggtcagtttgaacgtacattgattgtggctgatgacgatagctatgtttcctatctggaggggtgtacagctccaatgagagatgagaatcaattacacgctgctattgtcgaaatcatggtacatgatcgtgcggaagtgaaatatagcaccgtgcagaattggtatccgggcgatgccgaaggcaaaggtggagtttataattttgtgacaaaacgtggcaattgcaaaggagtagacagtaaactttcatggacccaggttgagacaggttcggctattacatggaaatatccgtcttgtattctttccggggataattctactgcagagttttattctgtagctgtgacgaataattatcagcaggcagatacaggtactaaaatgattcatttaggtaagaacacccgtagtacgattgtcagcaagggtatatctgccgggaagagcgagaactcttaccgtgggttggtccgtgtagccgaaaaggctgataatgcccgtaattatagccagtgtgactcattgctgttgggtgataagtgtggtgcacatacttttccctacatggatatccataatgaaacggcagttgtggagcatgaagcgactaccagtaagattagtgaggatcagatattttattgtaatcagcgtggtatttctacagaagatgccattggattgatcgtaaacggctatgctaaggaggtacttaataaacttccaatggaatttgccgtagaagctcagaaactacttacgatctctcttgaaggcagtgtaggataa

SEQ ID NO: 57 - DNA, 246 bp, B.fragilis
ccaaggcattggaggcggtttcacttggctggcctgaatcgcatgcttgaagccgggctcggagctttaaaatatcttttattggtgagcttggttatatgtgtcattcagtttatagactccgatagtcagttgattagccaaacaaagaaggagcagtccttgttatattatcttatggaaagctttgcggggatcttctttcctgcagcaaaagaggttacacaacaatatatattcaaataa

SEQ ID NO: 58 - DNA, 1341 bp, B.fragilis
ctttttacgtggtttttagttctcggaaacttgtttgtccatgctaatttaagaaatattttatataatatgttgatatatagtgtggtatcgtatttctttttgaagtactttgtctatatccctttttgtttttcctctgcccgatggttaattttgcaatatcaaaactttaaaaatgtacgtgatatgttgaatcgactgaactatttcattatgttggcagggctacttgttttagtagcatgttcgtctaattccggaaaacaggtagaggttgcaaatactccttttgtttacgatggattaaaagagtatccggtaaaagagttgaaactgtccgatctggcagttagtgattatgtgttattaaaagacgatgaaaattcattgttgggtaggttaccgacaaatccctgtatgcaggtcactgaagaccggatttatattcaggatgaagagcaacaggctatatttatttttgaccgtcagggaaatccattattgcaaatgcgtcataaaggaggtggtcctcaggaatgggcgtctctgaactctttctatgtggacagccctaataaagaaattatagtgttggactgggctaaaaagtttatagtttatgatttgaatgggaaatttaaacgaagcttcccaacgcccggttgctcttggaagtttgctaatttgaatgatgaggccgtactgatatattgtccttttacgaatcgtaataacggagaggcagtttgtatcctttctaaaaaagatggcaaaaagttgtatgtgtgtcctattacgatagataattttgtgtgggatagtgagggacgtattggctatgaaccattgaagccagcttatggtgggattttattttcagatttatcattgaaaggcgtgtattttattgatgctgaaacatatgaagtaaaacaggttattgatgaagtgacagaatataaatttgaaaatgcagagttcgttaagctacatccggcgatcgatgctaaagactatactttgtatactacgctcggtacgaaatggttgactccagatatgccaatgaactattattattttgataagaaggagcaaaaaatgtatactttgaaaaatgaaaccggatgggctgttttaaaagatatctgcaatgtacagagaacccgtacaacgaatactccaggtatcggcattggttattattggccttctactatgaaaggagagtcgatgcaagctgaaaaagagcagtttgactctcgtttccgggcaataatggactctatacctgaagaaggtaaccctgtattacaaattatgaacttcaataaatga

SEQ ID NO: 59 - DNA, 270 bp, B.fragilis
ttacaactccgtgtctccgtttttgttttacatagaatgacgaccatagatattatcatactgattgctcttggagccggtgttattgtcggatttatgaagggctttatccggcagcttgcttccattctcggattaattgtggggctattggcagcaaaagcctttgtacacctcactggctgtgaagttatgccctacggtgaccgactccatgactgtggcgcagatactggcatttatcattatctggatcgctgtggccgctaa

SEQ ID NO: 60 - DNA, 1371 bp, B.fragilis
gaaggaattaggagaatgagtttaattatgaatgcagaacagcaatatatagatctcttttctcagtgtgaggcgatgatctgtcgtcatagcgctgaggcgttgaatgccccccgggcaacagcttttgctgatttcgaacgtcaggggtttcctacacggaaacaagagaaatacaaatatacggatgtcagtaaattctttgagccggattatgggttgaacttgaatcggctgcccattccggtgaacccttatgaagtgtttaaatgtgatgttccgaacatgagcacttcattgttttttgtagtgaacgatgcattctacaatcaggtgcttcctaagtccggattgcctgaaggagttatcttcggtagtttgagaaatatggctgaacagcatccggaacttgtgaagaagtattatggtaagttggctgatacttcgaaagatgcggttacggcttttaatacagcttttgcacaggatggagtattgatgtatgttccgaagaatgtgatcgtcgatagacctattcaactggtcaatatacttcgtgcggatgttaatttcatggtaaaccgccgtgtgttgattatccttgaagaaggggctcaggcccgtttgcttatttgcgatcatgcaatggataatgtaaacttcttggctactcaagttattgaagtgtttgcagaagagaactccgttttcgatctttatgaattggaagagactcataccagtacagtgcgtttcagtaatttgtatgtgaaacagggagcaaacagcaatgtattgcttaatggaatgacacttcataacgggacaacccgtaatacgacagaagttacccttgccggtgaaggtgccgagatcaatctttgtggtatggccattgctgataaaaaccaacacgtggacaataatacctcgatagatcatgccgtgccgaattgtaccagcaatgagttgtttaaatatgttcttgacgatcagtctgtgggagcttttgccggtttggtactggtacgtcctgatgcgcaacataccagttctcagcagacaaaccgtaacctctgtgctactcgtgatgcccgtatgtatactcagccgcaactggagatatatgccgacgatgtaaaatgctctcatggagctactgtaggtcaactggatgaaaacgctcttttctatatgcgtgctcgtggtatcgccgaaaaggaggcccgtctgttgctgatgtttgcatttgtcaacgaggtgattgataccattcgtctgaaggcgttgaaagatcgtctgcatttgttggttgaaaaacgtttccgcggtgaactgaataagtgccagggatgttctatttgcaaataa

SEQ ID NO: 61 - DNA, 762 bp, B.fragilis
aggcagtgtaggataatgaagacgaaacgtgttggttggctattgatattcctgtcctatgttggtgtagtactggcacaaaaccttgacgatcaagaaaggaggtgggcgatcagtggctcttggggaggaaattggccgatagtcacaaagaatacactttcgggaaaagctgtttctgcaggacatatacatactttaatgttggagtattatattccttatacccgtttctccctgaaaggaggatatacaggtgaagaaataggtttgaatccaggtatttctgcctcaatgagtaatctggaaataggagggcggtattatttcttaccacaacggtttgcaatccaaccttatgggggactttctactggatggaacctctctccacgaaggcaggaggggatgggcagtagcagttattacgatccttcaaggcaagagtttcgtaaagattacgattatcgataccgaattaaagaaccattattcacagtttctcctgtggtgggagctgatatatattttctttcttgtcttgctctcaccttggaatataatttccggatgggcattgccggaaagataagtggagagatagagaagaccaattctcgtggaaccggatttgtacgtagcaatgggatgcggcagaccgtaagtgtaggggtaaaggttaacttcccttttactattacgcagacggacggaaattccatattacaatggttggacgaggttatttttggaaaagaatag

SEQ ID NO: 62 - DNA, 879 bp, B.fragilis
gaagacggtggcggatcttctatggatacggcaaaggcgattggtattattaccaataacccggaattcagtgatgtcgtttcattggagggagtggcagataccaagaagaaatctgttcccatcatcgcgttgcctactactgcaggaactgcggcagaggtgactatcaactatgtgataacggatgaaaagaaccagaagaagatggtttgtgtagatcctaatgatattccgtctattgcgatagtggatgctgagttgatgtacacacttcctaaaagtctgactgcagctacgggactcgacgcactgactcatgctattgaaggtttaataaccaaaggggcatgggagatgagtgatatgttcgaaattaaagctattgaaatgatcaatcgttatcttgtgactgccgttgaagaaccatcgaatgcagaggcacgtaacggtatggcagtggctcaatatattgcaggtatggctttttcgaatgtaggtttgggagttgtgcatggtatggcacatccgttgggagctattttcgatattcctcatggtgtggccaatgctctattattgcccattattatggagttcaatgctcctgcagctcttgacaaatatgttgagatagctaaagcgatgaatgtgtattctactgacatgactaaagaaaaggcggcagaagcagcagtcgaagctgtaaaaacattatctttgagggtcaatattccgcaacacttgtcggacttgggtattcaggaaagtgatcttgaccgtctggccacagcagcgtttgctgatgtatgtacgccgggcaatccacgggaagtaacaaaagaaattattcttgatttatataagaaagcattatga

SEQ ID NO: 63 - DNA, 648 bp, B.fragilis
gaaagcattatgataaccaatgaacatatcgagcaataccttgctcaggcacatcgctatggcgatgccaaattgatgttgcgcagtagcggtaacctttcatggagaatcggtgaagaagcgcttgtttccggaacaggttcttgggtgccgaatttgcagaaagagaaagtatccatttgtaatattgctacgggtacgcctcaaaacggtgtgaaaccttccatggaaagtacctttcatctggggattcttcgtgagcgtccggatgtaaatgtcgttttgcattttcagtcggaatatgctacggctgtttcttgtatgaaaaataaaccatctaacttcaatgtaactgcggagatcccttgtcatgtacgtaaagagattcctattattccttactaccgtcccggttctccggcgcttgccaaggctgttgtggaagcgatgaaagaacataattctgtattgctgactaatcatgggcaggtggtatgtggcaaggactttgatcaggtatacgaacgtgctactttctttgagatggcttgccgtatcatagttcaatccggaggggactattcggtcttgacgccggaagagattgatgacttggaggtatatgtattgggaaagaaaacaaaatag

SEQ ID NO: 64 - DNA, 1167 bp, B.fragilis
tgtaatcctattaaaataatgagaaagaataagtttaaatcatttgcttcacgcctgaataaggatggcgatcatccggaaaagatatcatttgaatctccggaagaacaagccgaatatgataagctcgactttctctggaaccgatgtctccccgaagaaacgggtgaaccggatatatgggcaaaagtgcaggcaaaaataaatgccgacaacaccccggtccgtcttgccttgaagagcaataagacggcaaggttgttcagtattctgaaatattcggcagttgcagcttctgtagccctgttaataggagccggctgttttcttttattgaatgatgaagagagacatgatctgaataaaatagcacaaagtctgcaaacagaaattccacaggatataaaagaagttacgctggtggtttcggatcaaaagaagatagaattggacaataatgcccagatcgtctattcggcaacaggtcaggtgcaggtcaactctaataaacttgtggaagatgacattaaagaggaatacaatcagattattgtcccgaaaggtaagcgttcacagattgtcttagccgataacagtaaaatatggatcaattccgggagtaaagttatctatccccgtgcatttgaagggaaatacagagaaatttatgtggaaggagaagtgtatctgaacgtaacacatgatacttcgaaaccgtttattgtgaatacttccggatttgaagtacgcgttttgggtacatccttcaacatatcggcttataaaaatcaggaaaaagccgcagtcgtattggtagaaggttcggtcaatgtaaaagaccaacaaaatcatcatataaagatggtacctaacgagaaagtagaacttaatcaggaaggtatatcaggaaaagaaaaagtaaatgcccgtgattatatcagttggattgacgggatatggaccttgcagggagaaagcctaaagcaagttttgttacggctgcaaaattattacggacaaaacatccggtgtgatgctgcgatagagaacgaacaaatgtttggtaaactctttttaaatgatgatttaaatcaggtaatgaagtcaattctatctatcttgcctgccgaatacacaatgaaaaacaatgtaatctatatagaataa

SEQ ID NO: 65 - DNA, 1467 bp, B.fragilis
cttggaggtatatgtattgggaaagaaaacaaaatagataatgactaccagcttatgagtacttacttagcagctgactttggtggaggtagcggtcggattatggccggtacccttaccgaaggtaagctaaaactggaagaggtatatcgttttgccaatcggcagataaaacttggaaactgtgtttactgggattttctttctctttttgaagaaatgaaaaacggacttcgtgtcgctgcccggaaaggctatgaagtaaaaagtatggctattgacacctggggagttgattttgggttaatagataaggatggtaagttgctgggcaacccggtctgttatcgtgattcccgtacggatggtatacctgaaagagtgtttaaacagattgatcagactgttcattacgctgaaatcgggattcaggtgatgcctatcaatactctgtttcaactttatagtatgaagcagaatgatgatgtgcaactccgggtggctgataagctattatttatgcctgacctgttcagctattttcttaccggagtagcgaacaatgaatattgtatcgcttctacttcagagctactggatgctcgtcagcgtaattggtcggataacttgatcagtgagttgggattaccccgtcagctttttggtgaaatcgtttttcccggaactgtccgtggcaaattgaagcaggaaatagcagatgaaaccggtttgggatgtatcaatgtcgttgctgttggttcgcatgacacagccagtgccgtatttgccgttccctccaatgaacccaatcgggcttatctcagttcgggaacctggtctttactcggggcagaggtagatcaaccgattctgacagaagaagcacgtgtggccggatttacgaatgaaggcggaatacaaggtaagatacgttttctacaaaacataactgggctttggattttacaacgtttgatggctgaatggaaagaacagggaaaggaaatcagttatgattgtgcaatagctgaagctacagtgtcggatatccgttcggtgattgatgtggatgattctgctttttgcaatcccgaccatatggaagagtcgatcattaagtattgtcataagcaccatttacggacaccagtctctcaaggagaatttgttcgttgcgttatcgagtcattggcatatcgttataaattgggagtagagcagatgaatcgatgtctgccggcaccggtcaaacagcttcatattattggaggaggctgccagaaccgtctgttaaatcagcttactgccaatgctttaggtattcctgtgtatgccggtccggtagaagccactgctatcggcaatattttagtgcaggcaaaagcccaaggcgaagtcgattcttgggaagaattaaaagaaattatcataaacagtgtagaacctcaggtatattatcctgaataa

SEQ ID NO: 66 - DNA, 3051 bp, B.fragilis
aatatgacgataaggttaaacaaagttacaagagatttaaatgtaggaatcgcgacggtagttgagttcttgcaaaagaaggggtataccgttgaggcaaacccgaatacgaaaattaccgaggagcagtatgctatgctcgtgaaagagttcagcacagataagaaccttagacttgaatcggaacgtttcattcaggaacgtcaaaacaaagatcgcaacaaggcatctgtttctatcgatggttatgataagaaggaaccggagaagactgttgctgacgatgtgattaagacggtcattccggaagatgtgcgtccgaagtttaaacctgtcggaaaaattgatttagataaactgaaccggaaggttgagaaagaaccgatgaaagaagagccaaaaccacaacctgtagctgctgaggaaaagaaagtagcggaagaggttaagcctgttgtaatcgaagtgaaaaaagaagaagtcactgtgactcctgctacttcggaaccgaaaccggtgaaagaagaaccgaaaccggtggtggttgaaaagcctgttgaaacagaaaagaaagtggttgaggaagtcaagaaagaagaaccaaaagtcgtggtgtctccagaaaaaacagagaagaaagaagagaaaccggtagcagaagcaccggttactccagtagagaaggaagaggagggcgtatttaagatccgtccgactgagtttgtatctaagattaatgttatcgggcagattgacttggctgcattaaatcagtcgacacgtccgaagaagaaatcgaaagaggaaaagcggaaagagcgtgaagagaaggaaaagcttcgtcaggatcagaagaaacagatgaaggaagccatcatcaaggaaatccgtaaagaagatagtaaacaagctaaggtcgttggtaaggaaaaccttgatcctaacggtaagaagaaacgtaatcgcatcaacaataataaggaaaaagtagatgtgaacaatgttgcttctaattttgcacaccctactccaaacagtgagcgtacgaataataaccgtggaggaaatcaacaaggtggcggcggacagaatagaaaccgtaataacaataataaagaccgcttcaaaaagcctgtagtaaagcaggaagtaagcgaagaagatgtagcaaagcaggttaaagaaacgttggctcgtctgacaagcaaaggtaagaacaaaggtgccaaatatcgtaaagaaaaacgtgacatggcgtccaaccgtatgcaggaactggaagatcaggaaatggcagaaagcaaggtactgaaactgacagaatttgtgactgctaatgaattggcaagcatgatgaacgtatctgtaaatcaggttatcggaacttgtatgagcattggtatgatggtttctatcaatcagcgtctggatgcagaaacgattaatcttgtggctgaagaatttggatttaagactgaatatgtcagtgcagaagtagcccaagccattgttgaagaggaagatgcgccggaagatctggaacatcgtgctccgattgttacagtcatgggacacgtagaccatggtaaaacttcgttgcttgactacattcgtaaagcaaatgtaattgcaggtgaagccggaggtatcacacagcatattggtgcatatcatgttacattggaagatggacgtaagattacgttcctcgatactccgggacatgaggcatttactgcaatgcgtgcccgtggtgcaaaggtgaccgatatcgcaattattattgtagctgccgatgatgatgtaatgccccagaccaaagaagccattaatcatgcagcagcagcaggtgttcctatcgtatttgctattaataaaatagataagcctcatgctaatcccgagaaaattaaagagacattggctcagatgaattatctcgtagaagagtggggtggcaaatatcagtcacaggatatctcggctaagaagggtctcggagttcctgaactgatggagaaagtacttcttgaagcagaaatgctcgacttaaaggcaaatccgaatcgtaatgctacgggttctatcatcgaatcaactttggataagggacgtggatatgttgcgactgtattggtctctaacggtacgctgaaggtgggggatattgtacttgccggaacaagctacggccgtgtaaaagccatgttcaatgaacgtaaccagcgtgtagcccaggcagggccatcggaaccggtattgattctgggtttgaatggtgctcctgctgcaggtgatactttccacgtgattgagactgatcaggaagcccgtgagattgccaataaacgtgaacagttacagcgtgaacaggggctgcgtactcagaaactgttaacactggatgaagtgggacgtcgtattgcgctgggtaacttccaggaactgaacgtaattgtgaaaggtgacgtggatggctctatcgaggccttgagtgattcgttaatcaagctgtctaccgaacagatccaggtaaatgtgatccataaggctgtaggtcagatttcggaatcggatgtgacattagcagctgcttcggatgccattattattggattccaggtacgtccatcggcttccgcacgtaagtttgccgaacaggaaggtgtggacatacgtttgtactctgttatctatgcagctatcgaagaggtgaaggctgctatggaaggtatgcttgctccggaagtgaaagaggtagtaactgctactatcgaagtgcgtgaggtattccacattactaaggtgggtacagtagccggtgctgttgtgaaagagggcaaggtgaaacgttcggataaggctcgcctgatccgtgatggtatagtaatcttctcaggttccatcaatgctttgaagcgctttaaagatgacgtgaaggaagtaggtacaaacttcgaatgtggtatcagtcttgttaactacaacgatttgaaggtaggtgatatgattgaaacttacgaagaagtagaagtgaagcaaactttataa

SEQ ID NO: 67 - DNA, 1251 bp, B.fragilis
gtgccagggatgttctatttgcaaataatcagtgataaaatgaatattcataagatacgtgaggactttcccatacttagccgtacggtatatggcaagcctttggtttatttagataatggtgcgactactcagaagcctcgcctggtgatcgattcgattgtagacgaatattattcggtcaatgcgaatgtacatcggggagttcatttcttgtctcagcaggcgacggagctgcatgaggcttcacgtgagactgtacgtcagttcattaatgcccgtagtactcgtgaggtcattttcactcgcgggacaacggagagcattaatttaattgtctccagttttggtgaagagtttatgcaagagggtgatgaggtgattgtttcagtgatggaacaccacagtaatatcgtaccttggcagttgttggcggcccgtaaagggattgcgattaaagtcattccgatgaatgataaaggtgagctgttacttgaagagtacgaaaatcttttttctgaacgtactaagattgtcagcgtcgcccaagtgtccaatgtactgggaacaatcaatccggtgaaagagatgattgccacggcacatgctcatggagtacctgttatgattgacggtgctcaatccattcctcacatgaaggtggatgtacaggatttggatgctgacttctttgttttctcaggtcataaaatatatgggcctaccggaataggcgtcttatatggaaaggaagattggctcgaacgtcttccgccttatcagggtggaggagaaatgattcagtctgtctcatttgaaaagactgtcttcggtgaattaccatttaaattcgaggctggaaccccagactatattgccactaccgggcttgccaaagcgctggactatgtcacaggtattggcttagacccaatagcattacatgaacatgagcttacagtctatgctatgcaacggctgaaagaaattccgaacatgcgtatttttggtgaggctgagcataaaagcagtgtaatttcattcttggtaggcgatatacaccatttggatctgggtaccttgcttgatcgattgggcattgctgtccgtacgggacaccattgtgcagaaccgttaatgcgtcgtttaggcattgaaggtacggttcgcgcctcatttgccgtgtataatacaaaagaggaagttgatgctcttgtagctggtatcgaacgggtcagtaagatgttctga

SEQ ID NO: 68 - DNA, 204 bp, B.fragilis
gcccgtttcgtgtgtacatttattcttcgctacctgaatccggggatgcttctcaagattcttgcgattgcgggtggtgcttttacgttaggtgtgatttttttgcaagacatatggggattgtattgtttagtagctgtttcggcttgtatgtcactaatgtttcccacgatttatggccattgctcttcgtggtttgggtga

SEQ ID NO: 69 - DNA, 2088 bp, B.fragilis
tatcaaaaatctaattgtatgaacgaaagaattaactatctaaaaacgtatattttagataaacgacaccattcacaaaggagaacaccgtcaagtatcgggctggacaaattgaacacaatttatgcccaacaaggtttatctcctgtagaacgtactacagcctgtttcgcagctttgatgaacgctgaactcccggttatacttccgggtgaaaagatcgtttttacccgtacccttacgcaagtaccggatatatacacccctgaagaatggaacgaaataaaaaacaaatattacatccacgaaaaaggtacggtatgtaatatctcccccaattacgcttataccattcaacacggactggaagcgagaaaacaggagatccgaaagcgtcaggaaaatccctccttaaatgaaagagagagagtattcctcaatagcatgtaccaatgcatcatatccctacagaaactaattgagaagtatgaacaatatgcactgctcaataacgagacagaaattgcgcacactttacataccataaagaccgaaggcgctcaaaacttcagacaagctctacagcttttgagaattctccatttctccatttgggaagcaggcaactatcacaataccctcggccgcttcgatcaatatatgtatcctttctatcagagggacctggaaaatggaacactcaccaaagaagaagcattcgatctgcttgaagaatttttccttgtatgcaataaggacagcgacctgtatccgggtatgcaacagggtgacaatgggcagagcctggttttgggaggacgggatccggagggcaaatacttattcaacgacctgtcccgcatgtgcctgcaggcaagttacgaattaaaactaattgatcctaaaatcaacattcgtgtagccccaaagacccctgacgaaatattcactttaggttcccgtctgaccaaaatagggctgggtttcccccaatacagcaatgatgatatcatcattccgggacttatacggaaaggctattccaaagaagacgcatacaattacgtagtggctgcctgctgggaatttatcatccctaaccgagccatggatatacctaacattgatgccgtttctttaatcggatgtgtagaccggtgccttgaaaaactaaatacctgttcgaactattcatccttttatacattggtggagcaggaaatacaaaaggaggtcaatgcgatctgcgagaaacaccgcaatctctacatcatcccttctccaatgatgtctttactgatggacggcaccatcgaaagagccaaagatatttcggaaggttcctactacaacaactacggaatccacggaacaggcattgcaaccgctaccgatacccttgctgccttgaaaaaatactatttcgaagagcaaagcctggattatacaaccctgcttactgccataagaagcaacttcaaaggctacgaagagttacaaaaaaaattaagagaagaagcgcccaaaatgggacaggataatgactatgccgacttgatagccaaagatcttctcgactcttttgatcggtcattggccgataaacgaaatgaacgcggaggggtttaccgggcaggtactggcaccgctatgtactacattttccattccaatcaattacgtgccacccccgacggacgtaatgatggcgagatgattcctgctaattactcccccagcctgtttttaaaacaaaaaggtcctatatccgtcataaaatcttttaccaaacaacatctggaccgtgttgtcaacggtggtcccctcaccctggagttcgatcaatccgtattcagcaatgacgaaaccattgaaaagctgggtatgctcgtgaaaacctacatcgttttaggcggccatcaactacaactaaacacagtcagccgggagacactgctacatgcccggaaacatcccgaacaacacaaaaatttgattgtcagagtatggggatggagcggatattttgtggaattagacgaatgttaccaaaatcacgttatcaatcggatcgaattcggtctataa

SEQ ID NO: 70 - DNA, 2085 bp, B.fragilis
aatcaatgtacaatgaaaaccacaaaacatttatctgtcgcagcagtactaaccgtactgatgcaaatggggtgtcagtctcacacagacaatacccggcaaacactccacttgcccgagctaaacgaagtccggatagaagatgctttctggagtccgaaactcgatatctggaggaaaataaccgctaatgatgtattaaacaaattcgaagggaaatacactccttttcccggatcgaccgacacgcgtaatgctttccggaatttcgatcgtgtagctgaagggcagagagatatcaaacagcacgatggtcccgaatggtatgacggactcgtttatgaaagtatccggggtatcgcctactttcttgcaagccaccccaataaagaactggaaaaacgaatcgacggatatgtagaccgcatctatgccgctcagcaaacagagccgaccggatacatcaacacccatacccaacttatggaaaacaaccatagatggggagacaatgggggactccttcgtggacaacacgatgtatacaatgccgggatgctgatcgaagccggagtacattattatcaggcaaccggcaaaacacgtttgcttgaaattgcaacccgctttgccaattacatggcagattatatgggtccggaaccacgcaagaatatcgttcccgcacattccggccccgaggaagccgtaatggcattatactggttgtataaaaacgaaccggaactgaaagataaactttccataccggtccgggaatcagattattataatctggccactttttggatagaaaacagagggcatcactgtggctttccattatggggaacgtggggataccggaaatcggaaaaatggattaaagacgcttgttatcaccaagctgaattcggcacacactctcgtcccagttggggagagtattcacaagattcgatccctgtactcgaacaaaaaacaattgaagggcatgctgtgcgagctaccttgatggcaaccggtctaaccgcggccgcacttgagaaccaatcaccccaatacatcgaaacagctaaacgtctttgggagaatatggcaggcaaacggatgttcatcacaggtggagtcggcgctattcacgaagacgaaaagtttggtccggactactttctgcccaccgatgcatatctggaaacctgcgcagctgtcggagccggttttttcagccaacgcatgaaccaattaacttgcaatgcccgctatatggacgaagtggaaagagtgctttacaacaatgtactgactggcgtttctttgtccggtgataaatacacctatcaaaatcccctgaatactgataagcccgacaggtgggaatggcatgtatgtccatgttgcccaccgatgttcctgaaaatcatggctgccatgcccggttatatctatgcctatcagggagataatgtctatgtcaatttattcataggaagtgaagtgcgaattccggtcggtgacaacagcgtccgattgaaacaattaacctcttatccctggcacggcgctgtttccattcaagtcaatcccgacaaggcaagcaccttctctatgaaagtccgtattcccggatgggcacaaggtacagaaaatccatacgacctttaccaatcgaatctaaaagcaccggtcaaattaaaagttaatcaagaggatgtacttttgaggatcgtagacggatatgcggaaatcaaccgggaatggaaaaaaggcgatcacattgagcttgaactacccatgcaacctcgcctgatcactgcaaataaagcagtcgaaaacttacggggacaagtcgcattggcgtcagggcctatcatttactgttttgaggatgccgataatccggaactgcagacattcaaacttcaggcacaaacacctttggaactctcccatgacagtaatctgctcaatggagtcaatatcatcaaatgtcagggtgatattccggcaaaagccatcccatattatgctgtggccaacagggaagagagccatagctataaagtatggattcctcagaaataa

SEQ ID NO: 71 - DNA, 783 bp, B.fragilis
aaaaacattgcagcattcggcatatctctgcgtctaaaagacataaaagacttaactatgcaaaaattcagattgacaatgctatttatcatttgcggcaacggatttgcttatgcgcaaacattcaacgaaacgcccatacctgcctttacactgcacaaagaaatgaaaacccctcaaatcttcaaactacccgaaataaagaatactttgtcagaaaccaaccctgctttcaataacagtatgccgttagtcaaacaatacgaactgagaaaaaaattctcctatctggatcccgtcttcaccggttattttaatcagcaacagtaccgattgttcaattcccgctatttcggatacgaattatacggttccagttattcactccggggagtaggtacacagaatatggcaggtggcagattggtatatcgtcttaacagacaactggctatccggataggtggcaatgcctatcaataccgctctaacggacggatgtttaatgattttacccttaacgcagaccttacctatcgtctgaataattggctgaccgcttatatttacggacaataccggctggactgtaatcccaactccggtgtacaaggtttcccgttatctccacaatcccattacggcgcttcattccggataaacctcctggaaaggaaagaatatggtctcgacctgaatctgggtaccgacagaagttacaatgctgctacccggcaatgggaaaatacttataagataggcccaaccatacgattaaaataa

SEQ ID NO: 72 - DNA, 792 bp, B.fragilis
aatattatgtatatatttgccattgttaatccaaacacaatgaaaacaggaacaatattcagtgtcgaggaatttgccatccatgacggaccgggaatccgaacaacgatatttctcaagggatgtcctctacgctgtgcatggtgccataatcccgaaggtatatcgccacagccgcaatacatgattaaaaaaggagttaaaagtatttgtggatatcagataactgtggaagaattggttaccatgatcgaaaagaaccggtccatttatacgctcaaccggggaggagttacactaaccggcggagaacccttatttcaaccggattttgttatcgaactgctccgacaacttccggacatacatacggctatcgaaacaagcggatacgcaaacactcacattttcaatgaggttacttctttagctgatcttattttattcgacatcaaacatacggacccggaaatgcaccggaaatatacaggagtggataatacgattatactggaaaatcttgctttactctgtaattccggacgagattttatcattcggatacctttaatcccgggtgttaatgatacccgggaaaacatgagtgccattcttgaaaaaatcaaagatgccaggaacctgatacgtgtcgaaatccttagatatcaccgtacagcaggtgccaaatacgcaatgatcggagaaacgtatcatcctccgttcgataccggaaaggcgccacaaatctataatgtatttgaagaaaataatatcaaaaatctaattgtatga

SEQ ID NO: 73 - DNA, 231 bp, B.fragilis
gcatatattcatataatattaagaatattaatagctcaaattacctttataggtaatgtttatgggagtaaagacgattattcgacatttacaaataatggatgtctcagatcactgttaaggcgtaatggaccgaataaaatggcaaaacggtctgtctattggcttttaccgtttttaaattcattaggtgtcactccacaaaaacgcttgaatgtcttactgaaatag

SEQ ID NO: 74 - DNA, 708 bp, B.fragilis
actgaaaaacatcatatgaatacttggttcgactctttttggtctcttttgttcccacgttgttgtgtggtttgtggagctccgctgtcgaaagaagaggagtgcttgtgtattcgttgtaatatgaacttaccccgtaccggatttcatctgcgaaaggataatccggttgagtgtcttttctggggacgtattccggttcttgaaagagcttcttcctttctcttttatcgtaaaggtagtgatttcagacgtatcttgcatctgctgaaatatagcggatataaagaactgggcgaagtgatgggacgctatatggcggcagaattaatttcttgtggtttctttgatcatgtggatgtgattgttcctgtacctttgcataagaaaaaacagaagctgagaggatacaatcagagtgaatggattgcccgtggtatatcttctgtgacggggattccgctgaatgcgaagagcgtgatacgggaaaagaatacagagactcaaacccgtaaatcgacttttgaacgctcggaaaatgtggacggtattttcaaattgtgtgatgtagcctgtttccaagggaaacatgtactgattattgatgatgtgctgactaccggatctacaactgtggcctgtgcatctacgctttttgaagttgaaggagtacggatcagtgtgttgacattggccgtggccgaataa

SEQ ID NO: 75 - DNA, 267 bp, B.fragilis
attctttttaaacgtatgaaaattacaagttatgtttcttttttatattgcttatgtctgatgctggcgagtccgacagtacaggcgagcgaagtgcgaaccgctatttttgaggggaaaccgtgtattaatccccctcatgtggtgggaaactatcctgctaccccttttttgttttatattcccacctccggagaacgaccgataaagtggcatgctgaaaatcttcccaagggattgaagctggataaaagaaacgggggataa

SEQ ID NO: 76 - DNA, 4107 bp, B.fragilis
atatcagtttgtgaccataagtatctttttgattcgtttttatttcagacttttgtgttgtacgtaattaagagacgaatgaagaagagcacttttaccctgattttatttttttcttctgttatcctatatgcacaacagaacgaacttatgttccactccctgggtagtcaacacggacttacctatagtgccgtacgggatattctgcaggattcaaaaggatatatttggattgcaaccctcaaaggactgaacaggtatgatggatacaacatcaaacaatattataagtcagatgacggactctcttcaaactgcatcgagaaactcctactcctcggtcaggatactctattgatgggtaccaatgaaggactgtgcttgtatgatatgatgagagagaagttcaccactattgttccacaaaccaaggccccactatatgtattggacatggcctacgacggacgttcagttttcattgcgtccgattccgggctatacgtatataacaagacggagcaaagtatgccactactccataaaggattgattgtaaaagtaacgctggatataaatggaaatgtatgggcagtgagtccaaatacaatttattgtttccgtccaaacggacaaatgaccagaaaaatcacagccactgaagtttctcctgattatcctgtcgagtttacttctatttataaagattctcaggggactctatggctgggaacgaccgaaaacggactgtaccgatacaacaaaaactataatcaattcgtatccgtggagttcgcttcacaagacagaaaggatatgcgttatattcgctgcatccaagaagatatgcgtggaaatttatggatcggaaccgaaaacggacttttcatctatgactatacagataacagctacatacaatatcggcagcatgcaaaagatgtccaatccggactgaccgataatgcgatctatactatttataaaagccggggtgacattatgtggatcggcactttcttcggaggggtcagttacaccagcctgaccgaaaataatttccactacctgatagcagataatgggaaacaatacctgaaaggaaaagcaatcagcaacatcattaaagataaaaacggagctttgtggtttgcatccgaagatcatggaatttctattctttacccggatggtcacatcaggtatttaaacaaatcgacacacccgtcattaaacggagataatgtccatgcattagccgaagatcactccggtaatatctggattggcaactttatcgatgggttgcaaaaagtcgatttagcaaaaggctatattcgttcatataaaaacatagcagggggacacgcgggactatccaataattcaatctataaactttatgttcataatcctgatactatgtttataggaaccagccaaggtgtcaatatctatcatttccggaccgattcattcactcccttccttccggatgtattccggcttatacgtattgacgacatcacacgtgatctcaaaggaaatatctggttttccacacatttcaacggtatttttcggtatcatattccgacccatagtatccatcgatatcaaaaaggagtgacaggctgtaaaacaatgaccagcgataatatttattgtagttttgttgactccaaaggagaggtctggttcggtaccagcaacggaggattgatgaaatacaatgcacgtgcagacagtatacaggcattcggaaaggagaatgaactccggcaaagagatatttattccatacaggaagatagctttggctatttatggatgagtacggataacggtatcttctctttcaatccggaaagtcgtagttttgcccattataaagtatccgataatctggtttccaaccagttcaatgcctgtccgggctataaagatcctgacggtacccttttctttggcagtatcaatggggtatgcttcttccgaccggaaggactgaaccataacagtcctacaaacgatattcatctgactttctcggatttcaggattttcaataaacacgtacaaccatcaccggacggcattctacagaataatatcgacagcacatctgccattcgcttacctcacggcatgaataccctgacttttgattttctggtgatcaactataatgaaaattgccaatcacaactttcctgtgaatactatctggaaggtatggagaccgaatggaatgcaacacaacaaatcccacaatcagtcacatataccaaccttgatccgggcacctaccaatttcacgtacgggtcataggaaaaaacggagttgtattcgaccgtcggaaaataaccattaacattcgtcctcactttttgctgagtggtttcatgatcactatttattctcttatcggacttcttatcagttttataattgtccgcttctaccaagtgcgtatgcgagacaaaatggatatccgcatcgaaagaatggaaaaaaacaacctgcgcgaactgaataaacacaagctgaattttttcacttatatcacccatgagtttaagactcctttatctatccttatggctgtattcgaagatatatcaatcggacgaaacaatacaattaccggtgaagaaatgaaaatcatcaatcggaatatccaacggcttcaattcctgatcaatcaacttttggaatttcgttctgtagaaaccgaccatgcacgcatcgaatatgtcaaaggagatattatgacttatggacgcagcatcttcgaactgtttattcccgtcttcagacaaaagcagattgtttttcaatatgcaacttcagccgactcttattatacggtattcgatagagacaagatagagaaaatcatcagtaatctgctcagcaatgctttcaaacattctgatcctcaaagtgaaataaacttcaggattgatgtagacaaagcttccggacaattgattctctcctgtcataacagcagttcatatattcatccggaacagcgggaagctgtcatgcagccttttcacaaaaccgattcatccgatcaaaagtattccaatacgggtattggactggctttggtgaatggtctagttcagctgctttcaggaacagttgagatagaaagtcatcaaaacagcggtacgacctttaaagtaaaattacctttggtcgaagactctaaggatatgattgcaccggacgaaactttggatatcgttaactcacccgacgtagtggcagatactgtatacctgctcaataactccggactaaaagaggatatgaatgctgcaaatgccgagaaaaagatgactgtacttttggtggaagataatccggatatcaataacattttaaaaagtaagctactccgtttatataaggtgaaaacggcttataacggacaggaagctgtagagttgctaaaaacacatatcatcgacattatcatcagtgacattatgatgccttatatggacggatatgaattgagtaaatatattaaaacttctcgtgaatactcccatatcccggtcattctcatcacttcacagccttcgaaagaaaacgaattgcaaggtttatctgcaggagccgacgcctatatcgaaaaaccattcactttcgatgaattgaatcttagaattaccaacttgcttaaagccaaaaataatatccgcgaacattatcacgacatgaaaatattccaactcaatgaagaactcaacaacaaagacgaggaatttatcaaatcattgacacaattcgtcatcgaacacattgaggacccggaattgagtgtcgaccaactgaccactcacatgaatatcagtcgaactcaactatacaataaactgaaaaaactattaaacctgagtgcaaccgagtttatcaataaaatcaagatcgatgttgctaaagtaaagattataaagactaatctgactattgctgaaatctcatggcaactcggattcaataatcccagctatttcagtaagacattcaagcgtttttgtggagtgacacctaatgaatttaaaaacggtaaaagccaatag

SEQ ID NO: 77 - DNA, 210 bp, B.fragilis
cattggccgtggccgaataaatgcagtgataaatatgagggtgcattgaagcaccctcgtatctatttaaaaagtttcaattatcaaatcggatgccagcatttccttgattgcctttccaaaagcctggaaatggggggatgccgcatgtatatccatggcacgctggtctttgtactcttcgtagaaaatgaaagctacgggttgtga

SEQ ID NO: 78 - DNA, 1149 bp, B.fragilis
aagataggaggtattatgaaatcatttacattttgcattttattagcccatgtgttggcttttccactatttgctcagaagaatgcagctgccgtcacgctgaatttggcaaaggctgttacacaaagtcctaagacggtattaatgagtgaactggcatctgatgtacgttatttccctttagaaactactgataattgtctgctggggaatgaatgtagtattatttatgccggaaactcgattattgcgggtgacgcacagaccagaagtttttatcggttcgataaaaatggtaagtttatgaataagataggccggcaaggacaggggcctgaagaatatgcggtaggattattgttttttactgaccctgataaccaaaaactgtatgttcaggatttccaggatataatctgttatggcttcaatggtaaatttctccgtcgtataccggctcctcacctgaatatgggtaccggagctgtagacggtcagggatctattctctattgtgataataattattttatgagaaaggataatccccaacaattgttccttatcgatgaaaatgggaagaaactaaagatctggaaaggatatatggaacctggaaagaaatatggtgttaacctatctacccgcgatgtaatgtatcgttatgggggcgatatttactttaaacctgcgttggagaatctgatttataaaattgatgctaacagaaaaaagacattggcatggaaatttgattgttcggggaaggatgtggatgtatctgccaatgaaatagatcccggcaaacgttttcaatcaattgcagtacaacaggtttttgagtcagaccgttatttctttgtgctttatgtcctgaagaatgaaagctttgtgggattgtatgataaacagaagaagagtttttcaaatgtgattataaaagatgatttggcggcaggatttgattttactcctcccggaacagggttgggaagtcagttggcaaatgcccggatggtaggttatctgagtaaaggtaaacgctattcgaaagctttactgccggaaagaaaaaaagaactggatgaattgataaaccgattggatgaagaggataatccggtaatggttgttgtaacattaaaataa

SEQ ID NO: 79 - DNA, 1257 bp, B.fragilis
aagaaacgggggataatcaagggaaaagtagtagaaaagggaacgtacaaagtaatgctgaaagctgagaatgcccttggaaccgatacacaggaactactgattaatataggagatgagttgttgctgactcctccgatggggtggaacagttggaatacattcggacgtcacctgacagaggagctactgttgcaaactgcagatgcaatggtagaaaacggaatgcgtgatttggggtatgcttatattaatatcgatgacttttggcagttgcctgaaaggggagccgacggtcatatccaaattgataaaacaaagttcccgagaggcatcaaatatgtggccgattacttgcatgagcgaggattcaaacttggaatttattcggatgccgctgataaaacttgtggtggggtttgtggcagttatggatatgaagaaattgatgcacgggatttcgcatcctggggtgttgatcttttgaagtatgactattgcaatgcacctgccggaagagtagaagcgatggaaagatatgagaagatggggagggcattgagagcgaccgaccgttctatcgtcttttcaatttgtgagtggggacagcgtgaaccttggaaatgggcgaagaaagtcggcggacatttatggcgagtatccggtgatattggcgacttgtggaatcgttcgacagacgaaaagggaggtttacgtggcattttgaacattcttgaaataaatgcaccgcttagtgaatatgcaagacccggcggatggaatgatccggatatgcttgttgtggggattggcggaaaaagtaagagtatcggttatgaatcggaaggttgtacgaatgaacagtatcagtcccactttgctctctggtgcatgatggcttctccattactctgtggcaatgatgtacggcagatgaatgatagtacgttacaaatacttttgaataaggatctgattgctatcgatcaggatccgctgggcattcaggcagagcgtgccattcgtgccgatcattatgatgtctgggtgaagccgttgagtgacggaagcaaagcaatagcttgtctgaaccggatatccggacccgtagacgtggagttgaatgtaaagacggtagaaggattgtcattggatcgggtatatgatgttatagaaggcagccttgtggctgaggcttctaccggatgggtcgtaaagcttgctcccggtgagtgtaaagtgtttatatgtaaataa

SEQ ID NO: 80 - DNA, 291 bp, B.fragilis
attatcattatggaaaagaaaacaatcgtagcacgtgtagaagtactacccggcaaagaacaagcatttctacaggcggctgatgctctaatcaaaggtacaagggcagaagaggggaatattagttataatttatatcaaaacccgtcacaacccgtagctttcattttctacgaagagtacaaagaccagcgtgccatggatatacatgcggcatccccccatttccaggcttttggaaaggcaatcaaggaaatgctggcatccgatttgataattgaaactttttaa

SEQ ID NO: 81 - DNA, 3183 bp, B.fragilis
  unsure (2747): Identity of nucleotide sequences at the above locations are unknown.
attactaatattatgaatctaaaagatctgaacaaccttagagcagatacggaaggcaggataaaagccgtcttcttaatatgcatgtttgtgctggtgtctgcaggtggatttgctcaaaacacaaagagcatttcgggtacggtgagagagaaaggcagtaatgaaactgttattggtgccactgtacaagtgaaaggaacacacaatggggtgattactaatgagaatggggagtatacaattaaaaatgtatctccgggacaagtacttgttttctcaatgattggtatgaatacggttgaaaaaactgtaggtagccaaaatcggatagatgtactgatggatgcgggagtattgattgacgaggtggtagtgaccggttatcagactcagcgtaaagtggacttgactggatctgtatccagtttgagttccgatcagttcatgcaaaccaacccgttaagtctggagcaggctttgaaaggaaaaatatccggtgtgcaggtaatgaataatgatggtgcgccgggtggtggaattacgattaagattcgtggagccagttctattacggcaggtagttcacctctgtatgtcatcgatggttttcctctccctatttcggacgatcctctggaaagtcctttggctactatctctcctgatgcaatcgagagtatctctatcctgaaagacgtatcatcaactgccatttatggggcacagggggctaatggcgttgtgttgattactacgaagaaaggatcggccggtatgagtgaaatctctgtgaaggctacttacggtatcagtaaactggcaaattctattccaatgctgggtgcggaagactatatgcgtgcgtatatgcgtgatatgattatgagcggacgctggcaaaatgctgatttctatcaggaatataaagatcagatatggaataccaatccttcccgtttccaattctatcccgatctttgtttgcagaatggtactaaacagaattatgaagtttcttacagagggggaacagaccgcatacagaactctacaatcttttcgttgatgaatgaagacggtattgccatcaataccggatttaaacgattctatttccaaacgaataatagcattaaattgcttccgcaattgactttgaacacaaatctttcatatgaacacaatattcgtagcggtgctttctggacagaagggaatatttttaacgaaatacagactttctctccgcttgttcctaaagaatggacttttcaggagatagatgataacctttactatacaggtaagatggataatccttatagaaaattaaaagatattgattactctaacaagaataatactttcttcggtcaggcagagttggtttacaatatcaatgataactggtttgtaaaaggaggtattggtgtgcgtatacccaaaggtgaagtgaaagaatttatcccgaaaaccattcagagaggctacgataataacggattggccacatacgctacgcaaagtggattaaatatgcgtggagtagtccaggccggatttaataaagtgttcaacaaagtacatagtctctcggtaaatgccgtatacgaggctaataccaacaagtatgaaacctttaatcaggaatattctcagtttaataccgatttgggatgggaaggtatttatgatgcaaaaagtggtaatcatgtgaaatctcccggtgtatcttacgagaagatagcaatgctttcgggggtattgatggctaactactcttataaagggcgttatttattgaaagcatctatgcgtgctgacggttcttctaaattcagccctgataatcgttggggatttttcccgtccggagcattgggttggagagtttcagaagaagaattctttaagaatgtatcttggttggagaagaacgttaataacttgaaactacgttttagctatggtcaggtaggtaacgatcagattgctccgtatgcttatgcacagaccttatcttccagccagagacaagccatttttggtgacggagctattccggccttgttcaccagccgtatggcaaaccccgaaatcagttgggaagtaacggaagagtttaacggcggtctcgatttagatatgtttaataaccggctgaatatttcattggatctctataccaagacaactcgtgatatgctgcttgaacagaatctgccacgtacttccggttttggaaaagtaaccaggaatatcggttcggtacgtaaccgtggatttgaaatcagtgtaggcggtgtgctgattgataagaaagactttacgtggaatgcaacagtgaactttagttccaatcagtccaaagtactgagtctaggtgctgagacacagatgttggaagggcgtccggtgggttctgcttcgggttcggaaaatgtcctgataaaaaagggatatcctctcggactgttctatggtctgcaaatggaaggcattcgcagtaattggcattctgactataatggtataggcagtgctgattctccttggtggtatgccactgaaagagagatgccatacggattcccatcttttgcagataccaatggagacgggaaagtggatatgagtgaccgtgtcgtgataggagatgtgaatccggtatttatcggtggcttgaacacccgtttgcgctggaaattcattgaactggctatggagttcagctggtcatacgnaaatgatatatccaatggtaatgtataccatctgatgaccaatggcgatattcgtaataagtcggccgtatactataaagatgcttggtttgctaataatcctaccggtactttacaaggtcctggtgcaattgattggtccgggtatatgtgggctgcttccaactctgaaatggtggaagatggttcgttcctgaagatgaataacttggctgtaactttccgtatgccgaaaaatatattaaaggcttggaaaattaaggacctggctctgacatatacgattaacaatgttttctgtttaacgaactattcgggatatgatcctgaggtacgtagtggcagctctgtaaataatcgtattcttccgggagtcgatatctcggcttatccatatgcccggtctcatatattctcacttaattttaaatactaa

SEQ ID NO: 82 - DNA, 1149 bp, B.fragilis
actaaaaatatgaatcgtatgaaaacaaaactgatcattttattaatactcacaaccatgatacacacaaacaccgtaaatgcccaacattcacaattgaaaagagccgattttcaacaaacaattgacggaaagcaaaccgatctctactttctgagaaacaaaaacggcattgaaattgccatcaccaatttcggaggacgagtcgttgaattctggactccggataaaaaagggcattttgaagacatcgtcctcggacacgatcatgtggacaaatatctccattataaaggtgaaagatttttgggagccactatcggacggtatggcaaccggatcaacaaaggaaagtttaccctgaacggacaaacttaccagttacccatcaatgatacacccaacagtctacatggtggctttaaaggatttgatatggtagtatgggatgttgaacagccggacagccagactttacaactcacgtatttatccaaagatggtgaagaggggtatccgggaaatctccaagtatccatgagttacaagcttacggataaaaacgaatttattatcactcaccaggctcaaacagacaaagagacggtcatcaacctcacccatcattccttcttcaacctgcacggtgcaggcaataaggatatcaatgaccatatactcatgatcaatgcggataagtttactcctgtcgatcagatcctaatccccaccggtattctccaggatgtagaagggaccccgatggattttcgtcgccctacacctatcggaaagcgagtaaatgattcgttcgagcaactggagttcggtcacggctacgaccataattgggtattgaatcgcaaaacctccaacacccccgaactggcagcaaccgtttatgaacccgcctcaggaagatatcttgaagtatggaccaccgaacccggactacaattctatggcggtaacttctttgatggtacaatgaccggaaagcacgaaaagaaatacaactaccgagcttccctcgcattggaaacccagcactatccagatagtcctaaccaaccggcattcccgtcaacaaccctcttacccggagatacttacaaacatatatgcatctataaaatcaatgtacaatga

SEQ ID NO: 83 - DNA, 816 bp, B.fragilis
aaatcgaatatggaactggatcttcaacaacttactactgaggtatgccggatagcaactgaagccgggaattttttgagaaaagaacggaggagctttagtcgggagcgtgtggtggaaaagcatgcgcatgactatgtgtcgtatgttgataaagaatctgaacgcttgttagtggcacaactgtctgcgttgctccccgaagccgggtttattgcggaagaaggttctgccgtttataagaatgagccttattgctgggttattgatccgttggacgggacgactaactacattcatgacaatgctccttattgtgtcagtatcgcattgaggagctgtacagaattacttttaggagtggtgtatgaagtttgcagggatgaatgtttttacgcctggaaaggtgggaaggcttggatgaacggagatgaactgcatgtctcgaaaatagaaaacatagaagaggcgtttgtaatcactgaacttccttataaccatcggcaatacaaacggactgcggaatatttactgaaacaattgtatggagtggtaggaggaattcgtatgaatggctcggctgcatcggctctttgttatgtggcggccggacgttttgatgcctgggcggaagcttttatcgggaaatgggattactcggctgcggcactgattgtgttggaagccggcggaaaagtaactgatttctttggaagtgagtattttattgaaggacatcatatcattgcgacgaatggccctttacatcctgtctttcaacggctgctgaaagagatgcctccactggaaatgtaa

SEQ ID NO: 84 - DNA, 288 bp, B.fragilis
ggtactgccatgaaaaaaatattattagcccttttaacctcttgcgccttagtgtcgtgtgaggggtatttcgaccagttaccgaaaacagaacttccgtctgaaactttctatacttcctatgatgctgctttacgtaatgtagctatattgtatgctaatgcagggcatgtcaatgatggaattatgaccactgaccggtttatgatgccttcattgatgaatgaaggtccgttcgacctgacttcgacatcggtcttcaccacggggctgcaaggttgcacatag

SEQ ID NO: 85 - DNA, 1332 bp, B.fragilis
tacatctgcattatgaaaaatacagcaaagaatttcatgttttacgttgccttcgtggcatcattgggaggattactttttggattcgataccgcagtgatatccggagccgagaaatccatccaggtggtatatgatctatccgacttcagccatggcttcaccattgctatcgctttgatcggtacaatcatcggagctttcgtctgtagtaaaccggtagaaaaacacggacgtctgaaagcactgaaaattattgcttttctctactttgtttctgcagtgggcagtgctgccatcatcgattggtattcctttttattcttccgttttgccggaggtttagctgtcggagcctcatccgtagtcggtcccatgtacattgccgaaatatccccctcgcgttggcgcggccgttttgtcgcattcttccagtttaatattgtactgggtattgtactggcttacttttccaactattggattcacggcattgcgcatgattggcaatggatgttaggagttgaagccattcctgccatcgcattcgctcttctattatacaccgtacctgaaagccctcgttggctggtaaagcaagatcgggaagccgaagcccgacacgtcataaagaaggtcagcaatgcaaatattgaacaggaaattcatgaaatcaaagaatccctggtaacaataggagccagtggcgaaaaactgtttcagcataaataccggaaaccgatcctctatgctttccttatagctactttcaaccagttatcaggtatcaatgccattctctattatgctccgaggatttttgagatgtcaggtgtatttaccgactcagccatgatgcagtctattgttatcggactgaccaaccttactttcactatgatcggaatgatcctgatagatcaggtaggacgaaaaaaactcctctatatcggttccatcggtatgaccttctctttggccttagtagccaaaggtttctaccaaggcgcattttcaggttactatatgcttatctgcctgatggggtttatcgctttctttgccatttcactgggtgccgtcatttgggtattaatctccgaagtcttcccaaacaatgtgcgctccaaagggcaagtattaggcagcatgacacattgggtgtggtccgccctcctttcatggatgtttcccgttttcatccgtacaggaggtaccttcattttcagtttctttgccattatgatgttcctaagcttcttctttgctctcaggctacccgaaacaaagaacaagtctctggagcagatacaaaaggaattgaccaattaa

SEQ ID NO: 86 - DNA, 198 bp, B.fragilis
gccagtacaatacccagtacaatattaaactggaagaatgcgacaaaacggccgcgccaacgcgagggggatatttcggcaatgtacatgggaccgactacggatgaggctccgacagctaaacctccggcaaaacggaagaataaaaaggaataccaatcgatgatggcagcactgcccactgcagaaacaaagtag

SEQ ID NO: 87 - DNA, 207 bp, B.fragilis
tctcaaagatctctatcacaaagatactgcatattttcgaatgcaacaaatcaatcgattttttttattgaggactggcattatttgctggttcttttttattggaaatctgaaggtatatcgatacctttttttaatccgatagcaatacccaatcctgccacaccctattcggacaaacaaagaatgaaagataatagatcttga

SEQ ID NO: 88 - DNA, 240 bp, B.fragilis
aaaaactttccatactatgggtgggatgctttcgctaatgacaaatcaaaacaagatgctattgttcctctacctatgatattacccgattttgactcgcaggaaagatgctattattattctgcacaaccggttatatcagatgtttgtgaaatcagtagagattatttcaataaagacttttctaaaaattataaacttgaatttaaattgaagatagtaaattatttttttaattaa

SEQ ID NO: 89 - DNA, 489 bp, B.fragilis
atcaccatgttgtctttgcaatcagaaatcgattctttgtgcgccgtttcgcacgaacttctccatttaggtctggatggcgaacccatctattccgaccgtttccgtcagttgaatacggatgtgtatcatcgttgtgagcatcttttcggttcacatggacgtaccctcgaagaggaagcttctctttgtatcgctttgttgaccggctataatgctaccatttataatcacggtgataaggaagataaaatccagtcggtcctcaatcgtagttgggatctcttggatacacttcccgtctctctgctgaaatgtcgtttgttggtagcttgttacgccgaggtctttgacgaagagctggcggcggaggcacatgcaataatagacggttggaaggatcgggaattgacgagggaagagtttgagattgtggagcatttaaagagtttggaggaaaatccgtatccgaatacggatatagaataa

SEQ ID NO: 90 - DNA, 630 bp, B.fragilis
cgagaccgacctttcaacaatacgaaccatcataactccaataaaataatggcagcaacaaagatattcaacctttgggcgaagcgcagccctgagtgggaaacgaaatacgaagacaccttgctgaaggcgttctgcgactacggtaagggttcgacaagctatcaagaaacccgtgcaaaactgttcggcgcaggatatgaattgtatattctggcgttcttcattggtctgtatcatggtcagactaaagaccttgtggcagataaagccaagcggaaagactttggctgggcgattgagaattggggaacggcagaggctcgtggcggtcgcaagcagtatggtcagattcgcgaatacatgttcatggctcttgtggctcgtactggaatagactggattgcccttgacaaaggcgatattacgccccgcaaagtggttgacttgctcattgacaaaatggagaagtacgcaaacttcggcttcgatttcatgcaggacaagcttgaagacaatcccgattacttctacaaagaaacagcattcctacaagttttcctcaactttatgcaaccatcaacctctgaaaatgcagaagaagaagaggaagcagaatctttggattaa

SEQ ID NO: 91 - DNA, 603 bp, B.fragilis
tatttttgcacgttattctcacaagaaatagatcaagaaatgatagaagacattaaaaaagcttgtcaagtgatgagcgaaggcggggtgattctctatcccaccgatacggtttggggaattggctgtgatgctaccaatgaagacgctgtgcgccgggtgtatgagataaaacgacgtgctgacagtaaggcgatgctggtattggtagactcgccggtgaaagtggaattctatgtgcaggatgttccttcggtagcttgggatttgattgaggttgccgataagccattaactatcatttattccggtgcccgcaacctggcttcaaatctgcttgcagaggatggaagcgtaggcatccgggtgacaaacgaggcgttttcccgtcgtttgtgccagcagtttcgcaaagcgattgtctcgacatctgccaatgtcagcggacaaccgggagcagccaattttaatgaaatcagcgaagaaataaaatcgtcggtggattacattgtcaattttcgacaagatgatatgagtcgtcctaaaccatcgagtatcattaaactggataaaggtggagtgatcaagattattcgcgaatga

SEQ ID NO: 92 - DNA, 1923 bp, B.fragilis
agatatcaaaccgatagagtgacttaccaagagattttaaagcaatactggggttatgattccttccgcgacctgcaggaggacatcataaccagcattggcaatggaaaagacacactgggactgatgcccaccggaggcggaaagtcaattacgtttcaggttccggcccttgccaaagagggattgtgcattgtcatcaccccactgattgctctaatgaaggatcaggtgcagaacctgaaaaagcgcggaatcaaagcgatagccatctattcaggaatgacacggcaagagattgtggtggcattggagaactgcatcttcggcgactataagtttctatacatctctcccgaacggttggataccgaaatcttccgggccaaactccggtccatgaaaatcagtatgattacggtagacgaaagccattgcatctcacaatggggatatgactttcgtccggcttatctgaaaatagcggatatcagggatctcgtaccggatgctccagtcttggcactgaccgccacggccactcccgaagtagtgaaggacatacaggagcgcctccgcttccgggaagaaaacgtgttccgtatgagcttcgaacgaaagaatctggcatacatcgttcgccccactgataataaaaacggggagttgctgcacatactgaaccggatacaaggcagcgcgattgtatatgtacgaagccggcgaaaaaccaaagaaacaaccgagctgctggtaaacgaaggaatcacggccgacttttatcatgcgggactggataacgcaaccaaagatcttcgccaaaaacgatggcaaaacggagaaagccgggtgatggtagctaccaacgcattcggtatgggcattgacaaaccggacgtacgtatcgtcatccacctggacctgcccgactcaccggaagcctactttcaggaagcgggacgggcgggacgagacggacaaaaggcatacgcggtgatactctatgccaagtcggataaaacaacgctcagcaaacgtattacagatactttcccggataaagactatataaaagatgtgtacgagcatctgcaatatcattatcagatggcgatgggcgacgggctgggatgcatgtatgacttcagcctggaagaattctgccgcaagttcaaatattttcccgtacctgcagacagcgcactgaagatattgacacaggcaggatacctggaatataccgatgagcaagacaatgcctcacggattatcttcacgatccgccgggatgagttatataaactccgtgagatgggagaagccgcagagaaactgatacaaatgattctgcgatcttacacgggtgtctttacagactatgcctacatcagcgagcagactctggcggtacgtacgggactgacccggcaacagatttacgacttgctggtgatgctgagcaagcgccgtatcgtcgactacatcccgcacaaaaaaacaccttacattatatatacacgtgagcggatagacctccattatctgcaaataccccgagcagtatatgaagaacggaaagaacgctatgaaacccgtatccatgccatggtggaatacgtcacttcggagaatgtctgccgtagccggatgctgctccgctacttcggagagaagaacgaacataactgcgggcaatgtgacgtctgcctcagccaccgcgccgaaccggatatatcacaaagcaccttcgacggactgagagagcaaatatgtgctctgctgaaagagcatccgatgactccggcggagatagcttcacacataaatacagataaagagcagttgagcgaagtgatacggtttatgctggacgagggcttactgagctctgagaacggactgcttactgaaaaaacttcctga

SEQ ID NO: 93 - DNA, 1740 bp, B.fragilis
aaagaaaaaacaatatataaaatgaatcacaaatggaattatcgacccatcacacaagaacaggcagagataagccgggcattggctcaggaactaggcattagccccgtcctgggacgacttttggtacaaaggggaattacgaaggcacaggatgccaagaaattcttccgtccgcaattgcccgatttgcatgatccattcctaatgaaggatatggacatcgcagtggaacgcctgaacatggcgatgggaaagaaagaacgcattctgatttatggagattacgatgtggacggtaccacggctgtggcactggtctacaagttcattcaacagttctattcgaaccttgactattacatccctgaccgttataacgaaggatacggaatttccaaaaaaggagttgactacgccgctgaaaccggagtagggcttatcatcgtactggactgcggcattaaagccgtagaagagattgcgtatgccaaagagaagggaattgactttatcatctgcgaccatcatgtaccggacgacgtattgccccctgccgttgccatcctgaatgccaaaagactggataatacatacccatacactcatctttcaggatgtggcgtaggcttcaaattcatgcaggcttttgccatcagtaacggcattgagtttcatcacctgattccgttgctcgacctgaccgccgtaagcattgcatcggatattgtaccgatcatgggcgaaaaccgtatcctggcctatcatgggttgaaacagctgaacggcaatccgagcgtaggactgaaagcgattatcgatgtatgcggattatcggaaaaagaaattacggtgagcgacattgtattcaaaataggtccccgcatcaatgcttccggacgtatacagaacggaaaagaagcggtagacctgttgattgagaaagatttctcggcagcactcgagaaagccggacaaatcaaccaatacaacgaaacccggaaggatctggataagagcatgacggaagaagccaataaaatcgtagccgaactggaaggcttggcagaccgtcgttcgatagtgctttacaatgaagactggcacaaaggagtgatcggaatcgttgcctcacgattaacggagatttactatcgtccggcagtcgtactgacccggacggatgatatggcaaccggttcggcacgttccgtatccggtttcgatgtttacaaagctatcgaacattgccgtgacttgctcgaaaacttcggagggcatacctatgctgccgggctatcgatgaaagtggaaaacgtacaggcattcaccgagagattcgaaagtttcgtgtcggaacatatactgccggaacagaccagcgcagtgatcgatatcgatgccgaaatagattttaaagatatcacgccgaagttcttcaatgaattgaaacgattcaacccgttcggtcccgacaaccagaaaccggtgttctgcacacatcacgtgtacgattatggaacaagcaaggtagtcggtcgcgatcaggaacacatcaaactggaactggtagacaacaaatcgaacaatgtgatgaacggcatcgccttcggacaaagttcacacgtgagatatatcaaaaccaagcgatcatttgacatctgctataccattgaagagaacacccacaaacggggggaagtgcagttgcagattgaagatatcaaaccgatagagtga

SEQ ID NO: 94 - DNA, 1203 bp, B.fragilis
actaatactgcgattgttatgaatactacagaatatttacagacttggtctgactcttataaaaatgacatgataagcaatatcatgcccttttggatgaaatatggttgggatcgcaagaacggaggtgtttatacctgcgtcgaccgtgatggtcagttgatggataccaccaaatctgtttggttccaagggagatttgcttttacatgttcatatgcatataatcacattgagcgtaatactgaatggttggcagctgcgaaaagcactctcgatttcatagaagcacattgttttgatacggatggacgtatgttttttgaagtaaccgagaccggattacctattcgtaaacgtcgttatgtcttttctgaaacatttgctgctattgcaatgtccgaatatgccattgcatcaggagatcatagttatgctgtaaaagctttgaaattgttcaatgatatccgtcacttcctttcgactccgggaatcctggagcccaaatattgtgaacgtgtacagatgaagggacattctattattatgattcttatcaatgtagcttcccgcattcgcgccgctattaacgatccggttttggatcggcaaatagaggagtctatagcgattctgcgcaaagactttatgcatccggagtttaaagctctgcttgagactgtaggtcccaatggagagtttatagatacgaatgccactcgtaccattaatcccggccattgtatcgagacctcatggtttattctggaagaagccaagaaccgcaattgggataaggaaatggttgatacagcacttacgattctggattggtcgtgggagtggggctgggacaaagaatacgggggtattataaatttccgtgattgtcgaaacctgccttcacaggattatgcccatgacatgaagttctggtggccacagaccgaagcgattatcgcaactctatatgcgtatcaagctactaaaaatgaaaaatatctggctatgcataaacagatcagtgactggacttatgcccattttcctgacgcagagtttggtgaatggtatgggtatctccatcgtgacggaacgatttctcagcctgcgaaaggaaatctgtttaagggaccattccacattcctagaatgatgacgaaaggctacgcactttgtcaggaattactgtcagaaaaataa

SEQ ID NO: 95 - DNA, 258 bp, B.fragilis
ttggttttcgctacctttgcaaactgtgaaaaaacacttagttttaaaggttggaactgccagtttatgatacaattctataatgaatataaccagcaatttacaaatacgaaacagcctgtttcgtatttggatgatgtttctttataccttcctgtcatgcatttgagttggtcgcacaacatcgtattgatgcaaaaagtaaaagacctcaaagcacgtaactggtatatgattcaaagtctgaaaaatggttag

SEQ ID NO: 96 - DNA, 1320 bp, B.fragilis
atatcagaagccatgaatacaaaatattgggaagaagagatagagaccatgagtcgcaagaagctacaggaattacaactccaacggcttaaaaaaacaataaatatagcagccaatgccccttattataagaaagtatttcaagagcatggcattactccggagagtatccagtctctagacgacatccgtaaattgccttttaccacaaaggcggatatgcgggcaaattatcctttcggacttgttgcaggaaatatgaaagaagacggagtacgcatccactcttcaagcggcacaacgggaacaccgacagtcattgtccattcacagcatgacttagattcatgggccaatctggttgcgcgatgcttatattgtgtaggtatacgtaatacggatgtttttcaaaacagttcaggttatggtatgtttaccggcggactgggattccaatacggagccgaacgactgggagcattgaccgtacccgctgctgccggcaacagtaagcgtcagatcaagtttatcaccgactttaagacaacagctttgcatgcgatccccagctacgccatccgcctggccgaagtttttcaggaggaaggtatcgatccgcgcagtaccacccttaaaacgctcgtaatcggtgctgaaccgcatacagacgaacagcggaaaaagatcgaacgcatgcttggcgtgaaagcatacaatagctttggcatgactgagatgaatggtccgggtgttgcatttgaatgtaccgagcagaatggcatgcatttttgggaagattgctattatgtggaaatcattaatcccgagacaggtgaacctgtacccgaaagagaaatcggtgaacttgtactcactactcttgatcgtgaaatgatgccactgatacgctatcgcacacgtgaccttacccgcattttaccgggaaactgtccttgtggccgtacccatatccggatagaccgtattaaaggcggtagtgatgatatgttcattatcaagggagtaaatatattccccatgcaagtagaaaagatattggtacaattccccgaactaggaagcaattatctcattacgctcgaaactgtgaacaatcaagacgagatgattgtagaagtagaactgagtgatctttctaccgacaattatatcgaactggaaaagatacgcaaagacattacccgccagctaaaagacgagatacttgttacgcctaaactcaagttggtaaaaaaaggctctttacctcagagcgaaggcaaagctgtcagagtaaaagatctgagaaacaataaataa

SEQ ID NO: 97 - DNA, 840 bp, B.fragilis
aaaacaatggcaatagcatatgacgggatcaactatttcccggtgggtgtaaacttcatggaagagaacgcaatggaagtgatagaagctaaatatggaataaagggttcggcaatcgtactgaaactgctgtgcaaaatatacaaagagggatacttcatccgttgggatgaagagcagtgcctgatctttgccaacaaggcgggaagagaggtgcaggccgctgaggtacaggggatcattgagatcctcttcatcaaagggatattggacagaaacagttatctggcaaacggaatactgacttcggcaaacatacagaagatatggatggaggcaacaaagcgaagaaaaagggatctgaaagcattgccctatctgctggtgaacgacttgactcagcaggaaacagaagcgccggaaggtgaaaatgtaaccattagcccgggaaatgtagtacatgatgtagccgttaacgcaaaaaatgcatgcaattccggacaaagtaaagtaaaagaaaagaaagcagaggaaaataaagaattacccccctcagctccccccaaggggaaggagaaagaatgggaggaggtttctgctcctctcccgatacccggatacgccttcaacacaatgacacacaattatccgggactgacggatacactcaaaagactggggattaccgaagtaggagaggtgaatgccatactcaggctatcggattatggaaggaaaggaacacgggtatggcaactgattgccaatacttgctggagtgacataggggcaaaaggaaggtatctgatagcagcactgaataaggcaaaaagaaaataa

SEQ ID NO: 98 - DNA, 636 bp, B.fragilis
ggacgcaattttctgattgaagccatcaatcaggattactaccatgtccatggggcactggctcataacttcgataccactctccccgaaattcaagccaagcaagtgaaagagacattgaaagacccctatatcttcgatatgcttacattcacggacgagtatgacgaacgggatgtggagttgggcttggtaaaacatatcgagaagttccttgtcgagatgggagccgggttcgccttcatgggcagacaatactatatagaggtgtccggcaatgacttttatatcgatatattgatgtgcaacgcatttatgcacaggtatttagttgtggaattgaagcggggagagttccaacccgaatatatcggtaagttgaacttctattgttcggtggtggatgacatcctttgccgggcaggagacaatcagaccatcgggttgcttctttgccagaacaagaaccgcatcatggcggaatacgccctgcgtgatgtgcataagccgataggtatttccgattatgaattggggaaagcgttgcccaaagatattaagtcagggttgccttccattggagagttggaaagcaaactcagtcgggagttggaggataacacgcaaagtctataa

SEQ ID NO: 99 - DNA, 1923 bp, B.fragilis
atctacttttatattactatgaatatacgattttattataagtatctttcatcgcgagttgcttcaaaatggctgatacttgctgtcgatgttcttttagtgatcttttcaatgtttctggcaagccttttgcaaataggtctgtcggcattagtctttgagttttcgttgtgggtgtggacaacactgttttgtgtaatattcaatgtgtgcttctttcatctgaatcgtacttatgtaggggtcattcgatattcttcctttattgatatttctcgtattttcatttccttaaccttgggatatttggttacctgtgtaggcaatttgctttggatggggtggagtggacgagaagtattgccgattagtgttattcttacagcttatatcgtcaatttctccttgatggtctgtttgcgtattttggtgaaaatgatccatgagttgatgactttcgatcgtagacatagtattcgggtgtttgtttatggttcgaagggatctggtattaatattgctaaatcattacgagttagtagaagtaatcattttagattaaaaggatttatttcagatgatacaggctttatagggaagcagacgatggggtgtagggtatatgcgaataatgaatctctgtttgatattttagaagaagagagaattgaagctattattgtttcttctgagaaagtgcaccgacttgaaacctccggtatgattgaccggttgatagccgaggatattcgtattcttacagttcctccattcaatgatctgggaaaggaaggtatgcaaataaaggatattcagatagaagatttgttacagagagaccctattcatgtagatattcgaaaaatatcttcccatatagaaggaaagagaataatgattacgggagctgccggttcaattgggcgtgaaatggtgaggcagatagccggattgaatccatataaattaattttggttgatcaggcagaatcacctttgcataatgtacaattggaactgttggataattggcgggatattgatgctaaaatgctggttgccgatgtgactaaccaaacgcgcatggaatcaatctttaaagactatcgtccgcagtatgttttccatgctgctgcctataaacatgtgcccatgatggaagataatgtatctgaagccatacaggtgaatgtgctgggtactcgtattatggctgacttagctgtcaaatatggtgtggaaaagtttgtgatggtctctacggataaggctgtcaatccgactaacgttatgggatgtagtaaaagacttgctgagatttatgttcagtctctcgcacatcaattatctaaatatgccaatgatggggcattagtgaaatttatcacaactcgttttgggaatgtgcttggctcgaacggatctgtgatacctagatttaaacaacagatagagaaaggagggccggttactgtaacgcatcctcaggttatacgttattttatgactattccggaagcgtgccaattggtattggaagcgggaagtatgggtaatgggggtgaaatctatatttttgatatgggcaatcctgtgaagattgttgatctagccagaagaatgatctatttgagtgggcagaaaaatataaaaatagagtttaccggcttgcggcatggtgagaagctatacgaagagttattgaatgtgaaagagttcacttgtcctacctaccatgaaaaaataatgatagccaaagttcgtgaatatgattatgaagaggttaagcaagaaattcaaaagttaatagatttgagctatacttctgacaccatgggaattgtcgcttctatgaaaaagatagttcctgaatttgtaagcaagaattcggagtttgagatattagataaagcctctttttaa

SEQ ID NO: 100 - DNA, 306 bp, B.fragilis
ataatttctcttaataactatataagttatgatgtggtttctaattctttttggataaaatattttaatttatatattaaaaatatgtatcagtatgctttttctcccaataaatctcatttgatttattctacaatagcttttggagatgaaccggaaattattattatgggaaaaggacagataacaaatgatgatgaaatacaaatgtatccttctattaatgataatggagatgtggagatattgtttatcaagcaggaaataaaaaaactttccatactatgggtgggatgctttcgctaa

SEQ ID NO: 101 - DNA, 2118 bp, B.fragilis
tttactgaatatagtaaccttacacaaacagacaaacatcgtcttatgaagagaaatgtatcattgctgaagtatgcactgctgatagcactttgctgtgtagcatgtgtaaatgagaaagatttgtatgaaccgtcgggggaggatcctggtgaaacggaagaattggacttatcgttcaaattcgctttgagagccgataaacagattcatatatctgttacccgggcagatggaaaagctgctgaggggataggggttggagtgtatcttcaacagccttatgaagaagacgggattatttccggtaagcctctctatatgggctatacagatgggaatgggcagattgatgctactatttctgttccggcaaacagtgataagttgtatgtcgcttcgttgacagccggttatcccggagtgcaggagatggatgtgcaaccttcgatgacgtgcaacttgactgcaacagcctttcaaatcaagactgctactacccgtatggttgctacccggagtgaaacaggattggatgttcccgtcggccagaaactgagcaatctttatgaattgtatagcccttatactgattcggagattggaaaagacggtataccacttttgaatgcttctccgcttgttacgaaagaggaattatctgctaagtttctaaatttaatgaatagttggtatccggaacagaagaatgtgcaggatgtggatttgaaaaagagctctgatctggtggtgactgatgaattgggagcggaagtgtgggctacgtatgtcggtgatggtggattttatgtaaataatgcgaccgtctacaatgtgttggcttattatagctaccaggaaggggagcttggcagacgtgaagatatacagggacatcgtatgactttgttacttccgaatactcatcagcaaaagtgtccttcgggtttaaaagtacaattgttgtattgggacggaaaacaatatagtaaggtattcccgaaaggtgcacgtatcggttttgctgtggcacgtgacggattgaatatagctaatgtaaatgctgccaatggaggagtgaattcaaaaagttcctataagttcaagaatcagaccttcccgaatggagatgttaatggcttttattactctaccccatctttgaatgcaacgaaaaggacgaatgcggtgattcgaaatgtgcccgattacaactgttgcattatgggcttcgatattcgcccttatgatgatccaaaagcagattatgattttaatgatgtgatgataaagcttaccgcatcaccggtatctgccataaaaccggaagaagacattccggtgatcgatgaatttactccatcggaggctgtttacggtacattggcctttgaagaccagtggcctaagatgggggactatgacttcaacgattttgtgatgaattacagttatgagttggagaaaggggataataatatgattactgctctaaagttgactttcacgccgattgcaaagggagcagcttcatggacgcatatcggtgtaggcatcgaactgccgctttcggctgacaatatcgacaaagcaaagtcggaaggtgctacacttgaagagggtaatgaccgggccacttttattgtctggaatgatgttaatactgctttcggtacgactgaaggatatgtgaatacggagggtgcggtggtcggagtttccgctattccggttgaagtaaccgtacgactgaagactcctgtcagcagcttgttaactcagaagtttaatccgtttatttttgtcaacagccgtcaaagagaaatacatctggtagattataagccgacaaaacatgccgacacttcactcttcgggacagaaaatgacagatcggatcctggggctgaagtttattatcgtatggataaccgatatccatgggctcttgatttcccacggaaggaagactcttcaccggcctggaattatcccaaggaaagagttatcattacgaaagcatatcctaattatgagaaatgggtgcttgatcaatccaatctttcctggtttgacgcgagtgtgtcggggaacgtgaatagggaattcttatattaa

SEQ ID NO: 102 - DNA, 1386 bp, B.fragilis
aaaggagattttagagggagcttatcgttcaatattgatggatatatgagagtaatgatccgaattaaaagaaagattgacagctcaccgtttttgaaaagcgttgtagtcttgttttcaggaaatgtttttgctaatttaatttcactcttatcaattccaattcttagccggatttattcggatatagcttttggagattatgcaattgttatttctactgctacaattgttaacggtatttcaacattaggattaacttcagccataatgataccggtggaagaaaataaagccaaatcagtttttactacagcatggatttctcatatattggttagtactttttgctttgttcttgcactgattttattacctgtttattctatttattctattacagggtcttattcttgttctttactattgatgtatctttatgtacttcttgttggtaccttctctttgttgtctgtttatgcaaatcggttaagaaaaaatcggatcttattttggaatgcaatgataaattcattggcattgctctgtttagcaattccttttggcttatgggggtggggagggactggcttcttgatggcatctaccggtggatacttagtggcaaatatacaaatgctatatcatatgaatccatttaagaaaatagcttatagggattgtgtatctgtttataaagattttaaggactttattatatatcagtttccttctaatttaatatcaacttttacgattcagttacctaatcaattgttttctgcctattttggtaatgcttcattaggaggttatgctatgtgtgaaagaatattgggggttccgatgcgtttgataggtgctcctattacaactatctattttcgtcattcttctgaatgcataagagagtgtaaggatatatctgggtttacttatattttgattacacgtattttgatattagcttttttacctgtattgattttattttcttgttcggaagtattatttacctttattttaggagattcatggttgcttgttggcaaaattgtatctattttaatatttccgtatgtgctgttgttttgttcaaactgtgttagctattgtttggttgtaattggaaagcagaaaataaacttgtatctttctttactttatttaatgttgatcgttgcatctgttgtgtctggattttatgtttttagtgactttgtttcggttgtgatatgctttgcggtagcattgattgtatttaatctattgaatttattagttatattttattatcttaggaaagattttggaaggtttgtaagattcattggaatttatttgctgttaatatacttaggtcttattttaataaaatatttatga

SEQ ID NO: 103 - DNA, 2571 bp, B.fragilis
tcagaatatcttatgcgtagatttattacactattcttcttgatttttaccttgtccggagtggctgtagctcagcaaatgtccgatgatcaggtcgtgcagtatgtaaaagatgctcaaaagatgggtaaaactcagaagcagattacaacagagttgatgagaaggggcgttacgaaagaacaagtcgaacgcattcaggaaaaatatgaaaatggaagtggcagtaccggtacacagaacaaccagaactcaacaaggtcgcgtacgcgtactcagcaaaatgatgaaagtgattactctaatcgctctcaaaaaaatctgaaagatcagaaaaatcaaaagaaccagaagaaccagaagaatataaaagggcttcgtcagtcgaacaaccagaaaaacaagcgtggaatgggagatgagaatctggaaatgacagatgaagacatgatgaatgaggaagactggtctgacgagtacaccgtgaagccggaagaggatccgactcaacaaattttcggacataatatttttacgaacgagaaccttacatttgaacccaatctaaatatagcaactcctgtaagctatcgtttgggacctggagacgaggtgattatagatgtgtggggagcttctcagactacaatcagacaaaccatttctccggagggtagtattttagtcgataatcttggtcctatttacctaagtggaatgactgttcgtgaggctaataatgcggtacgtcgtgaatttgcgaaaatctacgcaggtatatccggcccgaatcctaatacttcagttgatctgacgttaggcaatatccgtactattcaaattagtattatgggagaagttgctgttccgggtacttatgcgctctcggcattctcttctgtattccatgctctctatcgtgccggtggtgttaataagataggtagtttacgtagtattaaagttgtgcgtaacggcaaaaaaatagcagatctggatgtttacgatttcataatgaaggggaaactgaatgacgatgttcgtttgcaagacggtgatgtggtcattgttgatccatatgaatctttagtgcagattaccggtaaggtaaaacgtccgatgttttatgagatgaagccttctgagacaatggctactattttaaaatattcaggtggtttcaccggggatgcttataaaaaagctatacgtttaattcgtaaaacaggccgtgagcatcaggtttataatgtagatgaaatggattattcggtatttaaactggatgatggagatgtgctggctgtggattcggtattggagcgttttgaaaaccgtgttgaagtccgtggtgctgtttatcgtgccggtatgtaccaaatcgatggaactgtaaacacagtaaaacaattaataaagaaagctgaaggagtgagaggggatgctttcttaaaccgtgctatcatcgatcgtgagaatgatgatcttactcatgagatgattcaaattgatttaaagggattgttgaatggtactgtagctgatattcctcttcagaaaaatgatatcctttatattccgagtattgaagatttgaaggaggaagcaacccttacgattcatggtgaagtagccaatccgggtacttatttgtattcatccaatatgtcggttgaagaccttgttctacaagccggaggattattggaggcagcttcgacagcccgtgtggatgtgtcccgacgaataaaaaattcaaaaagtactgaattgagtaatgtagttggtaagactttctcttttgaattgaaagatggttttcttgtaggaggtgatcaggatttccatttggaaccttttgacgaagtatatattcgtcgtagccctgcttatcatcaacaacagaatgttacagttggaggcgaggtcttatttggtggacgttatgcgctatcaaagaagaacgaacgtcttagtgatttgatttctaaagcgggcggtattactcaagatgcttatgtgaaaggtgcccgtttgattcgtaaaatgacagaagaagagttgcgccgcaaggaggatgcacttcgtatggctaataagggtggagctgattccatttctgttaagacccttgatgtctctgatacttattctgtcggtattgagttggaaaaggctttggctaatccggggtcagactttgatatggtattacgtgaaggcgatattttgtttgtgccggagtatgtaagtaccgtcaaaatcaatggtgctgtgatgtatcccaatacagtattatataagaaaggcgaaagtttgaaatactatattaatcaggccggtggttttgcaagtcttgcaaagaaaaaaagagcttttgtggtttatatgaatggaacagtgtctcgtttacgtacgggaaattctaaagcgatagaaccgggctgtgagattatcgtgccaagtaaagatccgaagaagagaatgtcggcagccgaaattataggaatgggtacttctgctgcttcattagcaactatgattgcaacgatggttaacctctttaagtaa

SEQ ID NO: 104 - DNA, 2898 bp, B.fragilis
atgaattttcaagatttacatatactcggtgaattaaaggaagaattgctttatcgtattctttattcaactgatgcttctgcttacagagagatgcctattgctgttgcatatcctaaggattcttctgatgtgcagaagatcagtaattttgccaaaaaaaatcaaattaatttgattcctcgtgccggaggaacttctttagcgggacaggtagttggtaaagggcttgttgttgatatttccaaatatatgaaccatatattggaaatcaatcaggaagaacgttgggtaagagtacaaccgggagttgtattggatgagctaaatctttattgtaagccttatgggttgtttttcggaccggaaacttctacttctaatcgttgttgcttaggaggaatggttggcaataattcgtgcggttctcactctttagtatatggtagtacacgtgatcatttgcttgaagctaacgtcgttttaagtgatggttctgaagtagtattgaaaggaatgacttctaaggagataaacgagaaatgtaaattagactcattggaaggacgtatttatagccaaattattacgttattatcgaattttgaaaaccaaaaagaaatcgtcgataattatcctgatgtatctttacgaagacgtaactcaggatatgctattgacgaattattgcgtagtaactattttgataagaattgttctgagtctttcaatctttgcaaattgttagcgggttcggaaggtacattagccttaatcacagagttaaaactaaaattagttcctcttcctcctacggaaaaagccgtgatatgtgtacattgttctacattggaagaatcttttgctgcaaatcttgtggctttgcgacatgctccggttgcaattgagttaatggatagtacaatactggagttgagcaaacagaatatttcacaaaataagaatcgcttttttattcagggagatcctgctgctatcctcattattgagttagctgagcaaacaaggggtgaggttgataaaaaggctaatgaaataattgatgatttaaaaatacatcattatggaactcattatcctcttgtatatgggaaagatattagtcgtgtatgggctttaagaaaatctggattgggattgctttctggtatgcccggaagtgctaagcccgtttcattgattgaggatactgccattgctcctgagcgtttagctgcttttatcgctgatttgaaagttatgttaagtaaatatggtctggattgtatttatcatggacatattagtactggggagttgcatttacgcccggtactcaatttgaaaaaggagaaagataagaaactattccgtttagttgctacggaaacggctgagttagtgaggaagcacagaggctcattaagtggtgaacatggggatggccgtttgagaggcgagtttatccctttgttgttgggtgataaaatttatagttttctgcgagacataaaggagacatgggatttacctcatatatttaatattggtaagattgtagatacaccttttatggatattaatttacgttatgaacagcacaatcttggggttaagacatattttgacttttctaaacaaaagggttggttgtgcgccatagaacaatgtaatggttctggagattgccggaaatcaaatctctttggtggtacaatgtgccctacttatcgggctaccagagaagaaaagaatacgacacgggcacgtgccaatactttgagagagttgttgatacatcctgcacatgatcgaatatttagtcaaccggaaattttggaagtattggatacatgcgtttcgtgtaaagcttgcaaatcggagtgtccatcgaatgtggatatggctcgttataaggctgaatatttgcagcatcactatgatgaaacatttgtttctttacgttccagattaatagctaatttgactaaggtgcaaaaattggggatggttgctccttggctgtataatgcttttgttactgcccaatttacttcctcattactaaaacgtatattaaagtttgcacctcaacgttctattcccagactttataaaataacattgaagagttggttatacaataatccagatatgaacaaatgtaatagaaaagtgtatttgtttgcagatgaatttaccaattatatggatgtagagattggtataaagttcatcaaattattgcgtacattgggctatgaggttattataccaaagcacttggaaagtgggcgtactgaaatatcgaaaggacttttgaagaaagctaagaaaatagcagaaaagaatatattatttttaaaagatatagtgacagaagaaattcctttagttggaattgaaccttcatgcatactttcgtttcgtgatgagtatccggatttggtggatgaggaattacaaggatatgctcgtaaattatcggtaaactgtctgttgtatgatgagtttattgttcgtgagatgcgtaagggtaatattaaacagaaacaatttactcaatcatatctttatataaaattacatgggcattgccatcagaagtcgttagcgtctatagagccttctaaagagatgctttcactccctaaaaactatcaagtggatattataccgtcagggtgttgtggtatggcaggagcttttggatatgaaaaagagcattatgacttatcaatgcaaataggtgagcaggtcttgtttccagcaattcgtcaagctaaagaagatgtatgtatttctgctcctggaaccagttgcaggcagcagataaaagatggtacgggaaggcgagcttatcatccaattgaagtgttatatgatgctttaatttaa

SEQ ID NO: 105 - DNA, 3255 bp, B.fragilis
gcaactcttcaccatgaaagagcggatagacaagtggcaggttctcaacaagtattatcaagcaacatgagtttcacaacttcaatcaacatagagcgtgactttggcaagataccccactatatcgtcactgccaatgctcgccagaccatcggcaaaattatcaatcactttgccagtggcattcattcgttttgcctcatcggctcgtacggcactggcaaatccagcttcatcctcgccttggaaaactgcctgtgtggaaagactgttggaaaaaatgtcttactgagtcaacgtggtcaattcaatagttttgagcaattctcgtttataaacatcgttggcgactacgcatcgttggcgaatctacttgcgtcacatcttaatgcagaaagtaagaacgttatctctgtgctggacaaccactataacagacttcagaaaacgaatcaattcttagttattgttattgacgagttcggtaaagtgcttgaacatgcagccaagaacaatcctgaaaaagaaatgtactttttacagaagttctgcgagtatgtaaatgacacaagtaagaacattctcttccttacaacgctgcaccaaggttttggagcctatgccaagggattgaaagcagagcagaaacaggaatggacgaaggtaaaaggtcgcattcaggatatcgtctttgctgaaccgatagagcaacttctcaaccttaccgccactcatatatcttcggctgacaaaaagccaacactcaacacagacaagatttacaacctagctgtcgcttctaagtttgccgccagcacacttgatgccaacgttgcccgtgctctctatccaatggatattgtctcggcttacgtttttacccaagctaatcagagatatggccagaatgagcgtaccttgttcacattcttggagacgcgcggtgagggaactgtcaacgattttgaagcttcaatcaatcgtttgtatagtcttgccgacgttcacgattatattgtttataatttttattcttatttgcaagaggcccacgaagactcggcgaattggtcggctatcaagattgccatcgaaagaacagagggactcaatgcagatgccacaaccataaccgatgccatcaagattgttaaggccgtcggccttctgaacatctttgcctcgtctgctgctagcatcgacaagcagtttctgatagtctatgctagctatgctatggacgtttgtcaagtgggctcggtgatagacctccttgaaaagaaccagatactgcgtttcgctaaatacaagtccaaatatatcctctttgagggaactgatgtagacttggaagcaggcctttatgaggctgctcgcgaatgcaagcgttccgatgttatagcagaaaaggtgtgtgaatacttcgacgacaagatagcacttgccaatgcgcactattttcgcactggcacgccacgatacttccagtactgtctcacctcttcgcctattgaatacatcgtcagtggcgagactgacgggattatcaatgtgatactgacccgtcaggaagaccttgttgctgtcaaagctgcttgcacggacataaatggtaaagccatcctctattgcatttttgagaacacaaccgaaatcgctgaccatctctttgagatagacaaactccattgggtgcgcgactattacgtggccgacgagaacgacaaagtagccaaccgcgagatagctaacctgctggttcacgaacagtcaatgttgaacaaaaccattatggagagcctcttctctgacaacgtgacgtggatttttaacggcgaaatccttgcgtcaatcacatcgcgtaagatgctcgcacagcaactctctaccatatgtgattctgtctattatgccactccaatctatcgttttgagctcattaacaagcaccgccccactggtaatatgtcacttgcccgtcagtcgtatttgcaggcattgcttgaccactcttccgagccataccttggctttgagagggataagtatccacccgagaaatcgctatatctcacacttctcaagaatacaggtattcatacaactgccggactgggctcaccgaccgaaccttcattccaaccactttgggacgcttgtgagaacttcctacgctccactatcggcaaaccgcacaagttgggagaactcttcactctgttagaggctgcgccttttcgtctgaagcaggggttgctctattgttggattcccacatatctgattattaaacgagatgatttcgcgctctataacagcgatgggacctatgtaccttacatcaacaaggaggtgcttgaccttatactgcgctcacccaatggttttctcattaaggcctttgctgttgacggtgtccgccgtacatttttcgacaaatatagagaggctatcaatatgggtagctcagaactctcgactcaatcgtttatcgaaacgattcgtccgttcctcaccttctataagaagttgaatagctatgctcgacgtacgaaggatatttcgcccaatgctcgtaagttccgtgatgtcatagcaaaggcgaccgacccagagaaaacattctttgaggtgttgccggatgagttgggctttaaggaaattacacttagccaaaacccagaagccattgagagctttgttgctgtcatacaagaggctatccgcgaactccgcaactgctactctgaattggttggcaatatcgagcaatatttgcttaagacactgcgacttgaagaagtcggtttctctgactatcatcatctgatagcagaacgatataagtcggttaaaacggaattgatgcctgtaaatatgcgtaattttcaagcccggcttgttggcaactatgatgacaagaccgcatggattgaagcggtgtcatacgtcgccctcaacaagcctttgacagaaattcgcgacacagataaatcgttcctgctggctacattgaaagatatgctgtttcaattggatgactatgtggagatgcacaagactgcaagtgaggatgtcataagactgcatatcacacagaataagagtaaggctgtaactacgcaagtcattctttccgaagcgatgcgtcaagaggttaacagccttgaaaacaaactggagtctattttgagtggtgacaactcgctcgacgttgctgcactgatagcaatccttaaaaagaaattgaaatga

SEQ ID NO: 106 - DNA, 267 bp, B.fragilis
ttttattcacattgcgttgatcaacattgcaaaggtgaacatttgcaggaagatgacaaaagaaaacaaggcatccggatcaagttatacagaataagttataatcatcacattatcagtgctattacttattttttcttatacatctacttcacatactctgctattgtccgattattcatattatacccgtttaacgaaatatccccggttttatacctggcatggcataaaaccggggacgaaacaaaaatctatacccattag

SEQ ID NO: 107 - DNA, 432 bp, B.fragilis
aaaaacggacaaaacttacaatcggatggttctatgagcttctggaacgaggcaaatgtgatattatggatttcaaggaacagtttgaagataagtcttgcggacatagagtcgtcaccatacataagcaagcagttgcttcgccacacattagaacatctacaagaactggactttatagagtcaactggtcgcgcatcaggtttgcgttacatcttgcataagtctaagatacaaacaactggtgagaaaataaaatattcgcaactgaagaggcagggcaaggcaaaacagagagaagccgtcatacggtatataaacacagtcggcactataactaatgcggaggctcgcgaaatactcaacttgacagagacatcgcagtcatacgtgccaaggtgttatccgaactatggcgtgaaggacatatag

SEQ ID NO: 108 - DNA, 876 bp, B.fragilis
atgtttactaacctcatcaaaagagtaattatgaagtatgcattctctggtcatgagtcctttcaatgcaagggcttgtggttgaaaaaaggatatgactacgctaaggcgggattgtcgttcacagatgactacgctgttgtagaacttggtgtgggcaagaatatggtagcctcaatacgctattggttgagagctttcggcatcactaacgacaatggtgtgccgaccgagataggtaaatatcttcttgatgacaacggcgcagacccttacatcgaagacacgaccacactatggctgctacactatatgctcgtgacatcacgagtagcaacactctacaacatcgttttcaccgagtacaacaaaacacgcaaagagttcacgaaagcagatttggcaaatgcagtaagacggatgtttgccgacaaatgctttgacagcacaccctacaacgagaagacagtttggcgtgacatcgacacaatgctaaagaattatgttacgcccgactctatcaaggcgtgcgatgacttctctgcactgctaattgacctcaaactgataggcaagactggccacgaggattataccttcaactgttccgctcgcgccaagatggagccgctcgttttcctctttgccgtactcgacatcacgcagggcaaacagcaagtgatagagttcgaggtattgctgcgacttgccaatatcttcggtatgtcagtcaatgaactatatgacgttttcgaccaactgcacactatcgacccccatataaccttctgcaatactgccggtgagcaactcttcaccatgaaagagcggatagacaagtggcaggttctcaacaagtattatcaagcaacatga

SEQ ID NO: 109 - DNA, 330 bp, B.fragilis
aaaaacgctaacactaaaacacaacctcctatcacagagcctattaaagagacaagaggcagaaaagcaggagcgcagataccgggaattatctccaacaatgaaggagttataaaagcgctgatagaatcctacatattggacgcaaaagaacaaaatatcaagacatgcaaagattcattggcacgctacatagagggaaaaaaactttttggaaaaataagaaatggagtattcaagccattagttttaagcacaatcagaacttacgtcaacgaaatctggaataagatggaaagaaagaaaaagaaccaagaaggaaagcgctga

SEQ ID NO: 110 - DNA, 195 bp, B.fragilis
acgtttcataaggtaaagcctcgacttaacattgaaagcagaatctttcaaactcttcactactacatattgactttaatgtttcgtagcaaaggtaaaattagaattctaagctttttttcgagtggttacgagaatccgcaaaaggggaaagaaaacatcctcccccttataattttattttcaatcaaataa

SEQ ID NO: 111 - DNA, 195 bp, B.fragilis
aggggaaataaaagggaaaatgaaaccttttctcttcttaattgtctgacattaaatgaaatagttcttaaaaaagtgagtgtttcaataaacgatcgtttaattgaacgcaaagatagagggtattttcataactgcaaaatgtttaataaaaaaaatgttttccttcatggcttgatctatttaattgtttga

SEQ ID NO: 112 - DNA, 1596 bp, B.fragilis
gatatgagcaaacaactcttacttggcgacgaagccattgcgcaagcagcattggatgccggactttcaggcgtttacgcttatcccggcactccatctactgaaattaccgaatatattcaaatggctcctattacgagcgagcgtaacatacacaaccgttggtgtgccaacgaaaagacggcaatggaagctgccttaggtatgtcttttgttggcaaacgtgcattagtctgcatgaaacatgtaggaatgaacgtagccgccgactgttttatcaattcggccatcacaggtgtaaaaggcggactaattgtagtagcagcagatgaccccagcatgcattcatcgcaaaacgaacaggatagccgtttttatggcgatttctctttgatcccgatgtacgaaccgagcaaccagcaggaagcttatgacatggtgtacaacggttttgagttttctgaaaagataggtgaaccgatactaatgcgtatggtgacacgtctggctcactctcgttcaggtgtagaaaacaaagcacaaaagccacaaaacgaaatttcgttcagcgaagacccacgccaatttatcctgctcccgggcaacgcacgcaaacgttataaagtactactcacacgccaggaagaattcatcaaagcatcagaagagtcaccatataacagatatatcgatggccccaataagaaaactggtattgtagcttgtggaatcggttacaattatctaatggagaattatccggaaggttgcgaatatccggtattaaaagttggacaatatccgcttcccaagaaacaattgatgcaattaatcgacgcttgcgacgaaatccttgttttagaagacggacaaccatttgttgaaaaacaattgaaaggatatctgggtatcggattaaaagtaaaaggccgtcttgacggtacattatcacaagacggtgaattgaatccggacacggttgcacgtgcgctcggcaaagagaacagctcggaattcaatgttccgaatattgtagaaatgcgtccgccggcattgtgtgaagggtgcgggcacagagacatgtatattacactgactcaagtgctaaaagaagaataccccactcacaaagttttcagcgatatcggttgctacactttaggagcaaacgccccattcaacgcaatcaattcatgtgtggacatgggagcctctattaccatggccaagggtgcctccgatggaggactccatcctgctgttgccgtaatcggagactcaacttttactcattcgggcatgaccggactattggactgtgtcaacgaaaatgccaatgttaccatcgtcatttcggacaacgaaacaacagcaatgaccggtggacaagattctgccggcacaggtcgccttgaagccatttgcgccggattaggtgtagatccggctcacattcgcgtagtagttccattgaaaaagaactatgaagagatgaagcaaatcatacgcgaagaaattaattataaaggagtatccgttatcatcccgcgcagagagtgtatacaaacattagcacgtaaaaaaagaagtaagtaa

SEQ ID NO: 113 - DNA, 429 bp, B.fragilis
attttatcaaaccggaatacattcgatccgacttacctttggggcgataatttatctattaaccctttaaatcatatacgtatgaaacagaagaaaagaccggcatcacaaactgaagccatgaaactgagatggaaaaaacggattgtctttgagaaaggatacactgaaatgtgtgccgaatggatggcggagcgcctggaagcgttgaccgaccacctgcaatacgggcacgcagccatcgcttatcagaagcagaacggagacttcaggttggtaaaagcgacactgatctactatgaaacggaattccacaaaaagtatgatcccacacaaatagaaggcgccgtagtctactggaatgtggatgaacagcgatggacgacattccagatggagaacttcatggagtggagaccgatcgtatag

SEQ ID NO: 114 - DNA, 1233 bp, B.fragilis
atattaccaaaattattaatctatatgaaacaacatcttttaaaagaaatagaactaggtaccaaaagcgctcttctcaaaaagaaaattattacacattatatatataatggcagttcaacaattaccgacctgtctaaagaattggatcttagtgtccctacagtcactaagtttatcagtgaaatgtgcgaagaaggttatatcaacgactatggtaaattggaaacaagtggaggacggcaccctaacctatatggcttaaatcctgaatccggctactttataggagtcgatatcaaaagatttgccattaatatcggcttgatcaacttcaaaggtgatatgatggaacttaaaatgaatattccttataaatttgaaaattcaatagaaggattgaatgagttatgcaaactcatttcaaattttatcaagaagttgacaatagctaaagacaaaatattaaatatcaatgtaaatgtttccggacgcgttaatccggaatccggatatagttttagtcaattcaattttgaagaacgcccattatctgaagttttagctgaaaaattagggtataaggtaacaatagataatgatacgcgcgccatgacctatggagaatacctaaaggggtgtgtaaatggcgaaaaagatattatcttcgtaaatatcagttgggggctaggtgttggaatcatcatcgatggcaaaatttatacaggaaaatccggattttccggagaattcggccacaccagtacctttgacaatgaaattatttgccactgcggcaaaaaaggctgtctcgaaacagaagcttccggatctgcgctacaccgcatcttgctggaacgtatacaaaatggtgaaaactcaatcttatccaatcgtataggagacattaacaatcctataaccttggatgaaatcattgcttctgtaaacaaggaagatcttttatgtattgaaatagtggaagaaatcgggcagaaattaggcaaacaaattgccggacttatcaatctttttaatccggaacttgtcattatcggaggaacaatttcgctgacaggagactacattactcaaccaataaaaacagctgtccgcaagtactcacttaatctggtcaataaagactcggcaatcgtcacttcaaaactaaaagacagagccggtattgtcggagcttgcatgcttgcaaggagcagaatgtttgagtgttaa

SEQ ID NO: 115 - DNA, 285 bp, B.fragilis
ataaggcaaaaagaaaataatccggataggaaagtacagtttgcagttgataaaaaagcaagtataccggtttccatacggaaggttctctgtcgggaatggaaaacgggacgtacatttaaacaaatgatctacagtcacttcagagcacaatatttcaatctgcagaagctttattttaacgttacgttaaagttcgtttttcgtctgcaaatagcaaattctttaaatgcaaaagacttgttatttgcagacaagaacaaagctatcggaaaatggcattaa

SEQ ID NO: 116 - DNA, 588 bp, B.fragilis
gccatgaaaaaagatatcatattatcaggtgtaggcggacaaggcatcctgtctatcgccacagtaatcggaaaggccgctcttaaagatggtctgtatatgaaacaggcagaagtacacggcatgagccagagaggtggagatgtacagtcaaatctccgaataagcgatcagcccattgcttccgacttgattccttcgggtaaatgcgatttaatcatttcactcgaacccatggaaggactcagatatctgccctacctcggtcatgagggttggttggtcacgaatgaaactccgttcgttaatatccccaattatccggctgaatcagatgttatggcagaaattaataaactgccacacaaagtcgtattgaacgtagataaagtagctaaagaattagggtctacacgagttgccaacatcgttctattgggtgccactatcccgtttttaggcattgattatgaaaagatacaagatagtatccgtgaaatattccagcggaaaggcgatgcaatagtcgaattgaatttaaaagctttggccgccggaaaagagatcgcagaaaaaacgatgaaataa

SEQ ID NO: 117 - DNA, 969 bp, B.fragilis
tcaatgaaaaattttgcattaatcggagcagctggctatattgctcctcgtcatttacgtgctatcaaagatacgggaaaccgtttggttgcagcttatgatacttttgatagcgtcggaataatggatagtttctttccggaatcttccttttttgtggaacaagaacttttcgaccgacattgtacaaaattaaaaggtactgacaaacagattgattttctatctatttgcactccgaattatttacatgatgcgcacatgcgttatgggcttcgattgggtgctgacgtaatttgcgaaaagcctttggtcttgaatccatggaatgttgatgcacttcaagaagtcgaaagagaaacagggcatcatatttatactattctccaactccgtttgcatcaatctatcatagatttaaagaagaagatagagaatggccctaaagataagatttatgatgtagatctaacttatattacttctcgtggcaattggtattatacaagttggaaaggggatatgcataaaagtggtggtattgctactaatattggtgttcatttttatgatatgctttcgtgggtattcggtcctgtgaaaaagaatatagttcatgtatatacacatgatcgtgctgctggttatcttgaattggaaaaagcacgtgttcgttattttttgagtatcaattctgaaaatcttcctgaaaatgcagtacaaggtgagaaacttacctaccgtactattaatattgatggagaagagtttgagtttagtaagggatttactgaactacacacagaaagctataaagatattttggctggtaatggctttggcattgaagatgcgcgtaatgctattaatattgtttacgatatccgtcatgctgagccaattggtttaaaaggagattatcatcctttggcaaaacttcctttgtcaaagcatccgtttggctggtaa

SEQ ID NO: 118 - DNA, 270 bp, B.fragilis
aagtacgaaaaaaaccggaagtgtgggggatatactgaaaaaaataattgccattgtccgagatacaaaatactatttgcgcacattttagaaagatattatcgggacttcgaggcttttataccgatatgggcgggatgtccgggcattcatacgccttggaaaagagaagtgatgcaggaaagcggttgttgcaaaccgtatctgcccaaaaaactgcctgactcctcacgtatcgaattctgttttgacgtatttgtaatttgttga

SEQ ID NO: 119 - DNA, 1131 bp, B.fragilis
tttattatgaacaaacgaatctggctttcgcttgctcacatgggtggccgtgagcaagactttataaaagaggcttttgatacgaactgggttgtccctttgggacctaacgtggatgcttttgagcaatctttggccgaatatttgcatgaagaccgtcgtgtagtggctttgagtgctggaacggctgcacttcacttgggcttgattcttctgaatgtgaagcccggtgatgaagtgatctgccaaagctttacttttgccgcctctgccaatccgatttcctatctggaggccaaacctgtttttgtggacagtgagaaggatacctggaatatggatccggtattgctcgaggaggctataaaggaccgtttgcgcaagacgggtaagctcccgaaggctattattcctgtccacctttacggtatgcctgccaagatggacgagatcatggatattgcgggtcgttatggtatccccgtattggaggatgccgcggaggctttgggttcggaattgaacggacggaagtgtggcacattcggtgaactggccgctctctctttcaatggcaacaagatgatcacgacttccggtggaggtgctctgatctgtcgtacggaagaggaggcccgacagacaaagttctacgctacgcaggctcgtgatgccgctccgcattaccagcatacccatatcggttacaattaccgtatgagcaacatctgtgcgggtatcggtcgtgggcagatgtttgtcctcgatgaacatattgcccgtcgccgtgccattcactctttgtatgttgatttgctgaaagatgtggcgggtattacggtcatggagaaccctgattcgcggtttgcttccaacttttggcttacttgtattctggttgatccgaagcttgcgggtaagagtcgtgaggatatccgtttgaagctggactccgagaacatagagacacgtcctttgtggaagccgatgcatcttcagcctgtgttcacggatgctccgttctatgggaatggtacgagtgagaggttgttcgatatcggcttgtgtctgccttcgggacctacactgacagatgaggatatcaggagagtggtggatatgatccgataa

SEQ ID NO: 120 - DNA, 1569 bp, B.fragilis
aaaaagatgaagcaaaagcagttttactttatttatgttttccttctgtcaatgactttcttgggtgcatgttccaaagactctccaaacgaattaattcctaatacaatagtaaaaatcgagattgatgaactacctggaaaaagaatatatttcataggagaagaattggatgtatccgatatgacattgaaagtattttattcaaacgaaacgtctgaaatagttcctgtaaaaaaagacgaagtcactggattcaacagtacggtacccgaaaacgatcagattttagaggtacacaaaggcagttttaccgttacttttaaaatacaagtactgattaatgatattcaagcgatttcaattaagactttaccttcaaaaaccgtatatacattgggagagcctctctccctcagtaatatggtacttgaaataaactatgccgatggtacgataaaagaaaattcagctccatctgctgattgggtacaaggtttcaattcttccgtaccggcacaacttcaaatagtgacacttgaattggatggtaaacaagtatcttttgatgtgcaaatattacctgtaaaagtagacggagataaagttgtaagtgtcattgattccgactttacatcaataaccttcccggatggtattcgcacaataggatcaaaggccttcgaaaataagaatatcaaagcgagtgaacttctgttccctgcctctttgagtacgattgagcaggcagcatttgcttattgcagaaatctgaaaatcgtcgatttaagccacacatcgattaaggaattgccggaagaggcctttttattttccggaataaaaaaaatagcactgcctgcttctttggaaattgttggaaaggaggcattttacgggtgtactgatctgaatgttatcgacataagccatacttccgtcaaagagctacagaacggagctttcgggaaatccggtatatcttctatatctttgccttccacttttaagattgtaggtacatcggctttcatagagacaaagaacttgaaagaattgactctgcccgaaggaagtgaagtgattgacctggaggctttttccggcagttccattcagaaagtaacccttccgaatactatttaccacattgaccgctctttctacaactgccccgaacttactaccatcgaaacttacggaacccggacaacaccttcgcctgttgacaggacggcagcaatagtgagcgaatgttttaaccattctcctaaactcactgttcttaaaattcccgcaagcatagctaaaataggaataagcgctctgaacaagtgtcaagtaaaaactcttattttacccgcaagtgtgaaggcattagacttcaatgctttcggaaatgctgtttcgctggacgaaatttcattaatgtcgcctacgatggttactgccgactattaccccgtagcgccaggaattcaaaagataagagttccccaaaaccttgtcgaaacatacaagcagaacaaagcctggaagccattcgctgaaaaaatcgttgccctttga

SEQ ID NO: 121 - DNA, 978 bp, B.fragilis
attatgaagaaagaagatttaagaattgtatatatggggactccggactttgccgtggaagccctgcaatgtctggttgaaggcggttataatgtggttggagtgattacgatgcccgataaacctgccggtcgcggacataaaattcagtattctccggtaaagcaatatgcactggatcatcaactgcctttgctgcaaccggaaaaactgaaagatgaagaattcattcaggcgttacgtgagtggaaagccgatctacagattgttgtagcttttcgtatgttgccggaagtggtatggaatatgccacgtctgggaacttttaatctccatgcttctctgcttccgcaataccgtggagcagcgcctataaactgggcagtgatcaacggagacaccgaaacaggtattactacttttttcctgaaacatgaaatagatacgggggaagtaatccagcaagtacgtattcccattgccgatacggacaatgtagagattgtgcatgacaagttgatgcatttgggcggtcggttggttatagaaactgtagacgctattctggagggaaaggtgaaatcaatacctcaggaagaaatggcagtggcaggcgaacttcgtccggctccgaagatttttaaagagacctgccgaattgactggaatcagccggtgaaacgggtttatgattttattcgtgggctttcgccttatccggctgcatggagtgagttggtgaatccggaaggggaagcggttgtcgtgaaaatctttgagagtgagaagttgccaaaggtgcatacgttggctcccggaagcattgttactgatggaaaaaactttttgagagtggctgtgccggatggatttgtaaatgtcctttcgttgcagttgccaggtaaaaagagactgaagacagatgaacttttacgtggattccatctgactgaagcatttaagatgaaggctgtgtaa

SEQ ID NO: 122 - DNA, 546 bp, B.fragilis
agatttattgaacggatggaagaaacagccagaaaaataaaagaaaatacttcttgctggtatgctgtatatacagcaccgagagcagagaagaaagtgaaggaacagctggataagataggcgttgaaaactatttgcctcttcaaccggtagttcgtttgtggaacaatcgcaagaaaaagattttcattcctgttgttccgggatgtctatttgtgcacatctcctctgaggagattgctcatgtagccggtattcatggagtagcttttttactgaaggaaaagggacaatatgtttctataccggaagttcaaatggagactttcaagactatgatagagcactcttgcgaactggtcgagtttgcgccaaatgagtttgttcctggaaccatagtgcgagtaataagtggacagttacaaggattggaggctgagctagttgattgccaaggaaataataagttgttactgcgagttgaagggttgggatgtgctttggttacagtctcaacggattgtgtagcttcaaaagaggaataa

SEQ ID NO: 123 - DNA, 1026 bp, B.fragilis
aaagaaattgaaatgagtgaagtaagacacgtgttaggtatatctggtggaaaagacagtgctgctcttgccatctacctaaaagataaataccccaatcttcatattgagtattatagcagcgacaccaaatgtgagttggatgaaaccattcagttcattgaccggttgcgctcttacttaggacacataacgaccttaattgcggcagaaggaagtcctgaacctactccttttgaccactttctgaaggtaagcggtggctatctgccatcggtacaagcaagatggtgtacgcagaaaatgaaactcgccgagtttgagaaatttgttggcgacaccccaaccgtttcatacgtgggtatccgcggcgatgaagaccgtgaaggctatgtatcgacaaagccaaatatacaagccatattcccgttccgcaagaatatctggagtatggatgttattcacgaggtgctgcatgataagaacattgagaattttgcagaatgctatcgcaacgttgcagacgatgagacctatcaaacagttgaagcggctctcacttcaaagcttaccaagcacttctactactcaaagaaattgaatatgctacttgatgctgatgtcatcacctttaatcacgccgtattcagttttctgaagcaatacacagattaccctgtgggaaagttggactatttcccattgattgacaatgatgaggttttggtgagagaagaaatctttcgcatccttgaagatagcggcgtaggcataccagcatattacaaccttatcgactttgaggtggatggaaagaaaggacagtattgccgtagccgctctggatgttatttctgcttcttccagcagaagatagaatggatttggctctacgagcagcatcccgaccttttcaaaaaggcaatggagtacgaaaaagacggatatacgtggattcaaggcgagcctttgagcgaactgatacgatccggagtcgtgtgcggcaaatcaagcttgaccagataa

SEQ ID NO: 124 - DNA, 1182 bp, B.fragilis
atgggcaatgaaaagaaaaaagttgtaaaaatagttcctacctattttgagcatgaaactcgggacctaaaagagatttcagttttaaatagtttaggatgtaatgttattgtagtggccaaaggagataatgctgtaataattgaagagtcttgttatattctgcatagattatgttctaggcctttgatgccttttgtctcaaatctgtttctgaatagacttttttctctttatatatgggttcgatacgtcaggaagttgcatggagaattgctgagttgccatgatttattttgtttgtgcattggttggttatctacccttggtttgcgtaaaaagcctttcctggtctatgattctcatgaatttgagtatggacgaaactgtaaacgaaattttgtttcaaaattgtttattaaaactttagaaaggttcttgtgtaaaaaaaccgctcttaatattgttgtaaatgaatctattgcagatgcagtacaaactcttcatggtttgaataatagacctttagtagtccgaaatgtccctttatactggaatatagatgttaataaatgtgtattgagacggaaaaaaatatgtgaagcatatggtattccaattgatagttttatcataatgtatcatggggtgattgcagctgggcgcggcattgagaatgcaatttatgctgttgagaatgttgaaaatacttgtttgttgattttaggaaatggggaaaaaagctatattgcgttattggaaaaaatgatttcttctttacgattagagcaaaaagtgttttttcacacagctgtggaacattcaatattgtgggaatatattggtagtgttgatgtagaactctctgttatcttaaatacttgtataagttattattatgctttacctaataaaatttttgaatctattcaagcgatgatcccactcatagtcagtgatttccctgagatggaaagggttgtaaaaatgtatgatattggagtttgttgtaaatcagatgatgtgaatagtttagtagaagctatacgactaatgaataaggataaagtattatattctcgttttaaagcaaatatgcaagatgccaagaaagaattatgttgggaaaatgaaaaggagattttagagggagcttatcgttcaatattgatggatatatga

SEQ ID NO: 125 - DNA, 1821 bp, B.fragilis
aggtggagtgatcaagattattcgcgaatgatggaaaaagaaaagataagtttattacagcgctttattatctggcgcgagaataaaatcaaagaaaagcagtttattctcattttaagttttctggtcggtatttttactgccattgctgcactgctcctaaaattctttattcatacgatacagaatttcctgacagataactttaatacgacggaggccaactacctgtatctggtttatccggtggtcggtatttttctggcaggatggtttgtacgcaatatcgtaaaggatgatatcagccatggagtcacgaagattctttatgcaatttcgaggaggcaggggcgtatcaaaagacataatatctggtcgtcgaccattgccagtgccattaccatcggtttcggcggatcggtaggagccgaggcacctattgtgttgaccggatcggcaatcgggtcgaatttgggaagtatgttcaagatggagcaccgtacactgatgttgctggtaggctgtggagcggcgggtgccatcggaggtatttttaaagcgcctattgccggactggtgtttacgcttgaagtactgatgatcgaccttaccatgtcgtctttattaccattgctgatttcggctgtcacggctgccactgtttcgtatattacgaccggacaggaggctatgtttaaatttcatctggatcagccttttgagttggagcgtattccttatgtgattcttttgggaatcttttgcggattggtatcgctttatttcactcgtgctatgaactctgtggaaggagtatttggcaaactctccaatccgtataagaagttggcattgggaggtgtgatgctgagtgtgctcatcttcctctttccacccttgtatggtgaaggttacgatacgatcgaactattgttgaacggcgtgagcaatgccgactgggatacggtactgaataactcgttgttttatggatacggtaatctgttgctggtctatttggtgctgatcattctgttgaaagtctttgcgtcgagtgcgaccaacggtggaggcggatgtggcggtatttttgcaccttcgctgtatctgggatgtattgccggttttgtgttttcgcactttagcaatgattttgactttacctcgactttgcccgaaaagaactttgcgttgatgggaatggcaggggttatgagtggagtcatgcatgcacctctgactggagtattcctgattgccgagctaacgggcggatatgacctcttcctgcctctgatgattgtttcggtcagttcgtatctgacaatcatcgtgtttgaaccgcatagtatctactctatgcgtttggctaaaaagggacagttgctgacccatcacaaggataaagctgtattgacactgatgaaagttgaaaatgtggttgaaactgactttgtcagcgtgcgtccggaaatggatctgggcgaattggtgaaggcgatttcaacttcgcatcgtaatatgtttcctgtgacggataaagacggggtcttgctgggcgtcgtgctactggacgatatcaggaacatcatgttccgtcaggaactttatcatcgttttaccgttagtaaactgatgacctcggtccctgcccgtctgtatgatacagatagcatggaacaggtgatgcagacttttgacgatacaaaagcatggaacttacctgtggtcaatgaagagggcaaatacctgggatttgtatccaaatctaagatatttaattcatatcgccaggtattggtacatttctcggaagattga

SEQ ID NO: 126 - DNA, 252 bp, B.fragilis
aatcacggtgaaaagtcaggaggaagtgaatgctattcctgtgggtattcctctctctctttggatgcttgtctgattaaagccaatgactctgatccggtgtatctgagtacgaacggtgtgaaaagtcatattaaatcggtagaagattttaataaggtcggttttgattgggataaaatcaaggtgatgtctccggcagaagtggatgcaatccctactgctccggaatatgagatcgccaattggtga

SEQ ID NO: 127 - DNA, 936 bp, B.fragilis
tataaaaacgaaattatcatggaaaagattattggattgatcaatgccccttttactccgttttatgaaaatggagaggttaattatgaaccaattgaagcgtatgctaagatgttagtaaagaacggactgcaaggagtatttattaatggatcttccggtgaaggatatatgttgaccgatgaagaacgtatgaagcttgctgaacgttgggtagaagtttcacctaaaggatttaaggtgattgtacatgtaggtagttgctgtgtaaaatcaagtcgcaagcttgccgaacacgctcaaaaaatcggtgcatggggaattggtgccatggctcctccttttcctaaagtaggtcgtgtcgaagagctggtgaagtattgtgaagaaatcgcttgcggtgctcccgatcttcctttctattattatcatattcctgcatttaatggagcattcttgtcaatggttgctttcttggaagcagtagacggtcgtattcctaactttgccggaataaaatatacttttgaaagtatgtatgaatacaatcagtgtcgtttgtataaagggggtaagtttgatatgcttcacggacaagatgaaacgatccttccatgcctagctatgggaggtgcccagggaggtattggcggaactaccaactacaatggtgtaaatctggttggtattatagaagcatggaaagcaggtgatcttgagaaagcacgtgaattacagaatttctctcaggaagttattaatgtcatttgtcatttccgcggaaatatcgtaggtggaaaacgaatcatgaagttgataggattggatttgggtaaaaatcgtactcctttccagaatatgacggacgatgaagaagtacgtatgaaggctgaactggaagctattcatttcttcgatcgttgcaataagttttaa

SEQ ID NO: 128 - DNA, 1113 bp, B.fragilis
tataagatggaagaatataaaagatgtacgcgttgtgtaatggataataagtcagatgaaactataacatttgataagcatggacgatgtaattattgcacagatgcattaaatctgattggaaaggtctactttcctaatgcggaaggcgaacagaagttgcgtcaaatgattgaaatgcttaaatatgaaggaaagggaaaacaatatgactgcttaatgggaatatccggagggttagattctgcatatttagcctatttaggttctgtgaaatggggattaagaatattggctgtccatgtggacgatggctatgatacagagttagcaacatctaatataaaaaacttatgtgaagcctgtggtattgaactgatggtagaagctcctgattcggagcaatttaatgctatgacaaaggcttttataaaagctgaggttcctaacattgcaatacctcaagataatattttgtttgcttgcctatacaattatgcacgtaaatataaggtttacaattttttatcgggtggaaattttgccttggagtgtgtgttgcaaaaaggtaatacttatgaggtttttgatatgatccataatagggatatacagaaaaaatttggttcgaaacctattgataaactgtcgttcttatcatcttatcaaaagattgtggatacgtatttatataaaataaaaagtttacgtcctttaaattatattgattataataaagaatgtgcaattcatgaattgaatgatttttgtggatttacttattatgaagcaaaacatttggaaaatatattaacaaaagtgactcagttgtactggttttatcataagttccatgtagataaaaggacatctcacttatctagtttaattgtttctggacaaatgtctagagagcaggctctagcagagttagagaagcctgtttatgataaaaataagatggaaaaagatattgagtttgttttgaagaaaatagagatgtctcgagaagagtttgaagaacttataaatagaccagggaaacaacattcagattatagaatggacaaatttctaccttttttacataaaataaaaacattttttgattaa

SEQ ID NO: 129 - DNA, 1473 bp, B.fragilis
gaaagattttggaaggtttgtaagattcattggaatttatttgctgttaatatacttaggtcttattttaataaaatatttatgacggcaatttttatagtcgttttttcagttatttatttattggtgctatataacttttatatagcgatttgtggacgaattagggtttttactattacatcttttttttgtttatgttacatatcttttgcttatatcggtagtattctattgaatattatgcattttgaggctgaagattatttgggtatgtatgcccgtcctgatatttttttccttgtttgggtatttactttgttaggtttactgttcttgttattaggctttgcgatagcaaatatcgtatttaaaaatatttgttatcccagaaaaaatagagatctacaattaattaaagtttcaattagctgttttgataattcaaataaaaatttctttgttattttatttctttttattttaagtttctttgttttgcttgtttatagaaatgcaattggaggatttccattggaatctgttttctctgctgataatggaactgcacttgcctttttgagaagtgaggctactaataatttttctgggaaattttatagatatgtaatgtttatggagacattacctttgtttttatttatagttgtttcttttataaaaagttgtaagaagaaaaaatggaaatatttatatatagctttgtttctttataatcttttttattcattatctactatacaaaaggcgcctatccttaaatttttattgttatgttgcattatcttcttttataaaaatggatttattaataagaagataatattaaaattggtcgttttttcgtgtggtttagttttggtaatgtatatgtgttttatggggttggaggatgctcctattgaagttattattgaaggggctctacatcgggtctttattggcgcaattcatcctttttattggtatataaagtatgcggaagagttcggatttttgtatggaacttctttcccaaatccagcgggaatatttccttttgaatcatttcgcttaactgtagaaattatgaattatgcgaaaggagatcttttaggggatttagtaggttcaatgcctactgtttatattggagaaatgtatataaattttggactgtatgggttggctttagctagtttaatgtttgggtttatattacaaacattagatattttatttgttaggtatcttttagtgaataagagtgttttagtttcaagtttatatatatatatgatttattatttctcacagtttacagaaacaggaataagtggaataataatagatacagatctttatatagtcttatttatttcatttatttattgtttgataaatagatataatttgagaagatatgggaaaaaaaagggtttgccatgttacaagtgtacatcctgcagatga

SEQ ID NO: 130 - DNA, 378 bp, B.fragilis
taccgcctttgtaaaacttttacgcagacggtttatgcattagcggatattatgactctgtttgaactttttttgaataaacttttatataggttttatcgatctgttttgagttccttttcgatttattccctcgtttttattcatcacataacccgctatgcagctcacaaaacgggaaaatatcttcgaaaacaaatctcaaaacagcttcgagtgaaatttaaacagacctcaaagggcaacgattttttcagcgaatggcttccaggctttgttctgcttgtatgtttcgacaaggttttggggaactcttatcttttgaattcctggcgctacggggtaatagtcggcagtaaccatcgtaggcgacattaa

SEQ ID NO: 131 - DNA, 213 bp, B.fragilis
tctatggattgtatcatgcaaaacaatatattcgactatgccgcactgcttagacaggtcaaagcaagagtggcactcgcccagaaaaaggctatctatgccgccaatggagaaatgctttctatgtattgggacatcggcaagttattgtccgaaagccaaacacaaattggctgggcaacaatacgttggagcagttgcccggtgatttaa

SEQ ID NO: 132 - DNA, 498 bp, B.fragilis
aaaaggagatgcaggaatatggcattattttataaagcagtaaaatcgactatggcaactaagtccggtgataagaaatggcacttgaacttggtgaaggtaggcaaggtggtatctactcagcaattagctgagatgattgcggaaaaatcgtcgttgactccgggtgatgtgcataatgtggttcgtaacttgatgacagcgatgcgtagtgcattgctggacagtaagacggtacgtctggacggattgggtacttttacgatgaaagcgcgtacacggggaaggggagtggacaaagaggaagaggtgaacccgaatcaggtggcagcccttctttgtcattttactcctgaatatactcgtcctgcggctatcggtactacccgggctttgtttcagggtgttgagttccagaaagcgagtgggatcggtgcttcgggcaataatggttccggaggtggtgatggagacatagtagatgatccgactgcgtag

SEQ ID NO: 133 - DNA, 1251 bp, B.fragilis
cctcttatttttatcatgaaaaactcaaaaatttatccttggatagtggttgccctcctttggggggtagccctactcaattatatggaccgacaaatgcttagcacaatgaaagatgctatgcaggtagatattgtggaacttcagtcggcaaccaattttggccgtttaatggctgttttcctttggatttatggccttatgagcccgatttccggtatgattgccgatagattgaatcgtaagtggctgattgtcggcagtctttttgtctggtcttttgtaacctatttgatgggtattgcagaaacatttaatcaggttttttggctgcgtgcattaatgggagtgagcgaagctctttatattccggccggtctttctcttattgccgattatcatactgaaaagtcacgttctttagcggttggtatccacatgactggtctttataccggacaagctattggtggatttggagctactgttgccgctgctttctcatggcataccacattccattggttcggtattgtaggcattgcctatgcattggtcttgattatattccttcgtgagaatgaagaacatgccaggggcattcgggccatgcatacagataaatcaaaaaagattccgttgtttaaaggagtgactcttttattcggtaatattgctttttggattattctgttctattttgcagctcccagtcttcccggatgggctacgaagaattggttgcctaccctgtacgctgagaatctcgatatccctatggctgaggcagggcctatatccactataacgattgctgtctcttcttttatcggagttattctgggagggttattgtcagaccgttgggtatgcaaagacatacgcggacgtatctatacaggcgcaatcgggttagggttgaccatacctgcgcttcttttattgggcttaggcaatggtttcatcagtatagtaggtgcaggatttctgtttggggtcggtttcggtatgttcgatgccaataatatgcctattttgtgccagtttgtttcggccaaatatcgggcaacggcctatggtataatgaatatgaccggagtttttgccggagcagttgtaacaagcttgtttggaaaatggacggacggtggcaatctgggattgggatttgctattctgggaggtattgtattgttggctttgggcatgcagttgtgctttcttcgtccgcacacggataatatggaatga

SEQ ID NO: 134 - DNA, 684 bp, B.fragilis
ttcaaatatcgcaggttcaacttgccagtttcaatttgtaaatatcacaaatatggtttgtttattccagagatttctgtaagtttgtatcgtactataactatcataattatgcaagatataataaacgggcgttgcggttggtgcggaagtgacgaactgtatgtgaagtaccatgatcaagagtggggaaaattggtgaccgatgacaagacgctgtttgagtttcttgtgttggagagtgctcaggccggtttgagttggataaccatccttaagaaacgtgaggggtatcgcaaagccttttgcaatttcgatgctgagtcggtggcacaaatgaccgatgaagatgttgaacggttgatgcactttgatggcattgtgaaaaatcgtctgaagatcaaatcgaccatcacaaatgcaaggtcatttctcgccgtacaaaaggagttcggtagtttttatgactatactctatcattctttcccgacagaaaaccgattgtcaatacatttcaatcattgagtgagattccggtatcatctcccgaatctgatgccatgagcaaggatatgaaaaaacggggatttaaattctttggaactacgatttgctatgctcacttgcaggcctccggatttatgaatgatcatctggtggattgcatctgccggaagaggtaa

SEQ ID NO: 135 - DNA, 222 bp, B.fragilis
cacccatgccgcactggaatgggtagggggattgtacccctaaatcaaagcttaaatgaaaaagccgtggtcattaccgacttcaccgatgaaaacggtatcgaccggatgaaggagcagatacaggagaagtacaaccgtatcaaagccgacgtgcgtcagattgtcgccgacgaattgcaacgcatccagaacgatcctgcattggcacatctcatttag

SEQ ID NO: 136 - DNA, 630 bp, B.fragilis
aatgatatacgctgcaaggcaaacaacagaattagcaaacttgaccggaaggtgtttcactaccccggtgtcccccaattatatccttttgtgaacaatagcattaataaatcctggtacgcccttcgtatcacctatagccgtgagcttgcctttaaggaatacctggactcccgcggagtgaggaattttcttcccatgcgctatgaatacgtattccgtggtgagcgtaagatccgtaaattggttcctgttgttcacaacttggtttttgtttatgccactcgcagtgaggttgacgaaatgaaatccactgtcggggcttctcttcctattcgttatatcatggaccgtgagacccgtcagcctattaccattcctgaagtccaaatgcgtagttttatcgccgttgccggtaattacgatgaacaggttgtttatctggatccttcagtcgtttccatgaaaaggggagaccgtgtccgtgtcaccggtggcatcttcgagggagttgagggtgagtttgtccgtatcaaaggtgaccgccgtgtggtggtttccatccagggggttatggcagttgccacggccttcattcatccctctttaatcgaattaataaagaattaa

SEQ ID NO: 137 - DNA, 1236 bp, B.fragilis
aaccggggacgaaacaaaaatctatacccattagggcatattttactcattttatcggatcatatccaccactctcctgatatcctcatctgtcagtgtaggtcccgaaggcagacacaagccgatatcgaacaacctctcactcgtaccattcccatagaacggagcatccgtgaacacaggctgaagatgcatcggcttccacaaaggacgtgtctctatgttctcggagtccagcttcaaacggatatcctcacgactcttacccgcaagcttcggatcaaccagaatacaagtaagccaaaagttggaagcaaaccgcgaatcagggttctccatgaccgtaatacccgccacatctttcagcaaatcaacatacaaagagtgaatggcacggcgacgggcaatatgttcatcgaggacaaacatctgcccacgaccgatacccgcacagatgttgctcatacggtaattgtaaccgatatgggtatgctggtaatgcggagcggcatcacgagcctgcgtagcgtagaactttgtctgtcgggcctcctcttccgtacgacagatcagagcacctccaccggaagtcgtgatcatcttgttgccattgaaagagagagcggccagttcaccgaatgtgccacacttccgtccgttcaattccgaacccaaagcctccgcggcatcctccaatacggggataccataacgacccgcaatatccatgatctcgtccatcttggcaggcataccgtaaaggtggacaggaataatagccttcgggagcttacccgtcttgcgcaaacggtcctttatagcctcctcgagcaataccggatccatattccaggtatccttctcactgtccacaaaaacaggtttggcctccagataggaaatcggattggcagaggcggcaaaagtaaagctttggcagatcacttcatcaccgggcttcacattcagaagaatcaagcccaagtgaagtgcagccgttccagcactcaaagccactacacgacggtcttcatgcaaatattcggccaaagattgctcaaaagcatccacgttaggtcccaaagggacaacccagttcgtatcaaaagcctcttttataaagtcttgctcacggccacccatgtgagcaagcgaaagccagattcgtttgttcataataaactatttattataatttcattttcttacgtaatagggaatcaagaggaaaagtaa

SEQ ID NO: 138 - DNA, 2316 bp, B.fragilis
aatcaattgcgccaactgctttatataatatataataaggtatgtcctatgctgaaatctgatgtgatatggccaaatagccgacgattcaagtcgcggacagaatgggagcctttgggcttcttctccgaagctttgtgtaattccacgcaatttgatctgaagctgggcttcttttcctcatcggccatcaatgtactggcagacggtttcgctacgtttctctataatggaggaaagatgcgcatgattatcaacgatattttatctaccgaggataagcgtgcgataattgtagcagactcgtgcgacgatgtggattacttcaacctgcaagatttgggtggtatgagcgacacgttgtctaagcgcaaccagcatttcttcgagtgccttgcttggctgattcgtcataaccgcattgagataaaagtggttgtaccaaaagctggagagggcatagcccattccaagtgcggcgtgttcttcgatggactgaaccgtgtggcattcgatggctcatgcaacttctcgaagacggcacttattgccaacatcgagagcatcactgctttctgcgattgggacgggcaaagcgatgtgtgtcgcattaaagatgttgtggacgatttcgaacgcactttctctggtaacgacgagagcgtgacttatcttaatacagaccatatccgcatacatattactgacacctacaaaaacaaagatatacaagaactgctggcagacgaagcacaactcatcaatgaccgattggagaatgacttgcctaaaactgtgaccgcgttcctcggtcgggccaagaataaggtgaaaagcattatcgagcgaatccatcaaaatgagatacaaaggggaaaggaagctgcacctcggtttccctactcgcaaggacctcgcgaataccagcaacttgcgtttgagaactggaaagcaaacaagcaaaaggggctgtttgcaatggcaacaggtacaggcaaaaccatcacgtcgctcaactgtttacttgaaatatataagcggtgcggctattacaaagccataatccttgtgcctacgattacgcttgttggccaatgggaagaggagtgcaagaaattcaatttcaagaacgtcatacgggtttgttctaagaactccaaatgggcggagcagatagaaacgattacattaagcgaacgattgaaagggagtgacaacaatctatcatacataatcatttccacatacgcctcgtttatcaaagacaaggtcttcaagtcgttgtctgtgttcccgaagacaaagttgctgctgattgccgacgaagcccacaatatgggctcacgccggatgttgaacatcttggatggcatcccttatttgcggcgcataggtttgtcggctactcccgaacgccagtttgaagaagaagcgaaccagacgctttatcatttctttggcgcagaaaatggctttacttacgagtattcgatgcaggaggccatagacaagggtgttttgtgccgatattattattatccgcatgtcgtgcgtctgacgatgtcggagatggaagaatacatgagaatatcggtacaattggctaaattcttcaataacaaccattttgcggatagtaatgagatactgaccgcactgctactgaaacgcaagcggattattcataaggcagagaacaaattggaggtgttccggaatatacttgaacagcgtttccaagaaaaaggtaacttgaaatatacgctggtctatgtcccggagggattgaaaccagatacggcagatgcagacgtttacgatgatacagaccagttacaagacgatgactattccgaaaagctcatcaatgaatataccgctgtagtgagtggcattgacagcaaagtcacagtacgtaagtttacatctggcattaaagaacgtgaagaattgctgaagggatttgccgacggtgatatagaggttctgacctcgatgaaatgtttggatgaaggcgttgatgttccgcggagtgaacttgccattttctgcgcaagcacaggtaatccccgacagtttatacagcgtcgaggaagaattttgcgaaaacatcccgacaagcacatggctgtgatacatgatttggtggtggcaccagaagttaatatcggtgaaggctcatatgctatggaacgtagtctaatggcaacggaattacgtcgagtcaggaatttctcgttgctttcggaaaacagcgacgacactatcaacgaattggaggatataatgaattactataacttatcattgttttaa

SEQ ID NO: 139 - DNA, 279 bp, B.fragilis
ataaaaaagcgattcttattttgtgaaatattctgtttgctcaactccagtattgtactatccattaactcaattgcaaccggagcatgtcgcaaagccacaagatttgcagcaaaagattcttccaatgtagaacaatgtacacatatcacggctttttccgtaggaggaagaggaactaattttagttttaactctgtgattaaggctaatgtaccttccgaacccgctaacaatttgcaaagattgaaagactcagaacaattcttatcaaaatag

SEQ ID NO: 140 - DNA, 597 bp, B.fragilis
aagattttttttaataaatattccatgcaagattattttgctcatgaaacagcaactgtcgatgacggttgccgaatcggtgcaggcacaaagatatggcattacagccatataatgacgggatgtgtgcttggtgaacgatgcaatatcggtcagaatgtggtaatttctccagatgtggttttaggaaataatgtcaaggtacagaataatgtatcggtttatacaggtgttacttgtgaagatgatgtttttctcggtccttcttgtgtctttaccaatgtgataaatcctcgtagtgctgtcaatcgtaaatcagaatatgctaagactcgtgttggtaaaggagctacaataggtgctaatgctactattgtatgcggacatgatattggtgaatttgcctttattggtgccggtgcagttgttactaaaactgttcctccttatgctctcttggtgggtaatcctgcccgtcagataggttggatgagtgagcatggatatcgtttagaatttgatgagagagggatagctgagtgtttggaaagtaaagaatgctatcagcttagagatggcaaagtattcaaaatgtaa

SEQ ID NO: 141 - DNA, 225 bp, B.fragilis
atccggctaagaattggaattgataagagtgaaattaaattagcaaaaacatttcctgaaaacaagactacaacgcttttcaaaaacggtgagctgtcaatctttcttttaattcggatcattactctcatatatccatcaatattgaacgataagctccctctaaaatctccttttcattttcccaacataattctttcttggcatcttgcatatttgctttaa

SEQ ID NO: 142 - DNA, 534 bp, B.fragilis
aaatcctcaagagacaaaaatcgcttcttcgtagactatcttacctggaacaccaatggacgttgggccgcagagtataaagacggtgtcttttatcattatgaaaatggtgatacgactaaatgtcatacagattccatcttgaattacatatcggatgcgggtgagaactggcagatgaagatagagggtgatcattttgtccatgctcccaatggtgactattcacgtgcgcatactgatacggtaatgcattatatcggatgggacggtcgtaaatggcgtgccgaacttttgactctgatagatggacttcatcctgatctggcttccgactgtccagaaggtatgctcctcaaagctgacaatgcggatgcggtttatttggttcaattcggtagcctccatcacattcccaatccggatgtttattttgccttatttcctgcctgggataaaatcacggtgaaaagtcaggaggaagtgaatgctattcctgtgggtattcctctctctctttggatgcttgtctga

SEQ ID NO: 143 - DNA, 183 bp, B.fragilis
atctcagcaagtcttttactacatcccataacgttagtcggattgacagccttatccgtagagaccatcacaaacttttccacaccatatttgacagctaagtcagccataatacgagtacccagcacattcacctgtatggcttcagatacattatcttccatcatgggcacatgtttatag

SEQ ID NO: 144 - DNA, 1341 bp, B.fragilis
agatggcaaagtattcaaaatgtaatatttaattttaaaaggccaagagttatgtataataaattagtaaataaagaagctaaattagctttggtaggtctgggttatgtaggacttcctatagccttggagtttgcccaaaaaatatcagttataggttttgatataaacgaggaccgtttggcgaaaatgcgtgaaggaattgatccgtgcggagaattggatagttctgcttttgaaaatgtagatatcgaatttacttcctctattgaaaagttgaaagaagcttctttcttcatagtggctgttcctacaccaattgataaatataataaaccggatttaactccattgctgggtgcttcccgttctgtagccaaagctttgaagccgggagattacatagtttatgaatctacagtttatccgggttgtacggaagaggattgccttcctgttttagaagaagttagtggcttgaaagctggtatcgattttaaatatggttattctcctgaacgtattaatcctggtgagaaagtacatacgcttcctaatactattaaaatagtttccggttgtgatccagaggctttggatacagttgctagagtttatgaattagttgtaaaaccaggagttcatcgtgctccaaatgtaaaagttgctgaagctgctaaaatcattgaaaatactcagcgtgatgtcaatattgctttgatgaacgaattatctattattttcagtcgtatcggaattaatacttacgatgtattggaagcagccggtactaaatggaatttcttgaaattttatccaggattagtcggaggacattgcattggtgttgatccttattatttggttcaaaaagccagtgaactgaagtatcattgtcagataatcagtgcaggtcggtatatcaatgatagtatgggaggatatattgccaagaagcttgtgaaacgtttgatttctttaggtaaaggtgtattaggtgctcgtgttctagtgatgggagttacttttaaagaaaatgtagcggacattcgtaattctaaggttgtagatattgtcaatgaattgaaagattttggttgcgatgtggacgttgttgatccatatgcagacagtgatgaagtacatagagagtatggatttcgtttagtagagaaaccgagggataattatgatgcagtaattgttgccgtagcacatgatgaatataaaaatttagaggagaagtattttaaaaatatgacctatgatcatgccgtacttgtagatattaaggggatgtatcgtgataggattcataaattaaagtattggagtttgtaa

SEQ ID NO: 145 - DNA, 1113 bp, B.fragilis
gaagatatgggaaaaaaaagggtttgccatgttacaagtgtacatcctgcagatgatatcagaatattacacaaggaatgtgtctcgttaagtaatgctggttacgaagtttatcttgtggctcctgaggtgtcgaatcagttaaaaaatggaattcaaattataggggtactcaataagcctgtcagtcgatttcatcgtatcttattttatattagatatgtctataagaaagcattatgggttaatgcagatatatatcatttgcatgatccggaattacttctttatgcattgttattgaaaaaaaaaggaaagatagtcattttcgattctcatgaagatattcctcgtcaaatattgtcaaaagaatggattcctttctttatccgtaaatttatatctttctcatatactaaatatgaaaagtttatattgaaacaacttgatgctattgtaactgtaaatcaagatatagcttctagattggttcaatataataagcgtacatatgttgtttccaattatcctgtatttaggaataatgtagaaagaagttccgtgatggaaaggactattggttttgcaggtaatataaagcaagagtatatgcatgagaatatccttattgcattaactaatttgggaaatgtccgttatttattggctggtaatgctgaggagggttatttaaaacaacttcaaacttttaaaggatgggattttgtcgatttctacggacggatatcaaaagaaaaagtattgcttctttatgataaagttgctattggtatggccattcatgattatactttaaatgttggagggaagaagggaggtctaggttttattaagaattttgaatatatggaagcaggaatacctttaatctgtacagattttgatatttggaaagaaatagttgaagagtattattgtggaatatgtgtaaatcctcatgatgtaaatagtataactggtgctatacaatatttaatagataatcctgttattgctcgtaaaatgggagataacggtcgtagggcagtgaaagaaaaatttaattgggaaacacaagaggagatacttttgcaattatatgatagtttatga

SEQ ID NO: 146 - DNA, 543 bp, B.fragilis
tgtgactttatgaatgatggtgagcggaaagaaactgttttatcttttttttataggaaaattcttaaaaaatcatctcctccatattattgttattattctttattgactatttgtgcgaaacctattcgcaagtggttctcagtagtggtaatacccatcattcctttttctaatttacgtgtacagtgttatcggtggtgtggttataaaatagggcgtcatacttttattggtatgcgttgttatttggatgatatgtgttatgatttgattgaaataggtgagaatgtgaccatatcttatggcgttttttttgcatgccatggtcgtaaacaggggcataatagaattattataaaagatggggcatatattggcatgaatagttctattatatctcggagagaagaaggtttgattattggaaaagaggcaatagtgggtgcatgtagtttagtaaatagatctgtaccagataataagactgtagttggtgtacctgctaaagaattaaatgctgttctacacgggaataaatga

SEQ ID NO: 147 - DNA, 1200 bp, B.fragilis
aaggagattatcatcctttggcaaaacttcctttgtcaaagcatccgtttggctggtaataaagtaacagatataattatgaaacttcaaatggttgatcttcacggtcaatatcttaatattaaaccggaagtggatgccggtattcggcaggtcattgaaacttccgcttttatcaatggtccgcaggtcaaggagtttgcggagaacctgaaggcttacatgggtagcaagtatgtgataacttgtggtaatggtacagatgcacttcaaatagctttaatggcattggatttgaaacccggtgatgaagtgattgttcctgcttttacctatgttgcttctgccgaggtgatcggattattagggctgattcctgtgatggtggatgtggattatgctaccttcaatgtaacggtttccaatctggaaaaggctttgagtcctaaaactaaagcgattattccggtgcatctgtttggccagtcttgtgatatggaacctattatgcagtttgccaaacagcatggtatttatgtgattgaagacaatgctcaggctattggagcagtatatactttctctgatggtagtaagaagcatacgggagctatcggtcacataggctgtacttcttttttcccttctaaaaatctgggatgttatggtgacggtggagctatttttacggatgacgatgaattggcagaacgtttgcgcatgattgccaatcatggacaacaagtgaagtatcatcataaagtcatcggatgtaattcgcgtttggatactcttcaggctgcgatactcaatgttaaattgaaacacttggatgaatatagccatgcccgtcatgaagcggcacaatattacactttccagttacagggggtgaaagggattattactcccgaggaacttcctttaagtactcatgtctatcatcaatatactttaaaagtactggatggcaaacgtgacgtgctaaagcagcatcttgctgatgcgggtattccgagtatgatttattatccgttgcctttgcagcaacaggaggcttttcagactatcgcacgtgcagcagaaccattagatactgctgaaaaactggcatattcagttctttctcttcccattcataccgaactatctactgaacaacaggatttagtcatcaatagtataaaagattttttttaa

SEQ ID NO: 148 - DNA, 1122 bp, B.fragilis
gtaataactatgactgaagataagaatataaataaaacgactccgcaatctgaggaacaagaaattgatctgatagagttggctcagaaagtttgggccggtcgtaaactagtattaaaggtttgtggtgttgccgtgttagtaggacttgtagtggcttttagtattcctaaagagtattctacaagtgtaacactggcaccggaaacaggtagcaagtcttctactggaggcatgggggcattagccgctatggacggtattaatcttggcagttcaaccggagaagatgcactttctcccgaattgtatcctgatattgttagttccacaccttttctattggaaatgttcgatgtgaaggttgctgatcagaaaggtaagattaatacaactttgtatgagtacttggataaatatcaacgggctccttggtggggagcggttgcttcagctcctttcaaagcattaggttgggttgtatctttgtttaaagatgcaccggaggaacagggagatgcaaagatagatcctttctatttgactgcagatcaagcaggaatagcagatgctttgagtcatcgtatatctgtttcggtagataagaaaacaggagtgactacacttactgtgacaatgcaggatccattaatttctgcagcattaacagatacggtaatgcattgtttgcaaaattatatcacagattatcgtaccaataaagcgcgtcatgatttggcttttactgagaaactatttaatgaagctcaggagaactactatgaagcgcagcagaaatatgctcgttttatggatggtaatcaaaatatcattatgcaaagttttcgtacagagcaagagcgtttgcagaatgagatgaatttagcttatggagtattcactcaagtgtcgcaacaattgcaattggcgaaagctaaagtacaggaaataactcctgtttatactgtagtacaacctgctacagtccctttgagaccggctaaacctaataaaatcatgattttaattggttttgtattcttagcgggtgtaggtagtataggatggattctctttgttaaagatttattgaacggatggaagaaacagccagaaaaataa

SEQ ID NO: 149 - DNA, 681 bp, B.fragilis
ttttgtgctattattttaagaatgatgaatatgaaaccaattatatccccttctatcctttctgcagatttcgcatatctggcaaaggacattgagatgatcaaccgtagtgaagcagactgggtacacattgatattatggacggagtatttgtgccgaacatatctttcggctttccggtactgaaatatgtagctaagttaacttcaaagccgttggatgtacatctgatgatagtcaatccggaaaagtttattcctgaagtgaaggcattgggtgcccacatcatgaatgtgcattacgaggcatgtcctcacttacaccgggtcgtgcaactgattcgtgaagcaggtatgcaaccagcggtcactatcaatccggccactccgataaccctgttgcaggatattatccgggatgtatatatggtgctggttatgagtgtgaaccccggatttggcggacaaaaatttattgaacactcggtagagaaagtgaaagagcttcgtgaactgattgagcgtaccggatctaaagcactgatcgaagttgatggaggggtaaatctggaaacaggcgcccgtctgatagctgccggggcagatgcattggtggcaggaaatgctatctttgctgctgagaatccggaaggaatgattcacgccatgaaagggctgtag

SEQ ID NO: 150 - DNA, 1047 bp, B.fragilis
atattctatatgaataagaaaagaaagaaaatatttctcagcatactggctacttttttcttcatttgtatcgccggtgcaggaacagtctattactacctattttacccccagtttcatccaagtaagacaacttatatctatatagaccgcgatgatactacagactccatcttcaataaaataaaaaagcaaggaaaccctcatagctttaatggcttcaaatggatgtcccatttccgtgaatatagtaaaaatatccataccggacgttatgccatcaaacccggagatagcacttatcaattatacagtagattatcaagaggctatcaaactcctgtcaacctgacaattggaagtgtccgaacacttgacagattagtccgcagcgtagggaaacagttaatgatagattccgctgaaattgccatggcactatacgactctatttttctggaaaaaatgggatacacagaagccaccatcccctgcttatttattcccgaaacatatcaggtatattgggatgtcagtgcagcagactttttagcccgaatgaagaaagagcatgataaattttggaacaaagaccgactctcaaaggcccaagcaatagggatgactcctgaagaaatttgcacgctggcctccatcgtagaagaagaaaccaacaacaatgcagaaaagcctatggttgcaggattgtacatcaaccgattacatgccggcatgcccctgcaagccgacccgactatcaaattcgcactacaagatttcgggttacgcagaatcaccaatcaacacttagacgtacagtctccctataacacttacctgaatgcgggactgcctccgggtcctatccggataccatcacccaaggggctggacagtgtcttgaattatgtaaagcataactatatctatatgtgcgcaaaagaagatttctccggtacgcataattttgcctccaactatgcagatcacatggttaatgcaagaaaatactggaaagcgctgaatgaaagaaagatttttaagtaa

SEQ ID NO: 151 - DNA, 891 bp, B.fragilis
attttcaatatcatgaaaaataagcgaaaaagaccatctaaaaaacaacaccacaattcgtttaagagcttttggataatagctctatttgcgattttaccattaatctacggagtctatctctgtacaccggaaattcaagctgtattctttcaggcaaccaaagtatcaagaccgaatgttgcacgtcccaattattctcacgatgaaaatctgaagattccggtttcccaattcccattaacagagcagataattcatcacaaaggttatactgtgtcttataataaggataaaaagatccccaattgggtagcttacgaactcaccaagcaaaagacacaagggaatataaaaagaaacgaacgattcatcgccgatcctgtcgtgaaaggaggtatggcaaacaattctgattattcccgttccggatttgacaaaggtcatatggcacctgctgccgacatgaaatggagtaatgaagccatgaaagaatccttttatttcagcaatgtatgtccgcaacatcccgaacttaaccgtcggaaatggaaaacactggaggacaaggtccgcgaatgggctgtagccgatagtgcaatccttattatttgcggcccggtcacgaataaaaaatctccggtaatcggcaaaagccgggtgactgttccatcaaagttctttaaggtcatcctctctcttcacggctccactcccaaagctatcggatttatttttaagaatgaacgcgcaatagcacctttacgaaattatgccgtctctattgacagcattgaacaactcaccggactggatttcttttcttcactccccgattctttagaaaatgaaatagaaagtcggatagataccaccttatggagcatctaa

SEQ ID NO: 152 - DNA, 1233 bp, B.fragilis
tttatgaatatacttcttattaatcattatgctggatatccaaatttaggaatggaatatcgtccttattatctttctaaagaatgggtaaggatggggcatcaggttagagttttggccgctaattattctcatttaaggattaagcaacctttagatagctttagtgtaatagatggtatacattatcgttggatatcagcaggaaggtatagcggaaatggtgctaagcgtgtatgttcaatgttttgttttgttcttaaattaaggttgtatttccggaactatctcgatggttttattccagatcttgtaattgcatcatctacttatccattagatatctatccagctcataaaatagcccaatattatcatgcaaaacttatttatgaggtacatgacttgtggccattatctccaattgaaataggaggatattctaaatatcatcctttcattgcactgttgcaaaaggcagaaaatgatgcatataaatttagtgataaagttatatcgttacttccaaatgcatgttcacatatggtctctcatggaatggatgcaaataaatttgtttatatccccaatgggtatgatccggaagagtggacatctcaatgtgatctttcgcctttacatatgcaatttatatccgaattgaaaaataaggggaaaaaggttattggttatgcaggtggccatgcgaaatcgaatgcattggattatttgttggaggcaatgaaaattgtctttgataaaaaccagaatatagtatgtcttttggttggtaatgggcaagaaaagggacgtttagtagaacgtgttcaaaaggaaggcattaagaatatttattttctggatccagtacctaaaaaaaaaatacctgaattattaaatcagatggatgtattatatattggttgggagaaaaacccattatatcgttttggtatatctcctaataagttaattgattatatgatgtctcagaaaccgatattgcattcggtttgtgccgcaaatgattgggtaaaggaagccgattgtggaattacggtgaatgcggagtcgccacaagaaatagcggcaggtattatagaaatattttcgttttcagatgtagagttaatcaataaagggggtagggggagaaaatttgcagaagagaatttaagttatcctttccttgcaaagaagttcatcgaagaatgcataaacaatagagtgtaa

SEQ ID NO: 153 - DNA, 1002 bp, B.fragilis
aattactacatttgcaaccaaactaaaaaaactttgatcatgccgaacttctttaaatctttttttgcggggaaaacagaaaaccctgaggaagaaaaacaaaaaaacgccaaaaagaactttgagatatttaaatatgacggcctgcgtgcccaacgtatgggacgtccggactatgccattaagtgctttaacgaagcgctggccattgaagaagatttcgaaacactgaattatctgagccagctttacatccagaccggtgaattcgggaaagcacatgagttgctggaacgtatgatcgcactggaaccagaattgacaagcacgtacctgaccctggccaatctctgcttcatgcaagaagattatcaggagatggccgatgccgcccagaaagccatcgcactggaagaaggaaacgcaatggcacactacctgttgggcaaagccaatcatggattggataacggaataatgaccatcgcccacctgacaaaagccattgtgctgaaagatgatttcacggaagcccgactgctccgtgccgaagcactgtataagatgcagcaatttgcagaggctatggaagatattgaagccatacttacacagaatccggacgaagaagctgccctcctgctacgtggcaaaataaaagaagccaccggaaaggaagaagaagcagagacggactatctccatgtgacagagataaaccctttcaacgaacaagcttacctatatctgggacaactatttatcacacagaagaaattgacagctgctattgagttgtttgacgaagctatcgagttgaatccaaactttggagccgcctatcatgaacggggacgtgccaaactattaaacggggacaaagacggttcgattgaagatatgaagaaatcgctggagctgaacccgaaagagggagagaacctgaacggacagttcaataatcagcaagcagaaacaaccccaaacgtattgggactgtaa

SEQ ID NO: 154 - DNA, 810 bp, B.fragilis
tacatatacattatagttatgatattctatttttcaggaactggaaattctaaatggattgcggagcagatcgctaaggcacaaaacgaagtgcttgtttttatgccgaatgccatcagagacggaatagaagagtttgtgttggcggatgatgaaaaagtaggttttgttttccctgtttattcatggggacctccgttgagcgtattgcggttcttggattggattactttatctaattatcattctcaatacgtcttttttgtctgttcctgcggagatgatacagggctgacggaagaactctttcgccgggcattgtctcgtaaaggaatggagtgtaatgccggtttttcagtggctatgcctaataattatgttttgcttcccggatttgatgtggataagaaggaactggagaaaaagaagttggatgaagcagttggcagggtagaagagattaatgattcgataaccggaaagaaaataggttttcattgtaatgagggaagttttccatggtttaaaaccaaagtactcaatccgctctttaatcgttttatgacctcggcaaaaccattttacgccactgatgattgtatcgggtgtaaacgttgtgaaaggatatgtccggttgggaacgtggtgatgatagggtggaggcctgtgtggggaatggattgtacatcctgcctggcttgctatcatgtttgtccgaagcatgctgtgcagtacggaagaaggactaaacgtaaaggacagtatttaaatcccaatgtgagtatttcacatgaggcggccgcccaatag

SEQ ID NO: 155 - DNA, 2175 bp, B.fragilis
tatatgataatcaagagcgtaacaataaataatttccgcagttactacagggagaatacctttgagttttcaaagggactgactctgattattggtggcaatggtgatggtaagaccacattctttgaggcgttggagtggttgcttgacacagctcatgagacgaaagacccttcgctcatatcggaaatgcgcaagtcggaattggacgaagatgaagccgacaccatgtctgtttcaatgttttttgagcataatggagaaaaagaggtgtcgaagagtctgaccttcgaaaagagaaacggagtatgtcaagtgacaaattttgctttcaaaggttacgagactaatggcgctgagcgtatgcaacgaaagggcagctcgctaattgacgtgtgctttgatgcgttcattcgtaagtattgcctgttcaaaggtgagagccaattgaatgtttttaatgagaaagaggcgttgagaacgcttgtagataaattctccgacatccgcaagtttgaagattatgtcgctgttgctactgaacttgaagcaaaatccgatcgagcatacgcaaaggagtgccagtcggataagaagatttcgcagagggtttcggaactccaatgtaagaaagagcatcttggacaacagatagacgagataaaatgcgacatcaggaaacaggaagatgtggtgagcacctattctgtgaaacttgaagatttggagaagcaccaggtcaccagcgaaagttatcaggacatcaagaagcgcatagacacgcaacgcgagaagctggctaaactccgttccatgacgatggtgcgctacaatacgaacctactcgatgagttctgggcattgatgccataccagaatgtgtttgaggaatttcagaaaaaggtatcggcgttgagcaaagagaagcgacgtctcagcgaccttgacatacaggaaaaagcggcggcaaaggctaagaaggaagtcgttgatgaactgacatcaagtctgcaaagcgacttcacacgtttgccttggtatctgcccgatggggaaacgatgcaagagatgcttgacgaagaagtatgcaaggtatgcggccgaccagcaaagaagggcacgccggagtatcgtttcatggagaacaagctgagggaatacttggaacataagtcgcaggaacttgcggccaagcaagaagaattaccagacactccgctttttggtactcaatatatcgaggagcttcattcgctttctatcagttttggaggcatgacggcgagagatatttctaagaaatatcgcgaggttgtggataaactggaacttgtggcaagaatcaaacgggacattgcagagaaagaggctgagttgctagaactggaagacgagaaatcccgtttgctcatccaagccgacggacttacggaagcgatgcttgataagaatttccgcgacatcaagggtttctatgagcagcgagaccgagcaaaaaaccgcattagcgattaccgcgagcggttggtcaaggtccagatggaatacgacaaggtgaaggaagaatttgagcaactgaatccgacaaccggcatggcgaaagtgtataaccgtgtgcatacgttgctcgacaaagtgatgcgggctttcgttaatgcaaagagcgaaaacctgcgccgcttcctcgcaagccttgaggagcgcaccaatagttatttcgagaaactgaacaagaatgacttccgtggcgtaatccgcattgtacagacagcgagcgattcggcagagataaagctatttagttctaacggcacgccaatcaaaaatccgggcggtgcgcaggagacaaccatgtatatgtcactactctttgctatctccgatctcactacgctgaagcgcgaagaggattatccgctcatattcgatgcgccaacttcatcgtttgagaacttcaaagagaacgtcttctacaacatcatcgacaaaatccagaaacagtgcattatcgtgacgaaagacttgcttgaagtggacaaactgacgggcaagaagactctgaacgaagcgcaaatagaagctttgacctgttctgtatatcgcatcgagaaacagacgggctataacgagaccgacctttcaacaatacgaaccatcataactccaataaaataa

SEQ ID NO: 156 - DNA, 471 bp, B.fragilis
ttttgcccaataataacaaaggttaagagaaaacaaatggaagaaatcgaatttcatcacagtttacctatacaactacgattcaacgacgtagacaaattcggacacgtcaacaacaccgtctatttttcattttacgatctcggcaaaacagaatatttcgcttctgtatgcccgggagtcgactgggaaaaagacggcattgtagtcgtacacattgaagccgactttctggcacagattttttcatcggaccacatcgccgtacaaaccgcagtttgcgaaatcggaaccaaaagctttcatctgctgcaacgggtcatcgacaccgaaacaatggaagtgaaatgcatctgtcgttcggtcatggtgacattcgatctggagagacacgaatccaagccactgaccgaagaatggatagaggcaatctgtcggttcgaagggagagacttaagaaagaaaaaataa

SEQ ID NO: 157 - DNA, 216 bp, B.fragilis
cgaaaaccaattaacaatcaaatagttattaatttctatttttggttgttggtagagaaagcgagcattatggggcatgttttgctgcgacttccgttacttatccgttaccttgcaagtacggatatttcaaggagtataaacgattatttttcaatgctttgcgtcacttttcataacttcaaaaagctcaatatttatttagtttgtaactaa

SEQ ID NO: 158 - DNA, 525 bp, B.fragilis
agggttgggatgtgctttggttacagtctcaacggattgtgtagcttcaaaagaggaataatgaaactgattaccgaagggcttcttgataaagtgactgatcaggcaaaagagaattcacgcctgcggatgaattacaatttccatgactccatggatgctcctattcacaggatgttgaatgctttggagccgggaacttacttgccgccacatcgtcataagaatccggataaggaagaagtttatcttgtattgagaggtagcttgttggctatcctgtttgatgatgagggtaatgtaacggaaaaggttcatttgaatccagctgagggacattatggaattgagattcctccctgtgtatggcatactatcgttgtcttagaatctggaaccgttatttatgaaataaagcaagggccttttgctcctcttattcctgaaaatttagcatcttgggcacctcctgcaactgatgaggaggcggcccgagtatttatgcagcgaatgcttgagctttaa

SEQ ID NO: 159 - DNA, 975 bp, B.fragilis
agccgtcttgtgaactttcagtatttacaccgatatccttttatacgcctgctattccctctgatagcaggctttcttgttggcaatgggttgttttttaggggagtctgtgtttcgaagggcgtgctggcaggagggctggcaggattatttcttctgctcctagtcgtttatttttctcaccgttactctttacgttggatgttcggctgtattttgtacctgttcgtgttttttggcggagcaggtggaataaatcaggctttgcaacagacgctttattctttttcggaacaaaaatgtgtttaccgggctgtagtgttggaacaaccggagccgaaggaacatagcttcctttgtcgggcatttttggaggaaaggcaggattcagtgtgcaccatgccggtaaatcgaaaagttttgctttatatatcgaaggattcattgtccgaagggttacgtagtggggatgagttaatattttttgcccatgtatctccaccttcaaataatggtaatcccgatgaatttgattatgcgcgttatctgcgctacaaagggattagcgggattgcttttgttgcaagtgggaattggaaaattaccggatatcggttttcccgatcatgcaggcagattgcattggaataccgggatcggattcttgaccaatatcgtgctttgaagtttaatccggatgaatttgccgtacttgccgcacttacggtaggttataaggaggagttgagcgaagatattcgggaaacttactctgtatcgggagccagtcatgtactggcactttccggacttcatatcgggtttctgtatatgatgcttctgttttttctgaagtggctgccagggaatgcttttggtgtgagactttttcgtgcggtagtgataatcaccgcattgtggggattcgctttttttaccggtctctctccttcggtcgtccgttccgttgtcttc

SEQ ID NO: 160 - DNA, 252 bp, B.fragilis
cttatcattgttttaacgatggcacattacaacaataacagcaacagaatcttgcaggctgttttggccgatgagaaactgatagagtttggcgagtacaatcccgctgactatcaaagcttggacgaggctcttgtgtctgataaccttgtggtgaatactgtggcaaggattatcaacgaggtaaatgaggagagcagctcacgggaaatatataatatggtaacaacctatctaaagaataatatatga

SEQ ID NO: 161 - DNA, 615 bp, B.fragilis
aaaatgaatgtaaatattactgcggtgctattgaaatctctttttgaccatatcgttgcttttctcggtctcctttttctttctccaattttattagtaacagctattcttattcgtgttaagatgcctggaggtcctgttatattcaaacagaaaagagttgggcggtatggtagattatttaccatgtataaatttcgttctatgacggttgggcattccggtggttctgtttctgtaaaaggagaaagccggatcacgccattgggggccaaattgagaaaatataagattgatgaacttccggaactgtggaatgtgctgataggagatatgagtttggtcggtcctcgtcctgatgttccgggatatgctgacaatttgctgggagacgataggagaatgttgcttttaaaaccaggtattactggacctgccagtttgaaatatcgtaatgaagaagaattgctggcagggcaggataatcctcaaaaatataatgatgaggttttgttccctgataaagtgcgaataaatatagagtatttggataactggtcattttggaatgatattaaaatcatcgtttataccgtttttgggaaagatatgtag

SEQ ID NO: 162 - DNA, 927 bp, B.fragilis
gaaccaatcgttgaaagatggcaaggtgcccattatgggacgtataacgatcaacaagaccaccgcctgcttcagttgcaagcggaagtttcactggcattatgggatgccaaggccaagagggcgaaagggaaatccgacgaggccagacggctgaatcaggagcttgacaatgtcaaggcccagatcacaaggcattaccagtatgtctgcgaccatgacagcctggtgacagctaaaagtgtctacaaccgctatcttggtttcggggacgattatcacacccttatgggactgttcagggagcagcttgcctcctacaaggaaaagataggcaaggaaaaggcggcaagcacctatcgcgggctggtggccgactacaagaatctgcagcttttcctcaaagagaagaggcgcatcgaggatatagccatcgccgagcttgacaagaagttcatcgaggactattacaactggatgctcgggacatgcgccctggcgagttcaacggctttcggccggggcaacaccctgaaatggctgatgtataccgcccaggaaagaggctggataaggcttcatccgttcatcggtttcgactgcctgtccgaatacaagtggcgttctttcctcaccgaggaggacttgcaaagcgtcatccatgtcaagttgaattacaagcgccagcgggctatccgtgacatgttcctgttcatgtgctttacaggtctggcgtacgcggatctgaaggagatcacgtacaagaatatccatacggattccgagggtggtacatggctgataggcaaccgtataaaaaccgacgtggcctatgtggtgaagctgcttcctatcaccatcgaactggtcgagaggtacagggggacaatgaaaagaaaagttcgcctgacaaggtgttttccgtag

SEQ ID NO: 163 - DNA, 249 bp, B.fragilis
aatattttattaataaaaagagattccaaagatctacttaataaaattcattcactattattattaattaaaaacaatagagaaacatcttttcaccttataaaccctaaattaataaacaaattaactatctttgtagatattaccaaaattattaatctatatgaaacaacatcttttaaaagaaatagaactaggtaccaaaagcgctcttctcaaaaagaaaattattacacattatatatataa

SEQ ID NO: 164 - DNA, 573 bp, B.fragilis
atcatgcaattattaaaaaaaagaatcctacaggacggaaaatgttatgaggggggaattctcaaagtagacagtttcatcaaccaccagatggacccagtgctaatgaagtcaattggcgtagaattcgtacgtctctttgcagggacaaacgtcaataagatcatgaccattgaagccagcggaatagctccggccataatgacgggatatttaatggacttgccggtcgtttttgccaaaaaaaaatcgcccagaacaattcagaatgcgctaagtaccacagtacactctttcaccaaagaccgtgattatgaagtagtcatcagttccgacttcctcactccgaaagataacgtattattcgtcgatgattttttagcttatggaaacgccgctttaggtgtcattgatttgatcaaacagtccggtgcaaatctggttggaatgggattcatcattgaaaaagcatttcaaaatgggcgtaaaacacttgaagaaagaggagtaagagtagagtctcttgccatcatcgaagatttatccaattgccggattacaataaaagattaa

SEQ ID NO: 165 - DNA, 204 bp, B.fragilis
gacattttttccaacagtctttccacacaggcagttttccaaggcgaggatgaagctggatttgccagtgccgtacgagccgatgaggcaaaacgaatgaatgccactggcaaagtgattgataattttgccgatggtctggcgagcattggcagtgacgatatagtggggtatcttgccaaagtcacgctctatgttgattga

SEQ ID NO: 166 - DNA, 372 bp, B.fragilis
tattttgcatcgttttatttttttagggataagatatattttattttctttcttagaacttatgaaggaatacccaagagggcgattgaaccggaattcagttcatttcggaatagttataaatcggaggagcataataagtttcaagaactggttaagaaatatggtttctatcctgagttgtgcgatacctgtagaaaagggaatctactgaagataaaatcaaaaaggcggttttataagtcactctgtgggggcatgacccgcgatttgcttataaaaccgtttttcgtttataaaggcttaagtttcaactcgatttgtgtaactgaacccgggcgtacggtacgtcctgcagaccatatttcataa

SEQ ID NO: 167 - DNA, 1008 bp, B.fragilis
ataaataaatcaatcatggtaaaaataatcttaggtgttctgtcactgcttgtcatgttgtcgtgcagcactgccgtgaaagagaacactacacaacccgatataatggagacaaacaagaaaaatctcggaaatctgttggcactctatcccaaaccaatgacggttgtcggggcggaggtcgaagggaaagtaaactggcttgtggtaggacacacgggagtcatcggccatgaccggatactggtcagcatgagtaaaagtcattataccaatcaaggtgttaaaaaatcaaaacgactttccgtcaatcttgtgagtcgtgagatgttaccgaaagctgactatgtaggaagtgtaagtggtgcgacggtcgataagtcggaggtgtttgcttaccatatcggagagaacgatacgcccgttatagacgcatcaccactcacgatggagtgtgaagtggtggacatttatgaaaccgacggtttcgacaatttcatttgcgcgatagtcaatacatacgctgcttccgatgtgcttgacagcgatggcaaactcgactatacgaaactaaaacccgtattattcgagttcccgacctactcctaccttgcgacaggagagatcatcggcaaatgtctgaatccggataagccgggtatgtgcgttaaagagccgatgacgaccgatggtatcgtacggctgtcgaaaatagaggtttatccgcagtatcttgacgagtatatgaactatgcaaccgaggtaggtgaaatctccctgcgtaccgaaccgggcgtactgacgatgtatgctgtcggcgaaaaggagaatccctgtaaagtaacgattctcgaaacctatgcgagccgtgaagcatacgagcagcatatcgcttcggaacactttcagaagtacaagcagggaacgttgcatatggtcaaatcgttggtattgtccgaccagacaccgctcaatccggccaacaaactcaataacttcatgcaatag

SEQ ID NO: 168 - DNA, 1248 bp, B.fragilis
aagaaagaatcaatgaataaggaaatagacataaaagacatggcacccgtgaaggcctcggaacgccatgtcatcctcgatgctctaagaggatttgcattgctggtaatctgctttgccaactttccggaattctcgctttacacttttcaaaaaccggaaattacggaggctatgcctacggcggaaatagataaggtaattcgctttcctcaataccttttcgtggatggtaagttctacaccatattctcgctgctgttcggtatcggattttcaatcattatcagcaacgcggccaaaaagggaacggacggattccgtatcttttaccggcggatgattgttctggccgccattggttttctgcatctgatgtttatctggagtggggacatcttgttgttgtatgccttattgggcatgttgctccctcttttccggcatgtttcggacagagtgttgctggggacttccgctgtcttattgctacttcctattctgattgattggttggccggtacattcggagtgtcccggtcgtctcccgcagtgcgaatgcaacagcactattgcaatttatatggtataacggaatataacttcggaatctggctacgcgacgcggaaaactacggaggggtctttcaattcctggtacaaggtgcatgggtgcgcttgcaggaatttatcgacggcaatcgctattttaaggtattgggattgttcttattgggcttctacatcggacgaaagcaaatatacgccgatcttgaggccaatcgggtactactgaaaaaaacggtgacatacggttttctgctgggacttcccctatccgttctctatgcctggagtgcggtaaacgggcatcctttcggaacggctgcacacaccgccatctatacggcaagtgtctatcctttaggttttgcatacgtttccgctatctgtcttctgtacctgcatggtagagagtggcgcttgtggcgctgtcttgccgctccggggagaatggcactgactaattacgtgggacagtcggtatggggcatggttctcttctacggtatcggcttcggactgggggccggcattggattgacaggaacagaatccatagctttctacgtctttcttgtccagatggcattcagtgccttatggctctcctatttccgctttgggcctctggaatggggctggcggatgctgacttatgggaagtggttaaaaataaggaaataa

SEQ ID NO: 169 - DNA, 228 bp, B.fragilis
gccgtttgtccgttgttggaagttctgccccacaacctgtcagtatggttcctgtcaggaaacacttttgtaggatatgccgaccagcatcctttggtcagcgtgatagattacgataccgtcacgcccatcttgcatacgcacagccaattttcagtctatgcactttataaagggatgggcgttactcttctctccggacttgttgcatggaactccgttgggtaa

SEQ ID NO: 170 - DNA, 237 bp, B.fragilis
attacgataccgtcacgcccatcttgcatacgcacagccaattttcagtctatgcactttataaagggatgggcgttactcttctctccggacttgttgcatggaactccgttgggtaatcacatcaaagacttctctttcttttcttatcagtccaatgaagccggagagcacatccgttgtcatatcatcgatatggccaaaagtaaacttatcaacggagaacaaatcatgtag

SEQ ID NO: 171 - DNA, 627 bp, B.fragilis
attttaaaaccaacaagaaatatggaaataaccaatgctgaatttgtaattagtaatacggacgtgaaaaaatgtccggcaggcactttccccgaatatgcctttatcggccgatccaatgtaggaaaatccagcctcatcaatatgctgaccggacgaaaggggctggccatgacttccgctactcccggtaagaccatgcttatcaatcattttctgatcaacaacagctggtacctggttgacttacccggatacggatatgccagacgaggtcagaaaggacaggaacagatacgcaccatcatcgaagattacatcctcgaacgcgaacagatgaccaatctattcgtattgatagacagccgtctggaaccccagaaaatagatcttgaattcatggaatggctgggtgagaacggcattccttttgccattatcttcaccaaagcagacaaactgaaagggggacgactcaaaataaatatcagcgcttacttgagagaattacggaaacaatgggaagaactccctccctatttcatcacttcatcagaagagcgccttggcaggacagaggtattaaactacatcaagtcaatcaataaagaacttaattcaaaataa

SEQ ID NO: 172 - DNA, 528 bp, B.fragilis
aaaaataaaacgatgcaaaatatcattattacatttattgccttttttgtactcagattactttccttatcctactccattcgtaacgagaaacgtcttctgaaaagtggagcggtacaatatggtaaagttaattcgctattactgacattagcacatatcgtctactatttttcggccctctatgaagcatacacttcgggaactaccttcaactacttctctgtttgtggtgtttttataatgggctttgcttatgctatgctattctatgtgatctataaactccatgatgtatggacagtaaaactttatatcattcccgatcatcgcattgaaaaaagcttccttttcagaacagtaagacaccccaattactatctgaatatcatacctgaactaattggaattgctttactctgcaatgcctggtatacattactcattggactccctatctacgcttgtttgctcgctatacgtatccgacaagaggaaagggccatgaaagaactattggagaattaa

SEQ ID NO: 173 - DNA, 1488 bp, B.fragilis
aactctgggacgagaaaacttgtttcacagactaatgcccttgtacataacctgatgggaacaggaaagggaaagacagattacctgctatcgcttatccgcgaagggaagcagatgacactggggcagcagttgcgcctgactgcatacctcagtgtccctgccattatggcacagatatcttccatcgccatgcagtatattgatgcctcgatggtgggcagcctgggcgcgaatgccgctgcttccatcggattggtctcgaccacgacatggctgttttgggagctgtgtgcagccgccgcaacgggcttctccgttcaagtagcgcataaaatcggagccggggatttcgtgggagcacgaaagatactccgccagtcgattgctgccacattggttttcagctcattgttggcggctgtcggcatttccatcagtggtatgcttcccggctggttgggcggtgatgaagtaatacggagcgattcatccctctacttttggatattcgcacttttccttcctgccttgcagttgaatttccttgcgggtggcatgttgcgatgcagtggaaatatgcgtgtgcccagtatgctgaacgtgctgatgtgtcttctggatatcgtgttcaacttcttcctgattttcccttcgaggcaggtggaatggttcggagtgacatttaccactcccggcgcaggcttgggcgtggaaggcgcaatattgggaacggtgctggccgagctcatcactgccggcgggatgatgtggtatctttgccgtcgctcgcccatgctgagactgtccggagaacggggaagtttcctgcctcggaaagagacactgagtaaggctttccgcatctccctgccgatgggattcgagcacatggccatttgtggggcgcagatcgcaacgacggtgattgtcgcaccacttggtatcattgccattgccgccaactcgttcgccatcactgccgaaagtctctgctatatgcccggctacggtatctcggaggctgccacgacgttggtcggccagagcctcggagcaaaccgtatccggttgctccgtcgttttgccaatattaccgtctggtcgggaatgctgattatgggtgtcatgggaacgctgatgtatatggcggctccgcaaatcataggagtgatgaccccggtagaggaaattcgcacgttgggaatcgagattctgcggatagaagcctttgcagagccgatgttcgcggcgtctatcgtagcctacggtatattcgtgggtgtgggtaatacattcgtacccagtctgatgaacttcggcagcatttggggcgtacggctgacactggcggcatggctcgcccccacgatgggactacgcggcgtgtggtttgccatgtgcatcgagctttgtttccggggggtaatcttcctcgcgagactttggggcagtaactggatttataaattacgaataaatagataa

SEQ ID NO: 174 - DNA, 1083 bp, B.fragilis
aataatacggctatgaagttacaagcaatcgccatactgacattcctgacttttgcgaatgtcatggcacaagaaacgacaacaacaaaatatataaattcaaccgatatggaagcattgaaattgacgcaggaatgggataagacctttccgcagagcgataaggtggaacatacgaaaatcacgtttcacaaccgttacggtattacgcttgccgcagacctttacaagccgaaaaatacacaaggacgtctggcagccattgccgtcagtggcccttacggtgcggtgaaagaacaagtgtcaggccgttatgcccagacacttgccgaacgaggctttctgaccattgctttcgatccctcctattacggcgaaagtggtggtacacctcgctatcttacgtcacccgaaatcagcacggaggatttcagcgcggcagtcgattatctgacatcccgtgcggacgtcgatccggaacgtatcggaatcttaggcatctgcggttggggcgggtttgcacttaatgctgcggccaatgaccctcgtatcaaagcgacggtaacatccactatgtatgatatgagccgggtaaatgccaacgggtatttcgacgccatgagctccgatgaccgttacaaattgcgcgaacaactcaacgcacagcgtactgaggattatcgtgatgacagctatgtacgcgatggtggcgtacttgaccccgtaacggacgatactccgcaattcgtcaaggagtatcacgactactacaagacggaacgaggctaccatcgccgttcaccgaactccaacgagggaatcacgaaaacaagcgtattggcattcatcaatatgccgctgctcacctatatcagcgaaatccgcagtgccgtgttgatgattcatggagaaaaagctcattcccgctatttcagtgaggatgcctacaaacggctgacgggtagtaacaaggaactgttgattatacccggagccaaccatgtcgatttgtacgataatctcaacgtgattccgttcgacaagatagatgctttctttaagaatgccttaaaggagaaatag

SEQ ID NO: 175 - DNA, 642 bp, B.fragilis
ttaaatagatatacttgtttgtacatgaatcaacaatatccatcgacgttacttgaaaaggccgtcggagagttttctaaattgccgggtatcggacggaaaacagctatgagactggtgcttcacctgttgcgtcaggatacctctgtggtggaagctttcggaagttctattataactttaaagcatgaggtgaaatattgcaaggtgtgtcataatatatctgatacggaaacttgtcagatttgtgcaaatccgcagcgggacgcgtctatggtctgcgtagtggagaatatacgggatgtgatggccgtagaggccactcaacaatatcgtgggttgtaccatgttttggggggagtgatttcaccgatggatggggtaggaccgggcgatctgcagatagaaagtctggtgcgccgggtagccgaagggggaataaatgaagtgattcttgctctaagcacaaccatggaaggggataccacgaatttttatatttaccgtaaacttgagaaaatgggtgtcaaattgagcgtacttgcccgtggggtatccattggtgacgagctggaatacacagacgagataacgttgggtagaagtattgtgaaccgtacgacttttaccggtaccgtttaa

SEQ ID NO: 176 - DNA, 1167 bp, B.fragilis
gttatgagatacgatttcgatacgattgtcccgcgtcgcgggacgaactcctacaaatgggacactcccgaagagaaaaatgtgctacctatgtgggtagcggatatggatttccgtacggcacctgccattgtagaagccttgcaaaggcgggttgcacacggtattttcggttataccaaagtacccgaaacctattacgatgcggtcgtccggtggttcgagagccgtcatcgctggcagatagatccccggtggattatctatacaagcggtgtcgtaccggctctgtcggccattatcaaagccctgaccgcaccgggcgataaagtaattgtccaaactccggcatacaactgcttctattcgtcgattcgcaacgacggatgcgagctatcggccaataatctaatttatcgggacggtcgctatatgatagacttcgacgacctcgcagcgaaagcggctgatccgaaggcgaaaatcctgttactatgtaatcctcacaatccggtcgggcgggtctggacaccggaagaactgcggcatatcggcgacatctgtttgcgcaacggagtgtttgttgtggcagatgaaattcattgcgaactgacctacgagggacacgactatacgccttttgcctccctctccgaacgcttccaacaaaattccgtgacttgcatttcgccaagcaaggcgttcaaccttgccggactgcaaatcgccaatatcatcgccttggacgaagaggtgcgtcgccgcatcgaccgtgctattaacatcaacgaggtgtgcgacgtcaatccattcggcgtgatcgctacaattgccgcttataatgagggtggcgagtggctcgatgctttgcgaaaatacctgcgagggaattatgaatatctatgccattttttcgccgaaaggctgcctcaatatcccgtattgccgctcgaaggaacttatttggtctggatagactgccgagcactcggtatcggttcggacgccacgaccctgcatctgcaagagcagcagaagctgatggtcaactccggtacgatgtacggacccagtggagagggattcatccgtctgaacattgcctgtccccgcacattacttgccgatggtctggagcggatggcccgtgtattggaatgctgttaa

SEQ ID NO: 177 - DNA, 615 bp, B.fragilis
aaacaaggatatcaaatgaaaagaaaactattatcatttgcagttcttatcacactactgcttgtaccgaccgtaaaccgtgcacaatctatcaaggacttattcaataaagacaatatctccaaagttgtcaacgctgtcacaggacataccgaaacagtggatatgaccgggacctggcgttataccggctcagccattgagttcgagtctgaaaacctgctgaagaaagccggaggaaccgtcgctgcttccgctgccgaacaaaagctggacgaacagctggccaaagtcggcattaaagaggggcaactgagttttacattcaatgcggacagtactttcgtaagcactttaggcaaacgcaagctgaacggaacatactcttacgatgccggcacccagatgctccacctgaggtatatgaaattaatccccatgaatgcaaaagtcaattataccactcagcagatggatcttctgttcgaagcagacaaattgctgaagctaatcactttcttatccagtaagagcagcagtgccaccctcaaagccatcagttcattggcagatagctatgacggcatgatgctgggatatgaattgaaacgatga

SEQ ID NO: 178 - DNA, 330 bp, B.fragilis
aaacaatatcaaaaatttgtcacaattcttgtactattagccggcattgtccctgtctatgccatcatgaacatcgtattcgatcctaatgacgatggaaatctgttaataacactcggcactctgacacctatactgggtgaccttttgatggtatatgccttcaaagacaaatatcaaattttaattagcaatcatcgtttgcaaaataagtgttacctttgcgctcgttatgatgatacttgccactattgtatgctactttgccattctcttgctgatagcccgtatcaccggacggaaaggaggttcgaatgcagcgttttttaa

SEQ ID NO: 179 - DNA, 540 bp, B.fragilis
atgatgaagcaatctttcttagccaacgagcgaatatatctccgtgcagtggaaccggaggatttggatcttatgtacgaaatggaaaatgatccttctatgtgggatatcagtagtttcacagttccctattcgcgttttgtactcaaacagtatattgaaggatcgcaaagtgacatgtttgccgataaacagttgcggctgatgattatgcgtcggaaagataattgtactttgggtacggtcgatataactgattttgtacctttacattcaagaggggcagtcggaattgccgttcacagcaattatagacaggaggggtatgcttccgatgcattgaaactgctttgtgaatatgctttcaactttttatttataaaacaattgtatgcccatatagctgtggataatgaacccagtttgcgattgttcaattcttgtggatttacccaatgtggagtattgaaagaatggctgttaacacacgaaggttataaagatgccgtgcttgtgcaatgtatgaatcccaaacgatga

SEQ ID NO: 180 - DNA, 450 bp, B.fragilis
atggaagagcaaataaaacgcattgtgaaaagccagaaggtacagtatatttctttttggattattccgttattgttggtgctattgggagaagccggcgtgttgcctgtaggaataaaagcagacaatgtacgggctgtttatgttttcgaaacagtaggtattttgatgactgccgtctgtatacctctttctcttaaactatttagttttgttctgacaaagaaaatagatcagctgacgtttccggtggccctgagccgttatatgctttggggggctgttcggctggctttactggaatttgtagtggtgtttaatctggccggttactactttacacttagtagtacaggtgcgttatgtgcacttataggactgacagcctcttttttctgtcttccgggagaaaaaagattgcgtgccgaactgcatattgataaagaataa

SEQ ID NO: 181 - DNA, 213 bp, B.fragilis
cacagagttaaagcttgttctttggatgtgaataagaagttctttaaatgcaaaagacttgttatttgcgcacaagaacctgacaacctgcaaaaggcgttaacaatgttaattgaaaaaaggtacaaggatgaagataccggttcagacggcgtaaactcacttccgaaacttaagttatcttattcagcctgtgtctattttttcttataa

SEQ ID NO: 182 - DNA, 693 bp, B.fragilis
ataaaaaccaagaatatgagaccatatataatcagtcacatgatgacttcggtcgatggccgcatcgactgcccgatggtcgggcaactgagtacggatgagtattacatagccttggaaaagctggggccttgctcgaaactgtcaggacggataactaccgcactcgaatgttctgccgtcaaagaggaaagtactccgatggagggaactccgataggtcataaatccgtatatgtcgccagtaaatcggacgaatatacgatcattgtcgatacctatgggaaactgcgttggcaggagggtgaagctgacggtcatcctctactttgtattgtcagtgaacaggtgtccgaggaatatctggaaacgctgcgcacattgggtatttcatggattgcggccggtgcggaacgcattgacttgccgcaagctatggagctgcttcacgaacatttcggcgttgaacgcttggcgattgtcgggggcggacatatctgcggcggtttcctggaggccggactgattgacgaagtgagtattatggtagctccgggtattgacgggcgtaagggacagacggcggttttcgatggaatctcccgtatggaatgtaacccgtacaaactgaaattagagagtgtggaacaatgggaaacaggtattgtctggctccgctataaagtaaaataa

SEQ ID NO: 183 - DNA, 1221 bp, B.fragilis
aatataacaaaaatgaaaatatatatatttattatactggctgcggccacttcaatctccctgatatcttgcgattcgaaacagagtgacacccgctcggcctcttcctcagaggttcaccggaatgacgacggtcatgatcatcgggaaagtgatggagacaaccatagtgaaatagagaactccggcaagggacatgaggacgaaatcattttcactcggcaacaggcggaagctatcgggttggagatatataatgtggtacccggatcttttgcacaggtaatcagaaccagcggacagatacaggcagcccaaggagatgaagaaactattgtcgccacgaccaatggtgtcgtatcttttcccggacaaaacatcatcgaaggagcaactgttggcgtgggaagtactattgtaaccatttcagctaaaaatctttatgaaggagatccggtggcaaaagccaagattgcctatgaaactgccttgaaagagtatcagcgtgcagaaggtctggtaaaggataagattatttccgctaaagagttcgaacagactcgtatgaaatatgaaaatgccagaactgcttatgaagcccaagctgccaatgtaactgtttccggggtaaaagttacttctcccatcagtggatatgtcaaaaacaggctggtgagtcagggggaatacgtgactgtcggacagcctgttgctacaatttccaagaaccggagattgcaactgcgagccgatgtttcagaaaactatttcaatgaacttaaaaaaatcaggggagccaacttcatggtatcctacaataacaaggtttataggttggaagatcttcacgggcgtttattatcctttggcaaagccgctgctgaatcttctttctatatcccgattacttttgaattcgataatatcggtgatttcattcccggttcttatgtagaggtatacctgctcaccactccccaaaataatgtattttccattcctgttactgcattgacggaagaacagggtatctattttgtctacctgcaaatagcagaggaggagttcgtgaagcgtgaagtcggtatcggagagagtgacggtaaaaacgtgagaatactttctggcttgaaagagggtgagagagtggtcgttaaaggtgcttatcaggtaaagctggcttctagttcatcggtgttgcccgaagggcatagtcattaa

SEQ ID NO: 184 - DNA, 372 bp, B.fragilis
ataacgaaaaaagaaattggatatggaaaaattaccatcaatagcattagcaacgacaaccgtcagaccttgccgcgtttccagccggaagcgatgcgtgcgaatacccgcattgtaaatgcgctgcaagctttcgggcgtacacggagcatgacctcggcacaggtggctcttggctggttgcttcagaaagcaccgtggattgtaccgattccgggaacgacaaaactgtctcatctggaggaaaacctgcgcacactcgacttcaacatcagctccggggagtggaaagagttagaggatgccgtggctgctattcccgttgtgggagaccggtacaatgcggaacagcaacgtcaggtaggccgataa

SEQ ID NO: 185 - DNA, 1140 bp, B.fragilis
aagattatggatcgcagaaatttcttaaggacggcatcaagttttgcactactcgcggccggagctacaacgggtgtttcccgtgtgtttaccgaaccccctatctcttctttatcaggaaatttatctgataaaaatacgccaaatgcgggcgatacgatggagtatcgcaagctcggagagctggacgtatcggctattggtctgggttgtctgccaatggtgggatattacggtgggaagtacgacaaaaaggatatgatcgctctgattcgccgggcatacgacaaaggtgtcacttttttcgatacggcggaggtttatggcccttacatcagcgaagagtgggtcggcgaagcactcgctccgtttcgcgacaaagtgaaaatcggaacgaagttcggcttcggtgtcgaggagaaacaaccgactgctatcaatagccgtcccgatcatattcgttgggcggtggagggctctttgaaacgcctgcgtactgaccatatcgacctcttgtatcaacaccgtgtcgatccgaaagtgccgatggaagaggtggccggaactgtcaaggatttgatgcaggagggcaaagtgctgcattgggggctgtcggaagcgagtgccagttccatccgtcgggcgcatgccgtctgcccgctttccgccgtgcagagcgagtatgccatttggtggcgggagcctgaaaccaaaatcttcccgacattggaaaaactcggtatcggcttcgtgccttattgtccgctggggcgtgcgtttctcactgggataatcaatgaaaacagccgtttctacgagggagaccggcgttggaacttgccgcaattcacgcccgaagctttgaagcacaatatgccgcttatcgccttggttcgcaaatgggccgagcgcaagggagtgacactcgcgcaattcgctttgctatggatgttatctcgcaaatcgtggattgctccgatacccggaacgaccaatccggcacacttggatgacctgctcggtgcgggaacggtccgtctctcagcttgggagatggaggagtttgataaggagtatgccaaaatcgatttgatggggcatcgtgccgatccgttcaccgaaagtcaaatagataaataa

SEQ ID NO: 186 - DNA, 678 bp, B.fragilis
tctatcacgctgaccaaaggatgctggtcggcatatcctacaaaagtgtttcctgacaggaaccatactgacaggttgtggggcagaacttccaacaacggacaaacggctcaaacggccgatacactgcctgccattctccgtgtcgtgctgaacaacgggatagagatgccgcagttgggtgttggcacgtctactctcaaggagactgccgcagagtgtgtgaaacacgccatcggactgggataccgtttggtcgatgtggcgcaaggctacgacaacgaggccgaagtgtggtacggaatcaaggaaagcggtatcggccggagtgaagtgttcattatttcgaaagtctctcccgatgccgtgcgtagcggaaaggtacgcgagtcgctcgaccggactattgaagcattcgggggaacgtatgttgacctgatgctgattcattggccggtagctagaaaggtcaaggagagatggagaatcatggaaaagtatgtcgatgtggggaagatccgtgccatcggggtgagcaacttcaatccgcatcatgtggacgaattgctggcatacgctcgtatcaagcctgtcgtcaaccagatcaagattcatccctacatggaacatcaggaggtcgtgggcaacacttttgccaaaggtattcaagttcagtga

SEQ ID NO: 187 - DNA, 1029 bp, B.fragilis
aaaaataatagtatggataaaaggaaattaggacagctggaagtatctccgataggaatgggatgtatgggattcagccacggttacgggcaagtgccacccgaagcgtatgccatagaagccatccgcggggcatacgactacggctgcacgcatttcgatacggcggaagcctatggcaaagaacaattctacgccggacataacgaggaattggtgggtaaggcgattgaaccgttccgtaagaaggtggtgctcgccaccaaatttcatattggtgaactctcgaaaccggacgagacgaatctctaccgggaggtacgccggcatcttgaagattccatgagcagacttcgtacggattatatcgacctgtattacctgcaccgtatcagtgaggcagtccggcttgaggatgtggcaaccgtcatgggacggcttattcaggaaggactgatacgtggttggggattgtcgcaagtatcggccgaccagatacgggcggcacataagattactccattatccgccgtccagaacatctattcgatggtggaacgcgattgcgaaacggagatttttccggtatgccttgaaaaaggaatcggagtcgtaccgttctcgccgattgcaagcggattcctttcgggcaaggtaacgccacaggatcagttcggcttcgatgacgtgcggaaattcgtcccccaattatcgaaagagaatatcgaggccaaccagcccatactcgatttgctgcatcggttcgctgtggagaaacatgctaccaacgcccagatatcgcttgcgtggatgctccataaatatcccaatgtcgtacctattcccggttccaagaatcaggaaaggattctggagaatctgggagcttggaatgtcacgctttccgatgatgaattccggcagctacaatcagcgttggatgaatgtaaggtacacggacatcgtgggtgtgtggaaacggaacagacgagtttcggtaaacaatggagtgaagaaacagataagtga

SEQ ID NO: 188 - DNA, 879 bp, B.fragilis
aataaggaaagtatgaaagtaatatcaaatgcagaattcggaggtgaaagacctttgttcgaatcacatgacttacgtttggagaatgtaattatccgtgccggagaatcagccatcaaggaatgcagcaacatcgaagccgttgattgccggttcgagggaaattatcccttctggcacgtgcacggtttcgttatcgaccgttgtttcttcgatgtcggcgggcgttcggctctgtggtactccgataatctgaaaatgacgaacacacgtatcgacgcccccaagatgttccgcgagatgcacgacatcgaaatcgagaacgtagagataaacgatgccgacgaagtgttctggcgttgcaagaatttggacatcaaaaatctgaaactgcatggcggcacttatccgttcatgttcagcagcaatatccgcatagacggattggagagtgacagtaaatacgtattccagtacgtgaagaatgtggaactgcgcaatgccaaaatcaccacgaaagatgccttttgggaagtggagaatgtgacaatctacgattcagaactcaacggtgaatatttgggttggcattcgcacaaccttcggttggtgaactgtcatattaccggcgagcagccgctctgctatgcccacgacctcgtattggaaaattgtacgttcggccccgactgcgaccgggctttcgagtacagttcggtgcaggcgaccatcaaaggcgcaataggtggggtgaagaatccgcgaacgggctgtatcaccgccgagagctacggggagattatcctcgacgagaatatcaaggctcccgccgattgcaagctgaaactctgggacgagaaaacttgtttcacagactaa

SEQ ID NO: 189 - DNA, 864 bp, B.fragilis
cgatattatggtatggatttcaaagaattgaataacggagtaaagatgccgatacaaggctttggtgtctttcagatacccgatgccaccgagtgcgaaagagttgttaccgatgcgcttgccgtcggctatcggctcatcgacaccgcttcggtctatggaaatgaacgggcggtcggtatggctattcggaaaagtggtattccgcgtgaggaactgttcatcacgaccaaagcatggatttcagaaatgggttatgaacggacattgcgagcattagacacttcgctcgcccgtttgggattggattacctcgacctctatctgatccacatgcctttcggcgactattacggagcatggcgggctatggaaaaactttatgcgaaaggacgtgtgcgggctatcggggtatgcaatttcgagccggacagattgctggatttatgccataatgctaatgttattccggcggtcaatcagatagaggtgcatccttatactccgcaaaccgatgcgatacggaccatgcaggaactcggcatacaagcagaggcatgggggcctttggccgaaggacggaatggattgttcacggacgatattctgaccggtatcgctcgcaaatatgataaatcggcagcacaggtcgtactgcgctggcacttacagcgcggagttgtcgccattcccaaatcggtacatcggcagcggatgcaagagaatttcaacatcggggatttcatgctgacaccggaggatatggccgcaattgcttccatgaatatgggatacgatatgattctcgacctacacgctccggaagaagtacagcgactctatggtattgagtgtcctgcatga

SEQ ID NO: 190 - DNA, 684 bp, B.fragilis
ttggagattatgataaaagcaattggattgactaagatattccgtacagagagtgtacagactattgcattgaatgaaatcagtatcaatatatcggaaggcgaatttgtagctataatgggaccctcaggatgtggcaaatcgaccttgctgaatatactgggactattggacaatccgacttccggtgagttgtggttcatcggtaaagaagtttcccgctactcggaaaatgatcgtacagacatgcggaacggcaatatcggctttgtatttcagagctttaacctgatagatgaactgactgtatttgagaatgtagaattaccgttgctatatgccggtgtgccggttcgtgagcgtgtagatcgagtgaacaaagcgttagaaaggatgcagataagccatcgtacggagcattatcctcaacaactttccggaggtcaacaacagcgtgtggctattgcccgggctattgtgacgaacccgaaaattatattggctgacgaaccgacgggtaacctcgattctaccaatggcaacgaggtgatgcttttattgaaggagttaaataaagatggagctacagtcgtgatggtaactcactctgaagaaaatgcccaggaggcaggccgtattgtgcggatgatggatggttgtatcctgacggagaacagacgatga

SEQ ID NO: 191 - DNA, 1368 bp, B.fragilis
gtagattatatctatctttgtgacacaatttataaagcaacaaaaagaaacatgaaagatacacctatcaaacggcatctaattgatgaaactatcgaagaatttcaaattacagatttctcaaaagcaaccattcgtgaagtaaaagccatagcagctaaagcagaaacagcatccggagtcgaatttataaaaatggaaatgggcgtaccgggtctccccccttctactgtaggagtaaaagccgagatagaagcattgcaaaatggaatagccagtttgtatcccgatattaatggactaccggaactaaaatcggaagcctccaaatttataaaagcatttatcgatatagatctcaaaccggaaggttgcgtacctgtcacgggatccatgcaaggtactttcgcatctttccttacttgcagtcaatgcgatgaaaaaaaagatactattctgttcatagatcctggctttccggtccaaaagcagcaattggtggtcatgggacagaagtacgagacatttgatgtatacgattatcggggagacaaattaaaagaaaaactcgagagctacctgaaaaaaggaaatatttcagctgttatatactcaaatccgaataaccccagctggatctgtttaaaagatgaagaactgaaaatcatcggtgaactagccacccaatatgatgtaatcgtccttgaagatttagcttattttgccatggacttccgccaagatctgagtactccgtatcatgcaccttatcagccttcggtggcacactatacagataattatattttgcttatatccggttccaaagccttcagttatgcaggccaacgtattggtgtcagctgtatttctgataaattataccatcgccattatcccggattcgataaacgctacggaggcggtacttttggcactgtatttatccatcgtgtgctttatgccctctcttcagggacgagccattcggcacaattcgccatggcagctatgctgaaagcagcgaacgaaggtaaatacaatttcctgaacgaagtgaggatatatggtgaacgcgcccgtaaattgaaagaaatattcttgcgttacggattccatctggtatacgacaaagatcttgaagatcctgttgccgacggtttctatttcaccataggctatccgggaatgacaagtggagagctggcaaaagagttgatgtattatggggtcagtgcaatttccttggttactacaggtagccaacaacagggactacgtgcatgcacttcctttatcaaagagcaccaatatgctcaactggatgaaagaatgaagttatttgccgaaaatcatcctatatcttaa

SEQ ID NO: 192 - DNA, 1497 bp, B.fragilis
ttagcaatcatcgtttgcaaaataagtgttacctttgcgctcgttatgatgatacttgccactattgtatgctactttgccattctcttgctgatagcccgtatcaccggacggaaaggaggttcgaatgcagcgttttttaaaggagaaaaccagtctccatggtacgtcgttgctttcggaatgattggcgcatctatttcgggagtaacctttgtatccgtaccgggcatggtaaaggcgatggatatgacgtatatgcaaaccgtattcggctttttcttcggttatctggctgtcgcccatatactcctcccactctactataaactcaacctgaccagtatatacacttatctggatacccgtatcggaaagcgtgcctaccgtacaggagcctcttttttccttctttcgcgtatgctgggcacagctgcaaaactataccttgtctgtctgattctatatacctacgtatttcgtgatatgggtatcccattctggagtattgctgccggatcggtagctttagtatggatatacactcacaaaagtggcattaaaacaattgtctggacggatactttacagactttctgcctgatcgccgcactgatcagcatccttgtttttgtcactgcaaagttaaatcttgacttcagcggagttatacaaacaatcagcagcaatgaacacagtcgcatctttgtatttgatgactggatgtcgcgccagaatttcttcaaacagtttctaagtgggatttttattgttattgtcatgaccggactcgatcaggatatgatgcagaaaaacctttcctgccgtagtctgcgtgacgcgcagaagaacatgtattgttatggctttgcattcgctccgctcaacctgctgtttctgggccttggcattttattactggtccttgctcaagagatgcagttggaacttccggctgccggtgacgacatcctgccgctgtttgctacccagggttatctgggcgaaggagtacttatcctatttacaatcggtatcattgccgccgctttcagcaattcggattcagccttaaccgccatgacaacgagcttttgcatcgacttgctcgacacaggcaaagacacagaggaagaagcccgtagaaaacgaaaccgggtacatataggactatccgtcctacttattttctttatctgccttgtcgatgcattgaataaccaaagcgtcatcgatgctatttacatcatagcctcctatacatacggacctcttctgggaatgtttgctttcggattattcacccaacgaaaaacaaacgaccgatgggtgccgtttattgcgatagcttcaccactgatttgttacgcagccgatagatttgcccggcaggaaaccggctatcagttcggatacgaattattgatgctgaacggcatccttacttttgcaggaatatggatcgtatcaaagaaacaactaaaaaatgaattttaa

SEQ ID NO: 193 - DNA, 426 bp, B.fragilis
tatcccaccattggcagacaacccagaccaatagccgatacgtccagctctccgagcttgcgatactccatcgtatcgcccgcatttggcgtatttttatcagataaatttcctgataaagaagagatagggggttcggtaaacacacgggaaacacccgttgtagctccggccgcgagtagtgcaaaacttgatgccgtccttaagaaatttctgcgatccataatcttctattttttcattgttcattttatgattgcaaatttaccgcgattgaataagtcggcttgtatacgatttacggatatttatacccgaatcctcgaaatagtgcatgagctcagatttccttcgatacaatatttcagttttctttttaagaagataatggggcttgctcctaatgaatatcggttaataaattaa

SEQ ID NO: 194 - DNA, 495 bp, B.fragilis
cattgtaacatgtttgcaacttggttgcaagaaatatactctatttttgtcccgaaagtaaaaaccaaacagatgaagcgtatctttttcgtatatccacttgccatagcgacactattcttaatagtgctttccgctattccgcatcaccatcataaagagatgatgtgtacggtgatggaattatgtgaacaagacgatatctacaatgatgggcatacggatcatgaggcggggcaagatgcacataatgaaaacacctgtgtatcacaagctggttatatttttccttccagcgttgataaaagtaatctgcatgatggaagcctgatgaatatccacttgccggttctatatctgtttgctgacattctgactattcatttcgatataccaatctctgaaaacacatacgataggtatgttgtctcttatacgtccgtagtgctgggtgagagcagcggattgcgtgctcctccctattttttctcttaa

SEQ ID NO: 195 - DNA, 600 bp, B.fragilis
attaggggcatgaacatcaatactgacatatttaagatacaatcgaataatgtaatgccgtcgagaggaaagattctgatatcagagcctttcctccacgatgtaactttcggaaggtcagtagtattgcttgttgatcatactgaagaaggaagtatgggattgattataaataaaccactcccattgatgctcaatgatatcattaaagaatttaaatatatagaagatattccgttacacaaaggaggtcctatcggaactgacactttgttttatctgcatactttacacgaaatacccggaacccttccgatcaacaatggattatatctcaacggagatttcgatgctatcaagaaatacattttacaaggaaaccctataaaaggaaagatacgctttttcctcggatattccggctgggaatgcgaacaactgattcaggaaataaaggagaatacctggattatttcaaaagaagaaaatacctatttaatgaatgaagatataaaaggtatgtggaaggaagccttagggaaattgggcagcaagtatgaaacctggtcccgcttcccacaagttccttctttaaactaa

SEQ ID NO: 196 - DNA, 228 bp, B.fragilis
  unsure (10),(11),(13),(14),(15): Identity of nucleotide sequences at the above locations are unknown.
tgcactggtnntnnnaatagcgccaccgtcggatccttccagccccgtggtgaagactatctttttatgtatcactggctggatgagtttgcttaccggactactatgagctggtggctgtttttggggggcggactgattattgcggggattacgttattaactgttatcggacaaacctggcggacggcttcacagaatccggtgagatcattgagatatgaataa

SEQ ID NO: 197 - DNA, 249 bp, B.fragilis
aatccatgctttggtcgtgatgaacagttcctcacgcggaataccacttttccgaatagccataccgaccgcccgttcatttccatagaccgaagcggtgtcgatgagccgatagccgacggcaagcgcatcggtaacaactctttcgcactcggtggcatcgggtatctgaaagacaccaaagccttgtatcggcatctttactccgttattcaattctttgaaatccataccataatatcgttataa

SEQ ID NO: 198 - DNA, 423 bp, B.fragilis
aaaactaaatttatggacttaaaaaagacaactttctacttatttacgctctttagtttgatgttaatttcctgtagcaacgatgatgaaaacaaaaatgatgcgcaggtaacagttactgtagtcagtgctgatggcaaacctctgcccaacgaaattgtgcaaatgttcgatgaaaagacttatgaagagttcaaaaaagacaatcgaacaactcctacggcatatgcattaactaactccaccggagttgccactttcatttttacttatgataagtggttcgaatcaaacaaagaccgatttttcactttcgctgtccaatatggcagtggtacagaaaattatgaaatatggtctgcaggacgtaccgtacgcccgggttcagttacacaaatcgagttgaaacttaagcctttataa

SEQ ID NO: 199 - DNA, 186 bp, B.fragilis
acttcatcatcagatattttatttttaaattttataagaagtacatgtgtgtttttcatatcatttgtaattgttatggttgtaatgatagcaatattcggtaataaaaagcagaaaagcaagaaaatcgatgtttattttcttgcttttttacatggggacgattcttgtcacggtataccgtga

SEQ ID NO: 200 - DNA, 384 bp, B.fragilis
gtgaaagagtcggtacgcatttttagatttgccgtaattggtacgctcaatgcattaatcacagcttttgttatttggttgatgatggatgaattgtcatacgattacattccggccaatattacagcgtacatagtagcccaaattcataactttatttggagtaaatattggatctttccgattgaaaataaaaagaacaacatttggaagcagatgttgtttttctgttctgctttcggattggcatatagtgcccagttcttgtttttagtcacacttgtagagtgtggagatgtaaacgagtatctggcacaattcctggggctgtttatctacggaacagtaaacttcatcgttaataagaagcttacattcagataa

SEQ ID NO: 201 - DNA, 3177 bp, B.fragilis
aagtcaagcccgtatcagtcaatcacgagtcaccaacctctaatcgttaactgcatgttttcaaagttctttatcaatcgacctatattcgccacggtactggcattgatcatcgtggtggccggattggtaacattaaatatattgcctgtcgcacagtttccggagataactccgcctacagtacaggtatctgccttctatccgggggcaaatgctgagaccgtagcccagactgtcggcattcccatagaacagcaagtaaatggcgtagacggtatgctgtatatgagctctacagcgtccagctcgggtgcctattcgttgaccattacttttgctgtcggtacagacatagatatggccactgtacaagttcaaaaccgggtaagcgtagcacaatcttcgttaccggaacctgtcatcgttcagggagtaacggtacagaagcaatcgtccaatattgtgatgtttctcacgatgcaggcacaagactctgtatacgacgggctttaccttacgaactacgctcagttgaatctggttgaccaattgacacgtgtacccggcgtaggggctgtcaatgtaatgggagcgggcaattacagcatgcgcgtctggctcgatccggaagcaatgcgcatccgtaacctctcgccggcacaaatctatcaggctatccagtcacaaaacatagaggtcagtgccggttatatcggacagcctattggcaaaaacaacaataatgcctatcagtataccttgaatgtacaaggtcgcctgacgtctcccgaagagttcggcaacattattatccgaactgaagaaggagggaaaatgctccggctaaaagatgtggcgcgcatcgacctcggcagttcttcgtacaacgtagtgtccaaactaaagggacaccctactgctgccatcgctatctatcaacaaccgggttcgaactcgctcgatgtctctaaaggagtcaaggcaaaaatgcaggagcttgcacaaaacttcccggccggagtcagctataacgtgaccttggatacgaccgatgtcatcaatgcatccattgatgaagtactcgttacttttctggaaacaaccttattggtggtactcgttatcttcctgtttctacagaactggcgggctgtcatcattccatgtatcaccattccggtatcactgatcggtacactggcagtcatggcggcacttggattttcaatcaatactttaactctattcggattgatacttgccgtagcaatagtggtggatgatgcgattgtggtagtagaaaatgcttcacgtttgctggagacaggacagtattctcccaaagaagccgtcaccaaagcaatgggagaaatcacaggaccaattgtcggagtggtattggtattattggcagtttttatccctaccacattaatcagcggcatctccggacaactttataagcaatttgccctaaccattgctgcatctaccgtattaagcggtattaattcgttgacactgaccccggcattatgcgcactgtttctggagcataacaagccatccaatttcttcatatacaagggattcaataaggtatatgataagacacagaatctatatgaccgtatcgtgaagggattactcgtccgtcccggccttgcgttgatctcttatggtattattacggcagtggctgttatcctgttcatgaaatggccttcaaccttcgtccctgatgaagatgacggctacttcatagctgtcatccagttgccaccggcttcaagtctggaacgcacacaggctgtgggtcggaaagtcaatcagattctggacagttatcctgaagtaaaagactatatcggtatcagcggattttctattatgggaggtggcgaacagtccaacacaggtacttatttcgttgtcttgaaaaactgggaccaacggaaaggaaaagagcatactgctgcggctgtggtcgaacgtttcaacgagatggcttatggcatccaggaagcacagatattcgcaatggtacctccggccattcccggattaggagcttcaggagggttacagctacaattggaagatcgcaataacctagggccgactgaaatgcaacgggctgtcgaaaccctgatggctacttatcacactcaacccgctctcgcatccatatccagtatgtaccaagccaatgtaccacagtatttcctgaatatcgaccgcgataaagtacagtttatgggcattcagttggataacgtattctctacactgagttattatatgggagcggcctatgtcaatgactttgttcaattcggacgtatctatcaggtaaagatagaggccggagaacaagctcaaaaagtaattgacgacgtgctgaaactcagcgtccccaatgctaaaggagatatggtcccattttcatcctttaccaaagtcgaagagcgcttgggaatggaccaaatcagccgttacaacatgtactcgacagcatctatcacctgcaacgtggcttcgggaagcagttcgggtgagggaatacagcaaatggaagacctgattaaggagcaactgggtaacgagtttggctacgaatggacctcggtagcctatcaggagacgcaagcaggcaacacaaccaccatcgtattcatcatggcattattggtggcattcctggtactggcagcccaatacgaaagctggacaagccccttatcagcaattatgggattgccaatggctttattgggagcaatgataggttgttctgtcatggggacccctgtgagcatttatactcagatcggcatcattttactgattgccctttctgcgaaaaacggaatcctcattgttgaatttgcacgcgacttccgtgccgaaggtaactctattcgcgatgccgcctatgaagccgggcatgtccggctgcgtccgatcctgatgacctcttttgcattcgtattgggagtgatgcctcttctgttcgccacaggggccggggcgcaaagccgtatcgcactcggcgcagctgttgttttcggtatggccctgaacacgttactggcaacgatatatatcccgaatttctacgagctgatgcaaaagttccaggaaaacatattggatcgcaagaaaaagaaatag

SEQ ID NO: 202 - DNA, 450 bp, B.fragilis
atgttatcgttaaacctaccagtatttgacactaaaatcgccactcgaaatggaaaaaatgttattttcgatgtgattcgccgtcgttatgtcgcattgacccctgaagaatgggtccgtcagcactttgtacactttcttattgttcataaggggtatccgtcgtctttgatggcaaatgaagtgctgctgaacctgaacgggactaaaaaacgatgtgacacagtgctatataaacgcgatcttagtgccagaatgattgttgaatataaagctccccacattgagattacgcaggctgtttttgatcagatcacccgctataatatggttttgaaagttgattatctggttgtcagtaatgggatgcaacactattgttgccggatggattatgatactcaaagttattcgtttctgtcggatattccggattatgacgctttataa

SEQ ID NO: 203 - DNA, 426 bp, B.fragilis
agactcaaaccaatgaaggcatttttaccgttacttctctcttttttctttattatttcatgccagcaacacaaagaagctactatatctcctatcgatgaagaagatgaattgcaggaagaggccgatagccttccccgtgcgacagccattttttggcttgataaatatcatatgaaagagctgaaaaaggacgatgtgcttactttccgtacggctaaggctaaagtcatcattcggaatgatgggacaatcgagcttctgtcgtttgtggaacaacagcctgggaatgcacaacgatatatccgttaccgactgaaagatttcaaggttaagaaaatcttgatggataacggctatatcaatccgggtgaacaatacgtccaactccgttatatacctgcacttgcaaggcgcgttaaatag

SEQ ID NO: 204 - DNA, 1062 bp, B.fragilis
atgatggaaccaacttgcatgagcgaaaacaagaaaaaaataatattcatcgttaatccaatttcgggtacacaaagtaaggaacttgttctgagtctactggatgaaaagatagataaggaaatgtatacttgggaaattgtgtataccgaaagggccggacatgcaatcgaaatagcagcagatgcggcagataaaaatacagatatagtagttgctgtaggaggagacggaacaattaatgaaattgcccgttcattggtacacaccaatacagcattgggaattatcccttgcggctctggaaacggattagcacgacatcttcaaatttcaatggatccgcgtaaagcacttgaaattttgaatgatgggataatcgatatcatagattacggaaaaataaatggcacagactttttttgtacttgcggagtagggtttgacgcttttgtaagtctgaaatttgctaatgccggcaaacgtggactgctgacttatctagagaaaaccctgcaggaaagtctaaagtatcaacctgaaacttatgaattggaaacagaagacggtacttccaaatataaagcctttctcattgcttgcggcaacgcttctcaatacgggaacaatgcttatatagccccacaggccactctgacagatggtttgttagatgtaaccattctcgaaccgtttacggtattagatgttccggcactagcctttcagctcttcaataaaacaattgaccaaaacagtcgcattaaaactttccgttgcaaaaagttatgtattcatcgcagttcgccgggtgttgtccattttgacggcgatccgatgcaggctgacgaagatatcaaaatagaactgattcagaaaggactgcgggtcgttgtacctggtgataaaaaaaaagataatcccaacgtattacaaaaagcacaagaatacgtaaacggtattaaattgataaacgaagctatagtagaagatatagcacataaaaataaagttattctgaagaagaataagcagctgatacaaaaacttactaaaaaatag

SEQ ID NO: 205 - DNA, 951 bp, B.fragilis
atgattatgcctaaaaactatactttacaaaacgcctccaatttaggttggctattctataaagactattatagacaagaaccgaatgtagatttcatttctacacaaggaaaagaaagtgatacaactgctgattttttcagaaaaaccaatcagagaatcactgcttatcaattaaattccgaatcaccattagttgcagcattcaacaaccattttggtacaccgttgcaactaaaaaccatttatccgggtttaataacaggtagcggacttccgcatcagacaggtagtaaaggagaatttaaattaggatttcaatttgattatactaccggacttccctatattcccggatcatctatcaaaggaactttgcgcagtatgtttcctttttcattgaaagataaaggctctactaaacgtattctaccggaatatagaaaagaacgtatggaatatatccgagacttaataatagaagtaaccaatataaatgaaatttcagacacagaaattcaggcattagaatatgccatattcactaacagtactccatctggcaaaacgatagaattctctcttgaagaaaaagatgtcttctatgatgcttttgttgcagattcaaaggatggagtaatgttaagcgatgactatattactcctcatggcgagaatccattaaaagatcccaaacctattttgttcttaaagatcagacctgatgtaacaataaacttttatttcaaattgtgtactactcacttatacaaagaaaaggtatgtagttcaaaacaaatagaagagattaaaaaacaaaatgatttctcttcttcggactacaaaatgattacggcacaccagaagcgaaacctatttgagaaaattctcctttgtatcggaatcggagctaaaaccaatataggatacggacaattaaagaaactctaa

SEQ ID NO: 206 - DNA, 282 bp, B.fragilis
ggggagaagttcagacataacggcttggataagatcgtcatggacttcggtattgcttttaacattgggaaaatgatcaataagcaggaaaagaagaagagaggcagaactaatttattggtaactattttaataagctgtggaatagcttaccaaaaatacacaaaggcgataatactacggggctgtccaaaaagcaaagtgccccccaaaagtcggatagccccttttaccattgtttatttcggtgaaaagcctcatattaccgttgtgaaaaattaa

SEQ ID NO: 207 - DNA, 405 bp, B.fragilis
ttaatcgatactatcaggaatatgcacatcagccacattgccatctggactacccgtttagaggaacttagaaatttctatatcacttatttcaacggaacaagtaatgaaaagtatatcaatcctaaaaaaggatttgaatcttatttcatcagttttgatcagggatttgcttctctggaaattatgcaaagagaagatatcacaacacctgcattaaaagactgcctcgggttagctcatttttccttttctgtcggtagcaaagaagctgtattggaactcacagaacaactccgtaaggatggttttgttatcgagagtgagccacgaaccaccggagacggctattttgaaagtgctattcttgatcctgaaggaaacatagtagaaatcactatttaa

SEQ ID NO: 208 - DNA, 711 bp, B.fragilis
ttaagagtaacattggatagggttatcgaagataaagagttagggcgtttggttgtacgcgataatgtgcgtgcaaaacggcttgtttttcgtacgaaagcggatgctatttacattagtatacctctgggagttacgatgcgagaggtaaaagaggcaatagagaagttgcgtccccgattactggattccaggcagaagttggtgcgccctttgattgacctgaactatcggattgagacagaatacttcaaattatcactggttagtggtaaacgagagaggtttttggcacattcagagttgggagagatgcggattatctgtcctccaacagctgattttacagactcgaatttgcaggattggcttcgaaaagtgattgaagaagctttgcgacggaatgcaaagattatcttgcctccccggttgtatatgctttcagagaagcaccgtttaccctacgagagcgtgcagataaattcgagccgtgggcgatggggaagctgttcctctcgtaaaaagataaatctctcttatttccttgtattgttgccaaaacatctgatagattacgtccttttgcatgaactttgccatacttgcgagatgaatcatggagatcgcttttgggacttgctaaatgggcttaccgatgggaaagcattggaactacgcgaagagttgaagaggtacaagactgagatctga

SEQ ID NO: 209 - DNA, 249 bp, B.fragilis
ccgttaaaaacaaatcggagtatgagaaatttttttgtaagtgcctttttattattagtcggtattgccgttatgactgtttgccgaatgaataataagcaatgtttgagtgaattggctttagtgaatgttgaagcgcttgctacaggtgaaggagatgttcctacaagttgttatggcagtggtaatgtagattgccctataagcgatagcaaagtttcctatgttatgaatgggcgcagtttttga

SEQ ID NO: 210 - DNA, 1506 bp, B.fragilis
catagtcgaacagataaaactattagaattatgatatatagttatcacatattttattttccatttaaatgggaaattatgggattagaaaatcaagcattttctgaccaagttaatttggacaacattcaatataaccggaattcttattgggaacgctcacaaaagccagatcctggagaagaggagtcattatataacgaaaagaactattattatacatttgtacacaatatattatatgatgaagagcacagtccattaaatctaattcaccatttcgaacgcaaagaacctaagctaagtaatcacatttactattatataaagaaaaaagggcgtaataatccatataaactcattgtagacgcgatgaatattaatctatatgctacaggtgtcggattcttgtcattttatctaaaaaatgaagattgcactcaaaacagcccggaagacatattggctatcaatcaatatgggcgccgtatcatgcccccctttttcaatgatacaagactacgaaatgagatttcagaatacattcggatagaaggtttaaatcaaacagtttattttgaagatttcaaatcatatactccctatgacagctggcagccttcctcgtccataaaaaagctaatttgtgaattagttaccaatttatcaattgaccctattatagatgatcgtatgtttgtggcaacatggtacaaaaacaatcagctatctcaacaatttacaaataatgcgaaagcttactttgatagccaggatccattttcagattactggtatcgttttctgtttatagatggaagtaatgccacttgccaaaatgagaaaatgaaaaaagaactattggaggaacatacctattatcgttggcaacaatggagttcactttatggtatcagtaaatattcattagtataccttactaataatgaagtacccgattacctgatagaatattttcaaacgatctatgcacgtatggccgaactagtattagttcaacgtgcttccatgttaagattttccggagaaatcactaaagtaagccaattatccaatcaggatgtagaagccgtatctaaacgggttagttctttatataaagaatatattcgtttcgtaaatcaaatctatttccgtgagattacagctcaagaccaaggaatcgaaatgtacaacaagcttcactcttgcttgcaaatggaaagttatataaaggatttagatggagaaatagaagaactgcatcaatacatttctttaatggaagatcgggagcgaaacaaaaaagcaagtttgcttaatgatattgctactttatttttacccattacagtaattaccggtttttggggaatgaatcaaatcagtgaagtgatggaagaaaatggagaactctcgaccggctttatcattcaatctctattattaataataggtacactttgtgccatatgtataatctataaaagaaaaagaaaactatga

SEQ ID NO: 211 - DNA, 798 bp, B.fragilis
tatatgggaactattgatatatcttactttaatctgcttatagggctactgttattggtaatcccacttttttatctttggaagttcaaaaccggattactgaaagccaccctgatagggacagcacgcatgatcgtgcaactcttcctgataggtatgtacctgaaataccttttcctgtggaataacccatggattaacttcctgtgggttatcatcatgatttttgtagccggacaaacagctttggtacgtacaggacttaaacgtgaaatactcctgatccctatatcagtaggtttcctctgtagcgttgtgctggtgggcatgtactttattggcattgtattacaactggataatgtattcagcgcccagtattttattcccattttcggaatcttaatgggaaatatgttatcaagcaacgtgattgccttgaacacttattatagtggattgaaacgtgaacagcaattgtactgttacctgttgggcaatggtgccactcgtcaggaagcacaggcaccattcatacgggaagcgattatcaaatctttcagcccactgattgccaatatcgcggttatgggattagtagcacttccaggcacgatgatcgggcaaattttgggaggcagcagtccgaacgttgccataaaatatcaaatgatgattatggtcattactttcacagcctctatgttatcattaatgatcaccatctcgctggcatcccgtaaatcgttcgatgaatacggacgtattttgcaagtaaccaaagaatctcaaaagtag

SEQ ID NO: 212 - DNA, 2004 bp, B.fragilis
gaatatatgactgtaaaagaaaaaatagaacaactccgtctccaactccatcagcataattacaattattatgtgctgaatgccccggaaatctcagataaagaattcgacgatttaatgagggaacttcaggacctggaacaggaacatccggaatataaagacgaaaactcgcctactatgcgtgtaggtagcgatatcaataagaattttacccaagtagcgcacaaatatccgatgctttcattgtcgaatacatattcggagaatgaagtaaccgacttctatgacagagtgcgtaaagctttgaatgaagattttgagatttgttgcgagatgaagtatgatggtacctctatctctttaacttacgaaaatggtaaactgatccgcgcggtaacccgcggtgacggtgaaaaaggggacgatgtaacagacaacgtaaagaccattcggagtattcctctcgtcctacatggagataattatccggaagttttcgagattcgtggagaaatcttgatgccatgggaagttttcgaagcattaaaccgggaaaaagaggcccgcgaagaacctctctttgcaaatccgagaaatgccgcatcgggaacattgaaattacaaaattccgccatcgtggcttcccgtaagctggatgcctatctctattatctgcttggcgataatctgccgactgacggacattatgaaaatctgcaggaagcagccaaatggggatttaagatttccccgttaatgcgtaagtgccagacactacaagaagtcttcgactttatcaactattgggacgtagagcgcaaaaacctgaacgttgctacagacggaatcgtactgaaagtaaacagcctcaagcagcaaaggaatcttgggttcacagccaagtctccccgctgggccattgcctataaatttcaggctgaacgtgcactgacccgcttgaacatggtaacctatcaggtagggagaaccggcgccgtaacaccggtagccaatctcgacccggtacaactttcgggcacagtagtgaaacgcgcatcattgcataatgcggatatcattgaaggactcgatttgcatataggcgatatggtctacgtagaaaagggaggagaaatcatccccaaaataaccggtgtggatacgtcggcccgcttcatgatcggtgaaaaggtaaaattcatcactcactgtccggaatgtggcagtaagctgataagatacgaaggagaagccgcccattattgtccgaatgagaccgcctgtccaccacaaatcaaaggaaaaatagagcacttcatcagccggaaagcaatgaatatagacggattaggacctgaaaccatcgacatgttctaccgtttaggactgattcgtgacacggccgacctctatcaactgacgacagatgacatcagaggcttggaccgtatgggagacaaatctgcggaaaacatcattaaaggaatcatgcagagcaaagaggtaccttttgaaagagtaatttttgcattaggtattcgttttgtaggcgaaacggtagctaaaaaaatagccaaatcttttaaagacatagaagagttggaaaatgcagatctggaaactctgatcaatatcgatgaaatcggtgaaaaaatagctcggagtatccttaactactttgcgaatgaatcaaatcgtaaattggtggaccgattaaaaacagcaggattgcaactatacagacctgaagaagacttgagcggacataccgataaattggccggacaatccattgtcatcagtggagtattcacccaccattcaagagatgaatacaaggatcttatcgaaaaacacggtggcaagaacgtgggaagcatctcttctaaaaccagttttattctggccggagacaatatgggacctgcgaaattagaaaaagcaagtaaactgggaattaaaataatgaacgaagaggaatttttaaagcttatatcgtaa

SEQ ID NO: 213 - DNA, 609 bp, B.fragilis
atctatcttgcaaagttagtcaaaattcataatatgtgcgggatttcttttatctttgtgtcactaattaatgaacgagatatgatactgaacgaacgagacagtcgccacgaacatgtattaaatgtggcacggcagatgatgactgctgcccgtacggcccctaagggaaaaggaattgacatcatagaaactgcaattgttaccggtgaagaaatacagcaactctcggatacgttgaaagccatgttcgaagagtttggtatgaaattctttttgcgggatgcagataatattcttcaggctgagtgtatcttattaataggtacgcgtgagcaagctcaaggattgaattgcggtcattgtggatatgctacatgttccggacgttctgaaggtgtcccctgtgcgttgaatagcattgatgtaggcattgcaattggttcggcatgtgctacagcggctgatttgcgcgtagatacccgtgtcatgttctcagccggattggctgcccaacgtcttgagtggttgaaaggatgtcgtcaggtaatggctatcccggttagtgcttcttccaagaatccttttttcgatcgtaaacctaagtaa

SEQ ID NO: 214 - DNA, 1815 bp, B.fragilis
aacaataacgccatgaaatacattgcaatcactttaggaccaattacccgtacaatcgaaatggctgaaagcactaaagagctttgggcagccagttatttcttctcttatcttgctaaaaaaatagtagaaccattcgtgaaaaagaatcgtacctttcagctacctcttattaatgaagagatgcaaaagccccattgtggtgccggtttgtttcctgatcgatatatctttaagtctgagcctgaagatttggagctgcttaaacaacactcagatcaggtattaatagaaatagccggtcatatagcttctcctagcttgccgggcacagctaaagatgtatctcaaatatatcactatttaaaatcatatattaaaatatattttattgaacgcacattagagtcggacgatcctcatgtagtaattccggcttgtgaaaaataccttaatattattgagaatcaagaaacatttcctgagcaggaagaaaccatgatatcccatcaaaaaagcgatttcttaaaatttttaataaccaacgtcaacggtaaaatatatcgaaaagacaaaaattcaattcctcgttttactggatcttttctcacaagagatgcatttggtgatatgaacggagaaagattgtttgagtccatccttgaaatatcagcatccgaattaaacataaacatccaacaaaaagcattagaagtaattacagcaaacgaaaaaaacaaaggtgaaaaatatagcgatcagatctgggatgcggaagaaattatcctaaacgacaacaaagcacaacttagaccatatcataaatatattgctattattaagtcagatggtgattcaatgggggaaactataaaaagcatgggagcgtacaacatccctataacccaacttagtaaagctttactaagcttcaacatcgaatctattaacgaaatcgtagcttatggaggaaagccaatattcattggtggagatgatttactatgttttgcacctgtatgttgcaatggtaataatgtattcaatcttgtcgaaaaactgagtacttgttttgaccaatgcataaatcaacacttacagcaatacatcaacgcttgttcagaagctcagaggcctttaccaagtctgtcatttggcatttcaattacttatcataaatatcccatgtttgaagcattgcatacaacggactatttattagagatggtggccaaagataacttgtttaaatatacattaagcaataaaaatatacttaatgaaaacatgaagcgtttcattcttaaaaataaattagctttctctttacaaaaacatagtggacaaatctatcataccgcaatgtctaagaaaggaaaaagctatgtaaagtttaatatgttacttcaaaagtacatactgaaaaacaaagatatgagcaagacgcaggaatcagaaaagttcctctcatctgtcatccaaatgatcagagcacatgctgaaatattacaaatcattcttcagaatgaggacaagcgaactgaaatgttaaagaactatttcgataataactttaatgagtcttgtcacctaggttacaccggtttattcgaagatatccaaacgcttctttgccttagatatcaagaaaacattcaagattatcaaaatagaaatgaaattatccagcaaaacacgattctgacatcagatgaaaaagaaatattaatagtttctcctgccatggatgctatccatacgattttcacagctttacaatttattcacttcataaattataataaagatgaatag

SEQ ID NO: 215 - DNA, 918 bp, B.fragilis
actattatggcagatttaagtgtaaacattggtaaactacaaatgaagaacccggtaatgacagcttcgggtacatttggatatggtgaggaatttgcggattttattgatataacgcgaataggcggtatcattgtaaagggtactactcttcacaaacgtgaaggtaacccgtatccccgcatggcagagaccccttccggtatgttaaacgctgtaggactgcaaaataagggtgtagaatatttctcaaatcacatttatccccgtatcaaagacattcagacccacatgattgtgaatgtttccggatcagccattgaagactatgtaaagactgcagagatcattaatgaacttgacaaaattcctgctatcgaattaaacatctcttgtcctaatgtaaaacaaggaggtatggcatttggggtgacaactaaaggagtatcagaagttgtacaagcagtgcgttctgcttacaaaaagacacttatcgtcaagctatctcccaacgttacagatatagcagaaatggcacgggcagccgaggccaacggcgccgatagtgtatcattaatcaatacattgctgggaatggccatcgatgctgagcgcaaacgccccatcctttcaacagtgacaggcggcatgtccggtgcagcagtaaaacccatcgcactaagaatggtgtggcaagttgctaaagcagtaaatattccggtcataggactaggcggtatcatgaattggaaagatgctgtcgagttcatgcttgcaggtgcttcagccatacagattggtacggcaaatttcatagatccggctatcaccatcaaagttatagatggtataaacgattacctggaaagacacggatgcaagtctgttcctgaaattataggtgcacttgaggtatag

SEQ ID NO: 216 - DNA, 1296 bp, B.fragilis
tatgacatggcaaaaatacaaattaaatctgagaaactcacaccttttggaggaattttttcaatcatggagaaatttgactccatgctttcacccgttatcgactcaacactgggtcagagatgcagcagtatcttcggatatcagttcagcgagatagtccgttcgctgatgagcgtttatttctgtggcggctcatgcgtggaagatgtaacgtcacaactgatgcgccatctctcgtatcatcctacccttcgtacatgcagctctgataccatcctcagagccatcaaggaactgacacaggaaaacatctcctatacttccgaccaaggcaagacctatgatttcaatactgcagacaaactcaacacattgcttataaacgctttggtttctacaggcgagttgaaggaaattgaggaatacgatgttgactttgaccatcagttccttgaaacggagaagtatgatgcaaaaccgacctacaaaaagttcctcggctacaggcctggcgtatatgttatcggtgacaagatagtctatatcgagaacagcgatggtaacacgaatgtgcgttttcatcaggcagacacccataagagattcttcgctcttctggaatcccagaacatccgtgtaaatcgcttcagggcagactgcggttcctgctcgaaggaaatcgtcagtgagatagagaagcattgcaaacatttctacatccgtgccaaccgatgcagttcgctctacaatgacatctttgctctgagaggatggaagacggaggagattaacggcatccagttcgaactcaattccattctcgttgagaaatgggaaggcaagtgctatcgtcttgtcatccagagacaaagacgcaacagtggcgaccttgacctgtgggaaggcgaatacacttaccgttgtattctgaccaacgattacaagtcatcgacaagggacattgttgaattctacaatctgcgtggcggcaaggaacgtatctttgacgacatgaacaacggattcggttggagcaggctccccaagtcattcatggcggagaatactgtctttcttctgcttactgcattgatacacaatttctacaagaccatcatgagcaggcttgacaccaaggcttttgggctcaagaaaacgagtcgcataaagtcttttgtcttcagattcatctccgtacctgccaagtggatcatgactgcaaggcaatacgtgctgaatatctacacagagaaccgagcttatgcaaaacccttcaaaacagaattcggataa

SEQ ID NO: 217 - DNA, 2286 bp, B.fragilis
atttataatttaaatatgcccgattattatcattccattaccaccctccatgctctacagaatgcatggagggctgtgcgagccaaaaatgcggcaggagggattgatggattcactttatctcattttgagaagcgtttgaacgataatttgattgaattacaacatgaacttatttcccaaacatggaatcccgaaccttacctaagaatagaaattactaagaatgaaacagaaaaacgtaaattgggattattgtgcatcaaggacaaaatagtacaacaagccattaaaacagccattgaacctcagttagagaaaacctttttaaatctcagttacggttaccgccccaacaaaggtccggaacgagctatcaaacgggtcgtacacgatttaaagaagttaaagagtggttatgtagccaaattggatatagacaactatttcgatacgatcaatcatgaacggcttttcactcgtcttgccaattggttaaaagatgatgaaacactcaggctgatccgcctatgtatccaaacaggaatagttactccgcaactgcaatggcaagaaataaataaaggagtacctcaaggagctatactatctcctttattggcaaacttttatcttcacccttttgatcagtttgctgccaataaagtccctatgtatatacgctacgcagacgattttctaatcgctacatccacagaaaaacaaataaaagaagctgtagaattagtaaaagaagaattggaaagccaattttatttacaactcaatacaccgataatacataatttccatgatgggatagaatttcttggaatcacaatctctgatacaggtctatccatcacagaaaaaaagaaaaagacgttacaagagagaatcaattcaatcaaatttataaaatcgtcattgtcctctcaaagtaaagagacgcttcaaggtataaaaaattactatgccaagttgcttcctgaaagtactttaaaggaattggattgcttcttaatgaaccgcctcaatgcattgattatccgaaaccaaaactctattaataacaaaaaagaattagtttcgaatcttcaaaaaatagaattctattcagaaaatagtaataaaaataaatctcaactgatacaacaattatgtagtacatatatcgtacactctacaaaatcaaagactcggttaaccagtacccatattgataatacaaagctaatcacacaaaaaaagaaagaatatcagaaacgtgaaaatgaaggtgcagaattagtgataagtattccaggtagctatataggggccacttataaaggaattacggtaaaattacaaggtaagattattaataaaccttctcctgctttgaaacacattacggtagtaggtaaggggataagtctctcaagcaatgcaattacgtattgcatgaaccacaaaatcccaattgactttttcgatggtagaggaaaacaatatggtactgtactaaatcctgtatttttggatgtaactttgtggaataaacaagtagaacttcctttggaacaaaaaataaaacttgctactcaaattattatcggtaaattaaaaaatcaattaaatctgattaagtattaccataaataccataaagatattttaggaggaaagttatctgaaaaatatgtggaagttgtattaaagatagacaagctaatagagaaagctaaaaattattctcagagaaatgaaaaatatactgcagaattaatggccattgagtcacaggctgctatagcatattggtcgtacatacgagttttaacagctgatgacgggattgattttatccgccgtgagcaccaaggtgccaccgatttacttaattctttattaaactatggctatgctattctatatgctcgtgtctggaaaaatattcttgcggccaaactaaatccatccatcggggtgcttcatgcaaagcaagatggcaaacctactttagtatttgatgttgtggagctatttcgtgctcaaatggtagatagagtagtaattagtcttattcaaaaaaaagtctctttaaaaatgcatgacggtctattaaatgaatcatccaaacgagttttgatccgatatatattagagcgactcaatcggtatgaaaaatatagaggagaagaaataaccttctctcaaataattttaagacaagcccaagaaatagcactttttatttctggagacaatttaatatttaaaccttatgttgcgaaatggtaa

SEQ ID NO: 218 - DNA, 219 bp, B.fragilis
tcccataatttcccatttaaatggaaaataaaatatgtgataactatatatcataattctaatagttttatctgttcgactatgttaagtatttcatttgttgttaggcggttgcgtacggttccgataaatccattaataccgcctccccaaaagatattacttattggggtgtatcgctttaatatcttctggatagaatttatcccttttccataa

SEQ ID NO: 219 - DNA, 1038 bp, B.fragilis
cgccacacttatatttatatggccaaacaagaactgacttgcgatgacatcctcaaagaactgagggccaagcaatatcgtcccatctactatttgatgggagaagaatcgtattatatcgacttaatagccgattacattaccgacaacgtactgacggatactgagaaagagtttaacctgaccgtagtatatggtgcagatgtggatgtggcgactgtgattaatgccgctaagcgctacccgatgatgtcagaacatcaggtagtgatagtaaaagaggcacaagccatccgcaatatagaagaactatcttattacctgcaaaaaccgttaaactcaacaatattagtggtttgtcataaacatggcgctctggaccgcagaaagaagttagctgcagaaattgaaaaaacaggtattcttttcgaatccaaaaagataaaagaagcacagttgcctgcatttatcagttcatatatgaaacgtaaagggatagacatggagcctaaagctaccgcaatgttagctgattttgtgggtacggatcttagccgtttgacgggtgaactggaaaaactgatcatcacattacccggcggtcagaaacgcgtaactcctgaacaaatagagaaaaacatagggataagtaaagactataataattttgaattgcgtagtgcactggtcgaaaaggatgtactcaaggccaataaaataataaaatactttgaagaaaatcctaaaacaaatccgatacaaatgacgctttctttactattcaacttttactcaaacctaatgttggcctactatgcaccggataaatcagaacagggagtggctaccatgttagggcttaaaaccccgtggcaggcccgcgattacctgacggcaatgcggaaatacactggagtgaagacaatgcaaattgtaggagaaatacgatatgcagacgcaaaatcgaaaggtgtaggcaatacctcgataagcgatggagatattcttcgtgaattagtattcaagattcttcattaa

SEQ ID NO: 220 - DNA, 2334 bp, B.fragilis
tttaaccctctatatagtgttttgctggaccttatgaagaaaaatcttttattgttatttctttttttactgtttttgccaatgcttgtccaggcacagaaagtcggattggtattgagtggcggcggtgctaaaggactgacgcatattggaattattcgtgctctagaagagaataatatcccgatagattatataaccggtacttctatgggagccattgtgggctccctttatgccatggggtattcgcctgacgacatggaaaccttactgaaatcagaagatttcaagcgatggtattccggtgaggtggaagaaaaatacatgtactattttaagaagaatcttcccacgccggagtttttcaatatacgcttttcctttaaggactcgttgagcctgaagccgcagtttctgccgaccagtgttgttaatcctatccagatgaaccttgtctttatcgatctgtatgcgcgcgctacggctgcatgtgacggtgactttgataaactttttgtaccatttcgttgtatcgcatcggatgtgtataacaagaagcagctgattctgaagcgtggtgatctgggtgacgccgtacgggcttctatgagttttccctttatgttcaagcctatcgagatagacagcatgttggcttacgacggtggaatctataataattttccaaccgacgtgatgcgtgaggattttcatccggacatcattatcggtagcgttgtatctactaatccgggaaagccgaaagagaatgatctgatgagccagatagaaaatatggttatgcagaagacagactactctcttcctgattctgccggtattttgatgactttcaaatataatgatgtaagtctgatggacttccaacgcatcgatgagctcgagaaaataggatatgaccgtacaatgagcctgatggactccatcaaaagccgtattcaccgtagggttaatgtggataatatccgtttaaggcggttggtgtataaaagcaattatcccgaactcagatttaagaacatctatatcgacggagctaatactcaccaacaggtgtacataaagaaagagtttcatacctcggacgataaagaatttacgtatgaggatctgaaacggggatatttccgtttactttcggataacatgatttcggagattattccccatgccgttttcaatccggaagatgatacgtacgatttgcatctgaaaataaagatggagaatgaattttcggttcgtgtgggaggtaatgtgtctacgaccagctccaatcagatttatctgggacttgcataccagaatctgaactattattcgaaagagtttacgcttgacggacagttgggcaaaatatataataatgctcagttcatggccaaagtcgattttgccactactatcccgacatcctatcgttttatcgcttccatcagtactttcgattattttaaaaaagataagcttttctctaaaaacgataaaccggcttttaatcagaaggatgaacgattcctgaaattgaaggtcgctcttcctttcttatccagcaaaagattggaattgggctttggaattgcgcagatagaggatcgatactttcagaataatgtgattgattttgataaggacaaatatgataagagcggatatctcctgtttggtggttccgttagttttaatggcagtacactgaactccaggcaattcccgattcaaggtgcaagagaggccttggttgctcagatatttacgggaaatgaaagttttcgtccgggggttaattcggagaataaaaagcccgtaaaagaaaagcattcgtggttacaattgtcatatatgaaggagaaatatcataagatgggtgctaattggatattgggatggtatctggacgcagtttatgcctctaagaacttctcagagaactatacggccactatgatgcaggctagtgagtttgcccccactgcacatagcaaattgacgtataacgaagctttccgtgccaatcaatatgttgctgccggaatacgtcccatttatcgtttaaaccagatgtttcatgtccgtggagaattttatggttttttgcctattttcccaattgaacggaactccattaataaggcttattatggaaaagcattttcccgattcgaatatttaggagaaatttcagtggtttgtcaattaccatttggagctatctctgcatatgtaaatcattatagctcaccaagaagggagtggaatgtagggctgacactcggctggcaactgtttaattaccggttcatcgaataa

SEQ ID NO: 221 - DNA, 225 bp, B.fragilis
gtggcaatgtatgggaatggtgtgacaattggtacactcaagaatactctcaaaacggtaaatctgtccatcccggatggccatttaatggtacatctgcctttttccgccgggtcttgcgaggtggtagttggggtggtactgcaaaaggctgccgagtgtcatatattgactatgacgtgccaaactatcgtgatgaatatggaggttttaggcttgttttag

SEQ ID NO: 222 - DNA, 300 bp, B.fragilis
ccaaagaatctcaaaagtagccgtactatgacatcaaccgactccattttacaattaataagtgaaatacatatcccaggattttttattaccgtagacttcctgcaaatcggaaaggctattcctcaaggaataagcggctttttaaaagaaaagtacgataaaatatctcatggtgccagcggaagaaaatttatttatcaaaaatcaggttggcgcatggcatttacattctatcctaccgaccgggtagtcgatgagaaatatgcaatgaagaacaaaatgataaagaagcgataa

SEQ ID NO: 223 - DNA, 186 bp, B.fragilis
ttaccggttcatcgaataatttatttgcaaaaaaagttccccaaaagcttgcaaattcaagaaaaggccgtatctttgcacccgttaaacaaaaacaatggtcgcgtagctcaactgaatagagtagctgactacggatcagccggttacaggtttgaatcctgtcgcgatcactttaaggtttaa

SEQ ID NO: 224 - DNA, 852 bp, B.fragilis
aaaacaaatcatatgacaacaagaatgtatgtaattaataccttgagcaacatgcacgtaggcagtggtgaggtcaattatggagtgatagacaatctaattcagcgtgactctgtcactaatctacccaatatcaactcttccggtttgaaaggagctatacgcgaatatttcaaggagaatgaaaatttagtaagagaattattcggcagtgctcccaaagacgaaaaaacactccccggaaaagtgcgtttctttgaagccaacctcctatcgatgccagtaagaagtgacaaggtgccctttctgatggctacctcagacgaagtacttcaagaattgataaccaaaatgaagttcttcaattgcgaagaagccactcaatacatatcccatctgtccacattgcttgataatataaaaacacaagcgcaaggtactgattttgcgtacgtgtttgacccttcactgcaaggtgcaatcattgaagaagtttctatacgggctacttgcccaagccacattcctcttcaactgtctctaaagaaacttttaggcgatagactggtgattttatcacataaatatttctctatactatccgatgacaatcatcttccagtcctgtcacgcaataatcttgaaaacgggcagagcgccaatttgtggtatgaacaggttttaccgcgctatagccgactttattttatgttaatggacggaaatgcacaaagtgagtatctgaaaaaattcagagataccctatgtaccccttctaccattattcaaataggagctaacgccagtatagggtacggttactgccaaatatcagaattatcacctttttaa

SEQ ID NO: 225 - DNA, 540 bp, B.fragilis
aatcattgttttctgcccttattcttctgctgcaagaatccggctatgtcagtttggatgtacatagcagtcaccgatcccggttatggcaacgaacaaaacgatgagtttatgaagaatatgggtatagaggcttttgtcaagtacaattattttcacaaagagcagaagcggacctggaacaaggatgcttttaccatacaaaacctaaagaaggcatccattgctggacaccttccttctatatttattcttaatcgttatttttataaaagatcaagtgccttgaaacatttcactaacttaccgatagcaaaatcaatctgttctttagagtgtgtagccatcaacgagaaacgaatcaacgtatcgttcggagaacatgcgggaggcacaactggatttacaaacacaccttcgtcaaataacatcttagttaccataaatgtcttctccatatcacgtacatatagaggaatgataggagtggaggtatgtccgatctcaaaaccaagttcacggaaacactttaaagagtaa

SEQ ID NO: 226 - DNA, 798 bp, B.fragilis
ggatctaataaaaaagatatgcagaagcaagcaaaagagataaaaaaacatcttttccttttgggaggacatgatttagagatgcaaactatagtccagatattgacagatagaaacgtcatattcaaggaccgttatttacaatgggataatgcgttattaagtcaatacgaagaagagatacaacaatatggtaataaagagccgtttattatctatggtgtagaattgaaagaggacatcacgccccccactaactatattcgaattgatcaccataatgaatatgctacctatccttcggcattggaacaagtagcttctattcttgatcaccctctcaatcgatatcagacattagttgcagcaaatgataaggcttatattccaggaatgttagaaataggagccagtcatgaagaaataaatctaatcagacaagaggatcgaaaagcacagggagtaatagaggatgacgaaaagttggctcaagaagcaattacaaacggaacagaaaaaattggtagtttatatgttgtgttcactacagcgaacaaattttcacccatatgtgacagattatatccttatgaaaaattactaatctacactccgaatgagttaatatattatggaaaagggataaattctatccagaagatattaaagcgatacaccccaataagtaatatcttttggggaggcggtattaatggatttatcggaaccgtacgcaaccgcctaacaacaaatgaaatacttaacatagtcgaacagataaaactattagaattatga

SEQ ID NO: 227 - DNA, 747 bp, B.fragilis
aaacgaaataaaatgaaaacaattttcagaatgttatcggtattactgctaactacaggtttattgagtagctgtatacaaatcggtgaaggtatccaacccagcaagaagctcatcacaagagactataaagtgaaggagttcaataagattgatgcggggactgtgggcaacatctattatacacaatccacagacggaaaaacggatctgcaaatctacggaccggataacatcgtagcactgatacaagtagccgtaaaggacaatacactatttttgagtatcgataaatcaaaaaaggtacgcaacttcaaaaagatgaaaataaccattacatctcccaccttaaatggtatctcctttaaaggagtgggcgatgtacatatcgaaaatggattaactacggataatcttgatatagagagtaaaggggtaggtaatgtggacattcaatcgctgacttgccaaaaattgaacgttcagtcgatgggtgtaggtgatgtaaagcttgaaggcacagctcagatagctgctcttcattccaaaggagtgggcaacatagaagcgggaaatctacgagccaacgcagtggaagccagctcacaaggcgtaggagatataacctgtaatgcaacagagtccattgatgcagccgtacgaggagtgggaagtattaaatataaaggtagccctactataaaatcactcagtaaaaaaggagtgggaactatcaagaatatctaa

SEQ ID NO: 228 - DNA, 2355 bp, B.fragilis
aaacagaataaaaaaggatctaataatatgatacgacattatttgaaaattgcatgtaggaatttgctgaaatacaagactcagagtatcatcagcatcctaggattagctatcggatttacctgttttgcgcttgctgtcttatggatacgttacgaaatgacatacgacaccttccatgaaggttttgaccgtattcatttggtgtatcagaaatcggcattaagtgacacaggcgttacaacaacaattccatatccggtatccacttctttagaaaagcagtttccggaagtggaagatgcctgcggttttcttttttatgaacaggaagtgacagtagacgatggcgctatccggcaactgtatgaaatcaatgcagactcttgcttcatgcatatgttcgggatacaagtactctccggcagccttgatttcctggaatcggaagagcggatagcactgacagagcatgcggccaaggaacttttcggtacggaaaatccgatcgggaaggaaatcaaactgtatggtgcccctaaaaccgtatgtgcgatcgtcaacggatggaaccgtcataccaatttacctttttctattttaacgggaggaatacgtcaatggcataatgcatggtatcacggaggattccatgtatttataaaattgcacaaagaagtaaatgccgaaacttttcagaaaaaactggaacaaacgaaactcgaagcagacagcaagggcggcatacagaatctgatggttatgcccatcagtaagtgccactatactgtactggccgaccaaaatgccatccagttcagctatatcctattcttctcgattgtaggcggattagttattctttgttcgctgatcaactacctgtctttgtttgtcagccgtttacggatgcgaagcagagaattggcattacgtaaagtatgcggttcatcagacctccatctgttcaccctgcttgttacagaatatctgctgatcttgttggctgcaggacttatgggaatggccctgatagaattggtattgtctccgttcaaagaattgtcgggagtaaaagaaggagatatttactgggaatcttttttatacttcgccctcgtcatcggatgttctcttgccacattcctgcctgtaactttctacttcaacaaacgaacgctacaaagtaacatacagcaaaagaccgtaaacagatacgggtatctgggacgcaagataagcattgtttttcaactttctatcagtatctgttttatcttctgcatcagtgtcatcatgaagcagctctattatctcagcactacagatattggtatagaacgcaagaatatagcgactctaagcatgtatccgcaaaacaatctattgcctgccgctgataaaatagagcagtttccttacgtcactcaggttctgaaaggacacttttcgctgctacccaaaactgcatccatggctatgcacttcaaggattgggacggaaaacaacccggagatgcagagatcgatatggaagtactgatggaaagtgaagagttagcacagttttacggcatccgccttttaaaaggaaagatgctgaaagaaggagagagggatgccggcactattgtaatcaatgagacagcggccaaagcactcggatggaatgatccgattgggaaaaaactaatcagacccaacggaacagggacaaccgttatcggtttggtaaaagacttccatacgacatcgcctaccactcccataaaacctatcgcatttatagccaaaggcttttccggattcgacctgggcaaaggtgatgtactgataaagtatagagaaggcgaatggcccaaacttaaaaaagacattgaacagctatgtcagaaagaatatccggaaaataaaatcagattatccaatatggaggagacctatgacaactatctcaaatcggagcagacccttttgaaactactgagttgtgtagctgttgtctgtattctgattgctgtattcggagtgttctctttagtgacattggcatgcgagcaacggcgtaaagaaatcgctatcaggaaagtaaatggtgcaacacttggcaacatcctctcgatatttataaaagagtacctgatactgttactctgcgcctcgttccttgctttcccggtcagctacatgatcatgaaagcatggctggagaattatgtcgaacaaatcagcataggcgtttcgatgtatgtcactatctttacgggaatcggtatcatcataaccgcctgtatcggctggagagtatggaaagccgcccgtgaaaacccggcggaagtagtaaaaacagaataa

SEQ ID NO: 229 - DNA, 396 bp, B.fragilis
caactggtcaaaggtgatgatttcgtcaacacgatttataaattcgggtgcaaacgatttattcagagccttctgaatcacgctgcgagagaattctttatcgtcaagacggctttgagtggcaaaaccgactccacgcccaaactctttcaactggcgggttccgatattcgatgtcatgataataacagtattcttgaagtcaaccattctgccataactgtcagtcagccgaccttcgtccatcacctggagaagcagattgaacacatcgggatgcgccttttctatttcgtcaagcaatacgatagaatagggtttacggcgtactttctctgtcaattgtccgccttcctcgtatcctacgtatcccggaggcgctccaaccaagcgtga

SEQ ID NO: 230 - DNA, 1152 bp, B.fragilis
attataataaagatgaatagacactatttaataacattgactccgatggattggtttttctttggaggagaaagaacattggatgatggaaagagtgcagattatatatcgcattcaaataagttccctcaacaatccgctcttttaggcatgatccgttaccaattgctgaaacagcacaatttactgtcccaatttccttacacagagaataaaccgacagaaaaagagataatgaaagcacttattggagaacagagtttcaggatgaccgaaagaaaggctaaatcacttggcttaggcgtcatcaaacagatttccccactcatgcttatagagtgcaaggatgatacctcgtcacgctctatctactttccattgccattagacgatggatacaaagtatcatttaatgaaacaagtaatgaagacaaagttttctataatggaattgaatgcccgattcccaatgtttacccggcttccgaagagcaagattccggtaatcaaaaaagaaaatttttcgatcataaaacatacaataattatcttttctggtgcacccaaggaaataatcagataaaaaaattactatctgatgaaatatggattagtaaaatgcagatcggcattaccaaacatgtggaagaaggtgaggataacgacaaaagcttttataaacaggagttccttcaattgaaaaaatcatttatatatgccttttatatcaccttatcgggagaatcagagctatcttccgatattatacaattaggaggtcaacgttctgtattccgcatggaagtagaatcaatagaagagaatagcgatatacaagaaaaataccaaacagctgctcagttcctgactcaaagcgatcgtcttctaatattgagtccaacttatgtagataacctaaaggaactttctgctttatgtaactttatgtggagcgactccattgtctttcgcaatattcaaacgactaacgcaagtaacttttatggtaaacctatcaaaagcagtagtaaataccacttcttaaagccggggtcagtactttattttaagcaagggaaacgcaaagaagtcgagaaactattgatggattacacttatcttcgtttatccggttataacatatatatataa

SEQ ID NO: 231 - DNA, 183 bp, B.fragilis
caagtcccaaaagcgatctccatgattcatctcgcaagtatggcaaagttcatgcaaaaggacgtaatctatcagatgttttggcaacaatacaaggaaataagagagatttatctttttacgagaggaacagcttccccatcgcccacggctcgaatttatctgcacgctctcgtagggtaa

SEQ ID NO: 232 - DNA, 297 bp, B.fragilis
ggtttaacaaatggccgcgtagctcaactgaatagagtagctgactacggatcagccggttacaggtttgaatcctgtcgcggtcactctaagaaaataacgataaacggtcgcgtagctcaactgaatagagtagctgactacggatcagccggttacaggtttgaatcctgtcgcgatcacaagaacctccataatcaaattatggaggttttttgttttccttgcattatctcttttattggatcatacctaaattctgagggattcctctttttaattggcagtctgtactga

SEQ ID NO: 233 - DNA, 285 bp, B.fragilis
attttaaaaaaaatatttatgaattataagaagaaaattatttgtcttttggtattatttacaattgttgttgtaaatgtgcttaatgttgttgtgaaatcggatgatgctgagacattaactctatctggaatagaagctgtagcagctacttatgaaaacagtccgggaaactatactggagcccataatcaatattgtacaagtcccaaaaatgctacaggatgtgtttcggatcctgatccaacccgcacttgttcatattcaattttttgtaaaaaataa

SEQ ID NO: 234 - DNA, 1431 bp, B.fragilis
ctaaatagaaaaaagaatattatgaatcagttaaccgctatactaaaacaacacactccaatgatccattttcaacataatgaatcaggagcaaccttacgagcatcagaagttaaaccattattagataaattcattcttacaaaactcggaaatggagatattagagaaggacggctttatgctaaaaaaaataattggttaatagataatgaaaaaaattatgcattaaattataagttaagtatatctctacaaaaaaaaagtagactagaatatttaataacttctagtacatttcctctaccaactgagcgtccctctaatttctttacgatccaaaatagtccatattttgctcaagaaaagtgcgttggtataaatacaaactctaccattatcttaaaaaaaagcaatagtgaccctcgtaaaaaagaggctgagtttaaagaaaaaaattggagtcaaatagacaaaaaaggactggaatggcaagactttactataaaaatattctctctgaaaggtgatttaataaataaaatccaaacatatttaccagctttctttatatgccacaattttggtacaagaaacaacaaaggtttcggttcttttactgttgaatatatcaataatcaaaaaaatatatgcaatgtagaagataccttgaaagaaaattttgctttcgtatataagaaaaaaatagctttgtcatgccaaagtacattggattttatctatatctacaatcagatattttcaacaataaagaaggattaccagattctaaaatctggatataatttcagaaacgaatatataaaatcacttctattttgttatttcgttagcaaatatcctaattatagatgggaaaaaagaaaaatgaagcaattaattaaagcaagaggttatgaattgaaaggcgatcattctcccatttctggaataagagagaacgacaactcctggaatgatcctaatcctaatggatataattatgcttatataagagcaatcttaggattagcagaacaatatgaatttcaattagaaacaccatatcagaaagctattgtcaagataaaatcagcaaacaattgtatcagtcgttacaaatctcctttattatttaaaataataaacaacagcatttatttggttggtaatgaaataaatactgaaatactaaataaaccatttcaatataactatatagaacaaactaaaaataaaaatatgagaacaggaaagagtgaaataacagagcggacaatgcatataaatgagattgaaatgaactataataatagaattaattatcattatacgccaacctccttttcattaatcgattttatgcaatatgcaatgtcttataaaaaaaatgggaaaaacattttaaattatattcctttaaaacaataa

SEQ ID NO: 235 - DNA, 888 bp, B.fragilis
agtatgagaaaaataaaagtaggaatcattcaacaggctaacacatcagatattaggataaacctgatgaacctggctaaaagtattgaagcatgtgccgctaatggcgctcaccttgttgttctgcaagaacttcataattctttgtatttctgtcagacagagaatacggatttatttgaactggcagaacccattcctggcccttctaccggattctattccgaactggcggcagccaatcggatagtgcttgttacttctttgtttgagaaacgtgctccgggactatatcataatacagctgttgtctttgaccgggatggaagtattgccggaaaatatcgtaagatgcatattcctgatgatccggcttattacgagaaattctattttactccgggagatattggctttgaaccgattcagacctctttaggcaagttgggtgtgttggtttgctgggatcaatggtatccggaagctgctcgcctgatggcgttgaaaggagctgagattttgatttatcctactgctatcggttgggagagtacagatacagatgacgaaaagaaacgtcagctcaatgcttggattatttctcagcgtgcgcatgcggtagccaatgggcttccggtgatttcagtcaatcgtgtcggtcacgaacctgatccgtcaggacagaccaacgggatattattttggggaaatagttttgttgccggaccgcagggtgaatacctggctcaggcgggaaatgaccgctctgaaaatatgattgttgaggtggatcttgaacgttcggagaatgtgcgtcgttggtggccatttcttcgtgatcggaggatagatgaatatgggaatttaacaaaacgttttattgattga

SEQ ID NO: 236 - DNA, 1839 bp, B.fragilis
acctttggaaataacacggaatccgaattaatatgtacttttgcagactactttaacaaaaatataaataatatattaaatatgttcagaacgcacacgtgcggagagttaagaatctccgatgttaataaacaagtcaagctgtcgggatgggtacagcgcagccgtaaaatgggaggtatgacttttgttgaccttcgtgatcgctacggtatcactcaattagtatttaatgaagaaatagacgctgagctttgcgaacgtgccaataaattgggtcgtgaattcgtcatacagattgtcggaaccgtaaacgaacgtttcagcaaaaacagtcatatcccgaccggtgacatcgaaatcatcgtttcggaactgaatatcctgaactcagccattactcctccttttactatcgaggacaacaccgacggtggtgatgatatccgcatgaaataccgttatctggacttacgccgtagtgctgttcgttcaaatttggaattacgtcacaaaatgacgatcgaggttcgcagttatctcgataaactgggtttcttggaagtggaaactccggtattgatcggttcaactcctgaaggagcacgtgactttgtagtaccttcccgcatgaatccgggacaattctacgcattaccgcaatctccgcagacactgaaacagctattgatggtttccggtttcgatcgttatttccagatagccaaatgtttccgtgacgaagacctgcgtgccgaccgccagcctgagttcactcagattgactgcgaaatgagtttcgtagagcaggaagatgtgattactacatttgaaggaatggccaaacacctgtttaaggtgatccgtaatatcgaactgaccgagccattcccacgtatgccttggagcgaagcaatgagattgtacggtagcgataaaccggacattcgcttcggtatgcaattcgtcgaattaatggatatcttaaaagggcacagtttctctgtattcgataatgccacatatattggcggtatttgtgccgagggtgcagccagctatacccgtaagcaactggatgccttgaccgaatttgtgaaaaagccacaaatcggtgcaaaaggtatggtctatgcccgtatcgaagctgacggtactgtgaaatcaagcgttgacaagttctatacacaagaagttttgcaacaattgaaggaagcattcggtgccaaacccggtgacctaatcttgattttatcaggagatgatgccatgaaaactcgtaagcagctttgtgaattacgtctagaaatgggtaatcaattgggattacgggataaaaacacatttgcatgtctgtgggttgtggacttccctctatttgaatggagcgaagaagaaggcagattaatggctatgcaccatccgtttacctcacccaaaccggaagatatccatctgctggatacaaatcctgctgctgtgcgcgctaatgcttacgatatggtaatcaatggtgtagaagtaggagggggatcaatccgtatccacgatagccagttgcagaacaaaatgttcgaattactcggatttaccccggagcgtgcgcaagagcagttcggcttcttgatgaatgccttcaagtttggtgcgcctcctcatggcggactggcttacggattagatcgttgggtatctctttttgccggactggactcaatccgtgactgcattgcattcccgaaaaataactccggtcgtgacgttatgttggatgctcccgcagcactcgatccgtcacaactggaagaactgaacctgattgtagatattaaggagtaa

SEQ ID NO: 237 - DNA, 1245 bp, B.fragilis
tatagtatgaaaaagtatccaaaaatcgggattcgtcccaccatcgatggacgtcagggcggcgttcgcgaaagccttgaagaaaaaacaatgaatctggcaaaagctgttgccgagttgatcacttctaatttgaagaatggagacggaacccctgtggagtgtgtgattgcagatggaaccatcggacgtgtggctgaaagtgctgcttgtgcggagaagtttgaacgtgagggggtaggagccactatcactgtcacttcatgctggtgttacggtgccgaaacaatggatatgaatccgtattatccgaaagctgtttggggattcaatgggacagagcgtccgggagctgtatatctggctgctgtgctggcaggacatgcacagaaaggacttccggcatttggcatttatggtcgcgatgtacaagacttgaatgacaattctattccggcagatgtagctgaaaaaattctgcgttttgcacgtgcggctcaggctgtagccacaatgcgtggcaaatcttatctgtctatgggcagtgtttctatgggtattgccggttcgattgtaaacccggactttttccaggaatatctgggcatgcgtaatgaatcgattgatttgacagagattattcgtcgtatggccgaaggaatctatgataaggaagagtatgccaaggcaatggcttggactgaaaaatactgcaaaaagaatgagggcaatgactttaatatacctgaaaaaacgaagacccgtgcacaaaaagatgaggactgggagttcattgtgaaaatgacaatcatcatgcgcgatctgatgcagggaaaccctaaattgaaagaactcggatttaaggaagaggctttggggcataatgctattgcggcaggtttccaagggcagcgtcagtggaccgatttctatccgaatggcgacttctctgaagcattactcaatacttcgttcgattggaatggtattcgtgaggcttttgtcgttgcaacagaaaacgatgcttgtaacggtgtggctatgctgtttggtcatctgctgacgaatcgtgcacagattttttcagatgtacgcacatattggagtccggaagcagtgaaacgtgtgaccggtaaagagttgacaggaatggctgctaacggtattattcacttgattaattcgggggcaactactcttgacggaaccggacaacagacgaatgctaacggtcttaaccacggg

SEQ ID NO: 238 - DNA, 411 bp, B.fragilis
ttaaaaacgaataaatcagagaaaatgaactatatgatacagcattatctcaaaacagcaatacgcaatctgctgaagtataagacacacagcattatttctgccatttgtctttccgttggtatgacttgtttcagcatcatccacttttttatcaatgaaatagatggagcatcacgtaacatgcccaatttcgaacaaaggatttcaatccggatgatcaattccaaccacgaagtaggaggatgggggtggagtctcaattcttctgagatccgaaccctgacagaacatcccataccgggtattaagcaaatctgcttccactctttccaaagagaagacgaagttgtattcatcaatagggagcagggaagaaaagccttacatcatctcatatatggatactga

SEQ ID NO: 239 - DNA, 495 bp, B.fragilis
aagaaaaagaaaactatgaattggaaattagtagaatgtgaaattgcactaatcgtatctttgacagtaattgagtgtgtgaatatgggacagaattcccctaaagacattacatgtcttactgtgtttttttgcattatgattgttctgttgccacttattggtgtattgcaacaatggcatctctcatgttttcagaatcgccagaaagaaaaagagtatcaggctaaacaagaaactgatgaaaagatgaaaacatggctactcgcccgtgaagcaattatcaaggataaagaaaaagaagagctaacgaataaggtaaatggactacaacaaaaatgtgattccttgatagaaaaccaagaaaatgaattaaaaaaattttatctttctattctttctattattggcactaaagacgatctgaaatcgattgaggagaacttcaaaaagatgaaggatttctttgaagaatataaaaagataactaaatag

SEQ ID NO: 240 - DNA, 186 bp, B.fragilis
ggagcagggaagaaaagccttacatcatctcatatatggatactgatcctaatttcttttcacattataatgcatccttcttatatggccaatgcttttcccacaactccgaaagaagttgtgttgtccgaaagttgtgcccgtaaagtatacgggaaagagcaacccggtagggcacattactga

SEQ ID NO: 241 - DNA, 318 bp, B.fragilis
agagttaacctccagccaaaatgttcttttccggttcgtttatcggaaaaaatatctcccaaccatcttgttcgtgttgtaagttacattgtagatgctttggatattagttacctgctctcggcttataatggaggaggcaccaacagctatcatccccgtatgatactcaaggtcctgttttatgcttatctgaacaatatctattcctgccgcaaaacccaaaaggccttgcagaagaatattcacatcatgtggttgtccggtaatagtacatccaatttccgcactatcaatgatttccgtggcaaggtttaa

SEQ ID NO: 242 - DNA, 186 bp, B.fragilis
tttaaaagcctctacttcatttacacattgcagcagaaaatgtacagagtacaaaaagaaagactttttctcatccttgctttgatggtaggtattcgtaaaatcgaccaaagtagtgatcccaaagaatgggtcgtcaaaagcagaaaagaatttaaaatgttcttttctattccaattttctaa

SEQ ID NO: 243 - DNA, 768 bp, B.fragilis
tgcaatgaagattcgcaaaaatatcgtgtcttcccctggagagcaaggactgcatactgttgttgtttaacacatcctttgagtgtagatacgttgaatatactatggaggactatgttgaatgaaagacagaaatttcctattcgtacaggattaaaattaactgtttctgataataatggagtggtccgctcttcttttagtccggatagcctttcttgtttatcttattcttcgatatttacttattatgtaggctatagatgtgaaattgaaatcttagggtttgtatctatatcttttttctcagtatttgtaaatatagtttggactcttattggagttgttgttgcttttgtgctttgtgtgattcttacaatctatatatataagttgtctgttcaccctcctaaaataaaagaggttactacttatgttcagacagttgctgttaaaaaggggactctgcctatatacgatttgaaagatgatcttaaactggatgttggtaaaggtgtattgatctgcgaaaacatggaagtatctcttactccccagcagcgtgttcttttagttttgtttattaaggctgagaatcatactctgtctatgtctcaaattatggcagatgtttggccgggaaaatctatttctcccgattgtttccataaagcaatagaacgtttgcgtgatttgttaaggcagcttcctatgaccatacaaattgaatatttgggggaggaaatttatcagatgcaaattttataa

SEQ ID NO: 244 - DNA, 204 bp, B.fragilis
tttattctggataagcaagataaaatggtatgttatacaacatcaaaggcagagaacaaagcaattatttatagtaatcatttactctacaaccaacagagctactcttacttaaatatagaaaagcatcccttgtgttacaagaaatctaaatctattgactttactaatttaaagtacaagtccaagtctatatttttatga

SEQ ID NO: 245 - DNA, 1827 bp, B.fragilis
ggcacattactgaaaatagtcaagttgaaggaaagcgaaaaagataaaagcacatactataaagttgtcaatgttatcaggaatcttcccaaaacactaaatgttgaaacagatatctatttctctcatttgagagaagagaacagacaacaaggatacatcacagaaggtacactggaaacagcagacggattgaataaagccaatgaaagcctaaaggggataacaactcttcataataatgaaatggcatatttcattgcgaacaaagaagctgactcgtatcacgatccgcagcgaatgataggcatagcattcattaccttcttatcctctctgattctgttatcgggtatgataaactttctaaagttcatcatacagtcattctacaaccgtaatcgtgaactggccctgcggaaaagtctgggtgccagccccaaaagtttatttgcccttctattcaccgaagctttctggatgctgacattttctttattgttctcgctggtcttatccgaatgtacctgtttactactgacaacctatattccgcctaaagaaatgattccaatagatatccaaactctatatggcattcaagttaaactttatatagggctgttactgatctgcacccttgtaatgctatatcccatccggcgtttgcaacggtccggtcttgccgggcacatgaaaactaacagccaccggcacctctttcgcaacatcatgatgtgcgtacagctatgtgtatgtatcttttttctgggtatgagtatcgctatacatttattcaatagtgtaggaagcgttttgtaccttcctctatcagacaaagaaacaaattccacgctttgctttgaaatgaatagtgttactctcggcaaaaataaggatgcgattttatcacaaataaagatgttgccaggagtggaaaatatcagttcagctttgatgagcggcaactataattcgtttctgaccagtgactatgagtctgccgatcaccgtactctcactgtcagagtcagacaaggagatcccagctacttccagttctttcggattcctttccggggagagatcgtcgaacctcatacaagtaacgtggtttacatcagcgaagcctttcaaaagcagttggaaaatgattctgtaagcggaaatgtaaaattaggtaaagagaactatcggatagcaggtacatacaaggcttgttacggggagaacatctcagaacacaatcaatacaatatttctgttttcttcccgactgaagaagcatccgtaatttatatccgttttcgtgacgatatcagttttggtaaagccaaatcagaaatagaaagggtatgccgtaattacgtcccagagtcattgccactcgatatacaacgactggatataagaagaagtacaacacaaggtatcagagacctgatgggcgatgcctcactgctattaggcatcataagtgctcttctggttatactgagcatatactcagctatctctatggacacagtcagccggcagaaagaagttgctattcgcaaaataaacggcgcaactccgaaaataattgctttgatgttcggaaaagcatatataatccaattcatactggcctataccatcacttatccattattaaggttacttgtgatagacataaccaaggatagcccgatcagcagtattaccggatttgcatgggggatttacctcttcattctgataggtttacttatctttgtaacaacagcctataaaatctacagaatcatgcatctcaatccggcagaaataataaaaaacgaataa

SEQ ID NO: 246 - DNA, 894 bp, B.fragilis
atgaaaacactcctaaatattaaactccatttatctaaaaagaatatatttaccatcttagtttttattcttgttttaagtggtactaccggttgcattcaacacaaatccgaccagaaacgactgcctgctctttcttttactgtaaatggagagagctttgaaatgattccggtagaaggtggaacctttattatgggaggcacaagtgagcaaggtaatgattgcgaaaacaatgaaaaaccaacgcatgaggaaactctaccgttcttttatatcggaaagtatgaagttacccagaaactgtggaaagcagttatggggactgatttcgatcaatcatacaattcaggatgtgaagattgtccggcagagtatatcagttggaatgacacgcaaaagtttataagcaaattgaacacccttacaaacaaaacatttcgcctgcctaccgatattgaatgggaatatgccgcacgcggtggcaagtatagtgaaaaatacaaatacagcggaagtaatgatatcgatgaagttgcctggtatattgaaaattatcaaaaaagtaaatatggagacaaagggactacacatccggtaggtatgaaaaagcctaatgaattaggattgtacgacatgagtggcaatgtatgggaatggtgtgacaattggtacactcaagaatactctcaaaacggtaaatctgtccatcccggatggccatttaatggtacatctgcctttttccgccgggtcttgcgaggtggtagttggggtggtactgcaaaaggctgccgagtgtcatatattgactatgacgtgccaaactatcgtgatgaatatggaggttttaggcttgttttagtaccggactcagtacagactgccaattaa

SEQ ID NO: 247 - DNA, 840 bp, B.fragilis
atcactgtttgcacaatttcccgtatctttgcaggacgaatacgaatttactttcaacaatacatgaaaaaatttattttagacctgacagtaactgagaatctcagattgcataccaactatgtgctgctgaaattgacctctcagaccgtcctcccggatatgctaccgggacagtttgcggaaattcggatagatggttcacccaccactttcctgcgtcgccccatttctattaattatgtagacagacaacgcaacgaagtatggtttctgatccaacttgtaggtgatggaacaaaacgtcttgcgcaagtaaatcgaggagagattatcaatgtagtactcccactcggaaatagcttcacaatgcccgaaaagccttctgataagctattattagtgggcggaggtgtagggactgcccctatgctctacttgggtgaacaacttgctaaaaacggcagtaaaccaacatttcttttgggggcacgcagcaacaaagatctgctccaattagaagattttgccgcttacggagaggtctatactacaaccgaagacggcagccatggagaaaagggatatgtgacccaacattccatactgaataaaataaaattcgagcagatttatacatgtggcccgaaacccatgatgatggcagtagccaaatatgccaaaggtaacgatatcaattgcgaagtatcattggaaaatacaatggcatgtggcataggagcctgcctctgttgcgttgaaaacaccacagaggggcatttgtgcgtttgtaaagaaggtcctgttttcaatataaataaactattatggcagatttaa

SEQ ID NO: 248 - DNA, 306 bp, B.fragilis
accttatgttgcgaaatggtaaaagctaagaaaattttctgtgttgtagcatacgatattcaagatgaccgaagtcgtatacaaatatcaaaaatattagaaaagtatggaacacgtatcaactatagtgtttttgaatgtatgtttacagacagacaatttcagaagatccaaattaatttagaaagatggattaacaggcgttatgatactgtggtatattatccgatgtgcatcaattgctatacaagaattatatatcaacctatacgaaaaaagataattaaaaccgtcgaaatagtctaa

SEQ ID NO: 249 - DNA, 744 bp, B.fragilis
gattgttttaggcaaaaatacgggtttctcttcaaatatttgtacttttgcgaaaaattaaagattatgcgtatcgatattataacggttttgcccgaaatgattgagggctttttcaattgttctattatgaaacgggcccaggacaaaggactcgctgaaattcatattcacaatttacgtgattataccgaagacaagtatcgccgggtggatgactatccatttggaggttttgccggtatggtgatgaagatagaacctattgaacggtgtattaatgccctgaaagcagagcgtgattatgatgaagtgatatttaccacacctgatggagagcagtttgatcagaaaatggctaatagtttgtctttatccggtaatcttatcattttatgcgggcattttaaaggtatcgattatcgcatccgggagcatttgatcacaaaagaaatcagtattggagattatgttttgaccggcggtgaattggctgccgccgttatggcggatgctatcgttcgaattattccgggtgtgatttctgatgaacagtccgccctttctgattctttccaggataatttgttggcggcacctgtttatactcgtccggcagaatataaggggtggaaagtacccgagattctgctttcagggcacgaagcgaagattaaggaatgggaactccaacagtcgttggaacgtactaggagactgcgtccggatctgttggaagattaa

SEQ ID NO: 250 - DNA, 840 bp, B.fragilis
atatttataagtaaaatggcaagagaagctaaaaatgaaccgaaagagttgacagtggaacagaagttgaaagctttgtaccagctgcaaacaacattatctaagattgacgagattaaaacgttgagaggtgaacttccattggaagtacaagaccttgaagacgaaattgccggtctgagtacacgtatcgacaaaatcaagtcggaagtagacgaactcaaatcagctatcgccggtaagagagtggaaattgaagcagccaaagcttcggttgagaaatataaatcacagcaggacaatgttcgtaataaccgcgaatatgacttcctgacaaaagagatcgaattccagtctttggaaatggaactttgcgagaagagaattaaagaatttactgcagaagagcaggagaaatctgaagaaatagagaaaaataccaaagcgctggaagaacgccagaaagacctcgaccagaagaagaatgaactggatgaaatcatcgaagagaccaaacaggaagaagagaagttgagagacaaagcaaaagatctcgagacaaagatagaaccccgcctgcttcaatctttcaagcgcatccgtaaaaattcacgtaacggtttaggtattgtatacgtacagcgtgatgcatgtggtggttgtttcaataaaattccgcctcagagacaactggatatccgttcacgtaaaaaaattatcgtttgcgaatactgtggacgtatcatgattgacccggaactggcaggtgtagaaatagaacacaaagtagaagaagcaccggttaccaccaaaagagctatcagaagaaaagctgaataa

SEQ ID NO: 251 - DNA, 1359 bp, B.fragilis
tatttatcaagccaaaaaatggctgtcgcacggggaaggctatcggcctcttcctgcaattcatcttcttcatcgataggagatatagtagcttctttgtgttgctggcatgaaataataaagaaaaaagagagaagtaacggtaaaaatgccttcattggtttgagtctttataaattaggaggtaaatatattaaaaaatcaataaaagcaaggcaaggtgctatctttttcttatatttgcaggcaaattttctactaaaaatgaaaattaaagaaatagtaagcgcccttgaacggttcgcgcctctgccattgcaagacggatttgataatgccggcctgcaaatcggattgacagatgcggaaacaacaggggctttgttgtgtcttgacgttaccgaagctgtgttggatgaagccatcgcgtccggatgtaatctcattatatcccatcatcctcttatttttaaaggttataaatcaatcaccggtaaagattacgttgaacgatgcattctgaaagcaatcaaaaacgacatcgttatttattcggcccataccaatctggataatgttccgggcggagtcaatttcaagatagccgagaagataggattaaaaaatgtacgtatactcgaccctaaagaaagcagtctgataaaattagtcacatttgttccgtctgcccaggctgaagaagtccgtaatgctttgttcacagcaggatgtggatgtataggcaattatgattcgtgtagttataatacagaaggggagggaactttccgtgcacaggaagggagccatcctttctgcggaacagtgggagaacttcatcgcgaaacagaagtgcggattgaaacgatcctgcctgaatataagaaaggagaagttatccgtgcattgctttccaaacatccatatgaagaaccggcttatgacttatatcctctccacaatagttgggcccaagtcggatcaggaattgtcggtgaattggaagaaccggaatccgaactcgaattcctgaagcgaataaagaaaatattcgaagtcggatgtttgaagcacaacaaacttacaggccgcctgattcagaaagtatccctttgcggaggggcaggagctttccttattccgcaggcagtccgtagcggagctgatgtctttatcacgggtgaaattaaatatcacgactatttcggtcgtgaaactgacattttgcttgctgaaataggacattacgaaagcgaacaatatacaaaagaaattttttattctataatacgggatttatttcctaattttgcactccaatttagtaaggtaaacacgaatcccattaaatatttataa

SEQ ID NO: 252 - DNA, 192 bp, B.fragilis
acatataatggtgaagaacaatgtgaagaattgtgttttcatattcaatgcaaatttgtaaaaggtgatatggaagtcatttgcatgaatatagcactcaattatgcaaatgtgtcaagaagtaaaatgaatcaagaattactcagatttatcgggtacatctcttttaattgcgtatccgtgttaatctga

SEQ ID NO: 253 - DNA, 1191 bp, B.fragilis
gtagcgagtggcatttattactattggtgtagtgtccgttcgctatttatgatttattctttaaaaactaaaaaaatgggaataatggttggtcttcctacttcaggaggcacagagaaagatttgcaattgaactttggtttaactgttaatgatcaagtagagatgttagcccccttcttgcctgcagagtggtttctgcaaagtggtatacaactaacttggccgcatgccgggacagactgggcatatatgttggctgaagttcaggaatgttttataaatatagcccgtgagattgcgaaacgtgaacttttgcttattgtcaccccctatcctgaggaggtgcgtaagcagatcattggtacggtgaatatggataatgtacgtttcctgaagtgcgacacgaatgatacttgggcgcgcgatcatggagcaattactttgatggatacaggtggagcaagtttgctggattttacttttaatggttggggagaaaagtttgaggctcgtttagataatcagataactcgccgggcagtagaagccggtgcactgaaagggcaatataaagattgtctgaattttgtactcgaaggtggttccatcgaaagtgacggagccggtactttgctcacaacttccgaatgtttattgtctccacatcgtaattcgccgatgaatcgtgttgatatagaagaatatctttgcagagtattccatttacaacgggttttatggctcgatcatggatacttatcgggagatgatacggatagccatatagatacattggctcgcttttgttctccggatactattgcgtatgtaaagtgtaccgactctgaagatgaacattacgaggcgctatgcaaaatggaagagcaattgaaaacgttccgcactacatcaggtgctccttatcgtttattggcattgcctatggcagacaaaatagaagtagagggagagagattgcctgcaacgtatgccaattttttgataatgaatgatgttgtactttatccgacttataatcaaccggaaaatgataaattggcgaaagaagtgctgtgtgaggcttttccgacatacgaagtggtaggcattgattgccgtgcacttattaagcagcatggatctttgcattgtgtgacgatgcaatatccgacaggagtgattaaataa

SEQ ID NO: 254 - DNA, 2448 bp, B.fragilis
aaacccggcggaagtagtaaaaacagaataaaaaaatctaataatatgatacaacattattttaaaattgcatgtagaaaccttttaaaatataaggtacagaatatcttaagtattgtaggcttgtctatcggttttacagctttcttgttaggcgggtattggcattactgggaatatcattttgatagtttccaccctcaaagttcaaggacttatgccttgactaccaccggtatatttaaaacagctgacggatctgtaggagaattaaaccagatacatcagatggtggaaaaagatctggttactttccctgaaatagctaaagtttgccatgtcagcaaagtaaaatacgaatttgagaaggatacaaaaagttggatcggaatgaaaatagactccactttctttgatatctttcaatgtaaactgatcgaagggagctattataaggttccatttaacgtaaatcatgtgattctgactcaaaaaatggccaacttctactttggtgacagtagttgcgtagggaaagagttgaaaatcaacgacaaattatcatataccattgcgggagtaatggaaaattatccccaaaacagtgatttcaaatttgaatacctgattctggccactccatcccccaatcaagtcaaaagaaatacgacttatgtatggttacacccttcggccgatgctgcacatctaagtaaaaagatagcagcctacagagtcaaagaacccgataccaaatggagtaaatattctgaatggcgctttcatttgcgtccgttacccgaaattcatacccgctgctctcctgagctgaaaggcaggcttcaacatatccggattttggctacggcgggaatattggcatttgccagtgcattaatgaatctgcttgttctattcattggccagcaacaacgaaaagcacgctataatgccactttttccactctcggtgcttccatctacagtttgatagggaaaaacttacttgaattgaccctccccctgttcatagcatttttgctttcaatggcatttatcgaattcctgtttccgttttataaggattacaccagtttggtagcagagagcagtagctattataatggagtcatccagagtatcacccgacaagaagtactgaaagcatcctattggatttatccgttatgctgcctgatatttctggttttaagtacggttcccatcgtcggtctgctgaaacgaaacagtcggggaacttcgctggcacttagaaacggattgataatcggacaaatcttcatcggctctttattcctcctgacttcttgcatgttctacagtcagtaccgattcatgagccgtacagacaaaggactggtcaccgatcacatctggcagatcgacctcggattcgatgcaacctacaatactgattgtaccccttttatagaagcactaaaacaaaactcagccatcgatgacgtaacggccctgacacagcctctccttgttttaagaggagagtggtattgcagttttatcactcaatttcccatagagggacgtaataatgtagatgaagcaacagaagataattgcatcgttgtgcaaaagaatttcctttcctttttcggaatgaagatgaaagaaggagaatggatacaggatcaggggacaagagatatagttatcaacgaaaccggtgcccgcgaactcaacattccttcactgacaggacgtcttatactcagtgatgacgaagattcggagaatcatgcagtacccaccagaatcagcggtattttacgtgatttctactactgtccgatgcagtacccgctgtcgaaggtcttctttatgtatcaaaacaatgctgatgcagcaagggggtacaatggattcagatatttctatataaaggtacatccggataatgaaaaacaagcactgcaatacgccaggagaatctattctcaatacagcaaaaaagaaatctccgaggatatgcagatcattcaactttccaccttaatggaactgttcaatcgtccggaaaagacgatgttccggatcttcctgttgttggcagtactctgtatcctgatttcttctttcggcgttttcttcctggtatcgctctctaccgaacagcgtaaaaaagaaatagccatccgaaaggtaaacggagcacaattttcagatatcctatacttatttctgaaagaatatttatggctgacactggtcagtaacgcaattgctctgcctttaggatatttatttatcaaaaggtggttggaaacctatgcgtaccatactgatattcacggatggctgtttgtatgtgtattcctcttcacctgcatcatcgttattctctcggtcatgcgacaagtggtagtagctgccaaaatcaatccggcggagtcggtgaaaagtgaataa

SEQ ID NO: 255 - DNA, 1191 bp, B.fragilis
ctattcatgggattattacaagagaagttagctaaatacgacctccctcagcagataaaggctaaaggcgtatatccatactttcgttgtatcgaaagtgaacagaacacagaggtgataatgagtggcagaaaggtgttaatgtttggctcaaactcatacttaggcctgactaatcatccgaaagtaattgaagctgctgttgaagctacccgcaaatatggtacaggttgcgccggatcgcgttttctgaacggtacactcgacctccatcttcaattggagaaagaattggccgaatttgttggtaaagaagatgctatcatttattctaccggatttcaggtaaatctgggtgtggtttcgtgtgtgacaggtcgtgaagattatgtgatctgtgatgaacttgaccacgcttctattgttgaaggacgccgcctttctttttctaccattcttaagttcaagcataacgatatggaatctcttgagaaagagttgcagaaatgtcgtcctgatgcagtgaaactgattgtagtagatggagtattcagtatggagggtgatattgccaatttgcctgagatcgtccgtttgtctaaaaaatatgatgccaatatcatggtagatgaagcgcatggtctgggagttttgggtaatcacggacgcggtacttgtgatcatttcggattgactaaagaggtggatcttatcatgggcacattcagtaagtcattggccgctatcggtggctttattgcagcagacgagtccatcattaattatttgcgtcacaattcacgttcatatatctttagtgcaagtaatacgcctgctgctacagctgccgctcgtgctgcacttcagattatgaaaaacgaaccggaacgtattgagcatttgtgggatataaccaattactctttaaagtgtttccgtgaacttggttttgagatcggacatacctccactcctatcattcctctatatgtacgtgatatggagaagacatttatggtaactaagatgttatttgacgaaggtgtgtttgtaaatccagttgtgcctcccgcatgttctccgaacgatacgttgattcgtttctcgttgatggctacacactctaaagaacagattgattttgctatcggtaagttagtgaaatgtttcaaggcacttgatcttttataa

SEQ ID NO: 256 - DNA, 570 bp, B.fragilis
tttgtttttatgagaaaaagtaatgatataattttttattcgttgttagcattgtgtctatttactaactgtctgtttataggatactactattaccaacaaaacagggaagtactgttggggcaagagttggaacatcagaaaaaacaaaattatgaattaatagttaatcaaatagaatcagggattattccacatgtaatttctgataaaaaagaatttgcaggatattttgtccttgtgtttcctaatggtatttgtgatgtttgtaataaatggttgtttaaacaaatctctgaattatccagtacttcggatttagtggtggttgtccctgataaattgaagaagaatatggaaatctataataccgtttataaacttaagttgtcgtctattttttgttcggaaaagtatgccatgcctcaggaggaatttaaagatatgacatatatattctattgctcaaaaactggaacggttttatatcctttggcacttcatcataaaaatatagacttggacttgtactttaaattagtaaagtcaatagatttagatttcttgtaa

SEQ ID NO: 257 - DNA, 786 bp, B.fragilis
tggaatcttatgaaaacaaagcaagaaatcgtagctaattggctaccccgttacaccaaacgtaacctggaagactttggagagtatatcctgttgactaacttcaacaagtatgtagaaatatttgcagagaaatttaatgttcccattttgggtaaagacgccaatatgatctctgccagtgcagaaggaatcacaatcatcaactttggcatgggaagtcccaatgccgccataattatggatctgctgagtgccatctctccaaaagcctgcctgtttctgggaaaatgtggcggaatcgataaaaaaaataaaataggtgacctgattctgccaattgccgctatccgtggtgaaggtacctcaaacgactatttcccgccggaggttccgtccctgccggcatttatgctgcagcgtgccgtatcatcggctatccgtgactatgctcgcgattattggacaggaacagtctatacaaccaaccgccgtatttgggagcatgatgacacctttaaagagtatctgaaaagaactcgtgcaatggcagttgatatggaaacggcaactctgttcagttgcggttttgccaatcatatcccgaccggagctttactactcgtatccgaccaacctatgattccggaaggagtgaaaactgataaaagcgacaacatcgttaccaaaaactatgtagaggagcatgtagagataggcatcgcctcgctacgaatgatcattgatgaaaagaaaactgtaaaacacctgaaattcgactggtaa

SEQ ID NO: 258 - DNA, 1395 bp, B.fragilis
cagctacttatgaaaacagtccgggaaactatactggagcccataatcaatattgtacaagtcccaaaaatgctacaggatgtgtttcggatcctgatccaacccgcacttgttcatattcaattttttgtaaaaaataatagttacttgttcaaatgttaccggaagaggtgttttcctcttccggtttattctaataatatgttagttatgaagtacttgaatttgtttatattcgtgttgttgttggcaggatgtaatcgacctgttaaacactccgatattatccaagccgatactatggtaagtatcataccccaagaggatactatcacattatctgctctcttttctagatgtgaaattgtaaaattgaatgatattgttttagcgtcaataaataaagtatttaaatacgattctttgtggattgtgcaaggaaagtctgatcagggtggggtccatttgtttaataatgaaggccgatatttaaaaaccgttttgaaatgggggcagggacctgaagaagcatatgatatttggagtattaaactattagatggatctatctatttattgattaattctggaacagaagttgtggaatattctttgcagaaacaaaaaatggtagagcgctttcggctaccgtctgagatactttcagctacagattttgttgttgataatggtggaaattatatattcttaaaatcgatctcccgagagaaaaaaaaggaagagtataaactttatgtgtataataagaaagaggggacaatcgtaaatagaatattgaatatggataaaaagtctagtgagtatatttcttttgatcaaagtgattgtttatatcgtgttcaggatgaaatctattattacgaggtttttagaaatggtatttgtcggttatctgctaatgatatgactggatacatcgcttttaaacaaaatgaatatacttttccggaaaaagaactttataatgaagatcatacatttcagtcttttatagatgtttgtgaaaatagtccttttatttgggcgcatcgtaatttatttgaaggagagcgctttgtgagttctacttatatgtataaaaaagaactgttttggaatattatagataaatctgattatagcgtacattcatataaatgggtatatgatgacttgatattaaatgaggttgtccctgttgaagattatttatatcgtgctaatgttcaggagaatatccattattatacattgtctttttacgattttgatagaattatgcagttgaaaaagaagtgtaaaaaaagcgtaggagaaaagtggatggtaaaactagatgatatgttagatgaaaattcaaatgatataatagtttgtttttatgagaaaaagtaa

SEQ ID NO: 259 - DNA, 1416 bp, B.fragilis
cctaagcttatgaaactacgaataggaagtatcacgttcttgctgtttctttcatccgttgcctttccacaggccacgagccgctatctggacaaaccattaccacaaggatgggaagaagatacacaaatatttcagcaagtattgccagtggacgaccaatggtggaaagcatttcaggaccccgttctcgactcactcatctccgttgcagtcaagcagaattattcggtactgactgcgattgatcgtatcaatatggcaaaagccaacttaagaatggaacgtggaaattttttcccaacaatcgggttgaatgccggatggacccgccagcaaagcagtggcaacaccagtgacttgccacaatcgactcaacattattatgatgcctcgctcaatatgagctgggagttagacctctttggaagcatacgcaatcgcgtaaaagcccagaaagagaactttgcggccagtaaagaagaatataccggcacaatgatatcactttgtgcccaggtagcctcagcatacatcaacctgcgggagttgcaacaagaattggccgtagtgcaaaagaactgtgcatcccaagaggcggtattaaaaattacagaagtaagatacaacaccggactcgtatctaaactggatgtggcacaggctaagtcggtgttcttcagtaccaaagcatcgattcctcaaatcgaatcgggcattaatcaatacattacgacccttgccatactattgggtacttatccccaggaagtgcggccagctctaaccgctcccggaacattaccggactatatggaacctatcggagtggggcttccggccgatttgttacttcgccgcccggacatacgcagtgccgaacgaagcgtcaatgcacaagccgctttagtaggagcgtctaagtcggactggttgcctcaggtctttctaaaaggatcggttggttatgcagcaaaggacctgaaagacctgacccatcataaaagtatgacctatgaaattgctccggcactgagttggacgctttttaaaggaactcaactagtgaatgctaccaaattggccaaagcacaattggacgaagctatcaaccagttcaatcagacagtattgaccgccgtacaagagacagacaacgctatgaacgcttaccggaattctatcaagcaaatagtagctttgcgcgaagtgcgcaatcagggacaagagaccctgactctctcgctggaactttacaaacaaggattgaccccattccagaacgtactggatgcccaacgctcactgctcagttatgaaaaccagctggttcaagccagaggatattctctgctgcaactgatagctatgtaccaggcattgggaggcggatggtccggaaacctgaataattaa

SEQ ID NO: 260 - DNA, 408 bp, B.fragilis
aataacattatggcacatcgtcttaacactaacaagcaatttatggtaggaaacggcattttggcatttgccgtcatatttgtcgtggtcatctttgtatatatgagtttaagattacaacgagaaaaagaagctaatcgtcattttagtgaaacatactccattcagttgacaaaaggcttcgtgggtgattctatttcactgtttgttaacgacagtctgatcatgaataaacagatcaaagaggaacctactgccatcgaagtcgaacgcttcgcagagcaaagtgcactgatgattgtaaacaatcaaactgaaacagtagccgcatttgacctaagtgaaaaaggaggtacttaccgttttgaaaaggatattgacggtatcaaacagctgccacaaaaatga

SEQ ID NO: 261 - DNA, 192 bp, B.fragilis
aagttgattatctggttgtcagtaatgggatgcaacactattgttgccggatggattatgatactcaaagttattcgtttctgtcggatattccggattatgacgctttataaaattaacaatgttaatgactctttccggcatctattatcctctttccaggaagttaatatcgtaaatgcaagaagttaa

SEQ ID NO: 262 - DNA, 459 bp, B.fragilis
tgttattctattctttttataatatccgtgataaagatagtgatttgttttattcattacaagaataacgatacctttgctgaaattaactgtgaaaaacgaatggtaatgtcttgggggaaaacaattctcggttgtttgattggagggtatgcccttcttggtttgttaggggggaactatgcatatgaacaagaagtaaaggcattgcatgtatatgcggatagtgtttttcatgaagcttttcatgtagaattgcaaaaacgaggtatggatcaagtggaaagttggagatatggatgtgaagactctttcgtctcttcagtggatacagccttcaaaaaagttactatacaggacgagtacggtacgtatagttttcgggttgatgcaatgaagattcgcaaaaatatcgtgtcttcccctggagagcaaggactgcatactgttgttgtttaa

SEQ ID NO: 263 - DNA, 378 bp, B.fragilis
gctatgaatatagaagaatttagagaatattgcctttcatttaaaggtgtgcatgaccggatgccctttaaaaaagcaacatctgaatatgatagagatttactcgtcttttatgtaatggataaatggttctgttttgtgaatatagacgcattcgatttctgtaatataaaatgtaatgccggacagatagaggatttgctagacaaatatgaaggagtacaaccgggctatcacatgaataaaaagcattggattagtgtctattttgataaagacgttccggataaaatgattaaggacctggtaaagcaatcgtatgaaattgttgtatcttctttggcgagacgagagagggaaatattacaagctatgtaa

SEQ ID NO: 264 - DNA, 744 bp, B.fragilis
acatcgattttcttgcttttctgctttttattaccgaatattgctatcattacaaccataacaattacaaatgatatgaaaaacacacatgtacttcttataaaatttaaaaataaaatatctgatgatgaagttcaattctttagaagttcaattatacaaaaactgggtgaccagccagatatattataccacaatcatgtagagaaaaataaatatcgctactcttatcccttaatacaatacaagaatatcgaacaacaagcaacaatcgtatgtattgatcaaggaacaaaagcaattgagaaattcttttcacaatgtgatttcaactttcaactgggaaatagaaaagtcaatatgaagtttgcctctgtaactccttacaaactattgattgaacgacaatcaaaaatgataaattatcatattcataactggttgcctttaaattcggataactacaaaaagtatcaaaatattagcattctttcagaaagaattaattttctggaaaagattttgataggtaatatattatcatttacaaaaggagtcaattattttattgactttccactacaatgtaaactccttcaacttagttttgccaaactaatatctaataaaaatattaaattaatgtcgtttgatgcagatttccaatgtaatctaaatcttccggattatattggaataggcaaacatacaagcattggatatggtacgataactcgaaactaa

SEQ ID NO: 265 - DNA, 1152 bp, B.fragilis
agacttgtcataatgaaaaaactaatgtatattttcctcatcctccctttgataatgagcggatgtaaagggaaaaaagaaaccgaaagaggagggatgcctactccggaaatcagtgtggcatatccactcgtacaaaacattaccctaacaaaagattatccgggatatctgactaccgaacaaacagtaaatctggtagccagagtcaacggtgccttgcagtccgcctctttcacaccgggaactcgtgtgaagcaggggcaactcttattcgtaatcgaaccaacgatctacaaagataatgtaactcaagccgaagcccaactgaaaaccgcacttgcacagttggaatatgcccgtaacaactatagccgcatgaaagaggctctaaaaagtgatgcggtcagccgtatacaagtattacaagctgaatcgaatgtagccgaagccactgcagcagtcagcaatgccgaagccactctgaatactgcacacaccaatctgggctattgctatatccgtgcccctttcaacggaactgtcagccgctcgctttacgatgtgggcagctatatcagcggagccgcacaacctgtcactttggctacgatctataaagacgaccgcatgtacacctattttaatgttgccgacaaccaatggctttcaatgctactctctcaaaacggtaaagaaaaggaactccccaaaaatgtcatcgtgcgcctgggtgagaacggcacacaaaactatccggccacattggattatttatcgcccaatgtcgacttgaacacaggaacactcaacgtgcgcgccaatctggataatccgaaaggtattctgaaaagcggactatacgtcagtatcacattgccttatgccgaggcaaaacaagcagtgcttgttccggaagcttccatcggtacagatcagttggggaaatacctatacatcgtaaacgattcgaatatagtacgctacaggcatatcgaaccgggacaactggtcaatgacacattgcgccagataaagagcggactttcacccaaagaacaatatgtcaccacagcactgatgaaagtacgtgatggcatgaaagtcaagcccgtatcagtcaatcacgagtcaccaacctctaatcgttaa

SEQ ID NO: 266 - DNA, 1239 bp, B.fragilis
cacatttgcataattgagtgctatattcatgcaaatgacttccatatcaccttttacaaatttgcattgaatatgaaaacacaattcttcacattgttcttcaccattatatgtttatcactccaagcacaacaaccctgtattattgaaggaaacatcaatgggattcctgatgggaccgttatcagtatgatgcgtcaacagggaacaggtatgaaacgaattgccaacgatacaatcgataatggaaagtttaagttcattatacatactcttaataatcagactgaagctttgagaatagtaagtaaaggagaaggctttcccaatacatggctggacgtatatgcctctccgggagaaacggtatccatcatcggcagtgataaactactccgtacatggaatatagtaagtaacatcaaagagcagcaagaagaaaatcaatacacaaatgagggtttccgcaatttgacagaccaaagacaacgattacaagctttatcatcagatatgtggaaaaagatagctatatcggattcacctaaagagaaaatacaaatgacggacagcatccaaaatatactgtatccccaactagactccctcgagctgttactgtccaaagaagaaatcaatttaatgaagaatcttcctgttacctctatttggctagatcatttggaagcattaagccgtcaatctgtctatctaaaaggctttcctatctcagaagctcaagtattgtatcagcaactaacatcaacacaacgcaactcacaaataggaaaaaagatagaagcttgtttaacgcctacaaaagctaagataggtgatgacatgccggataccgagctgtcaaatatcgatggaaaccaccaccgtctatccgattataaaggaaaataccttttacttgatttttggagcagaagttgtggacactgtattgaatcacttcctgagatggaaatcttatccgatatgtggaaagaaaaagtaacttttatcggtataaatattgatgatgagaaatcatggaaagaattctctcaaagaaagaatatcaaatggatcgacctaaatgatcccaaaggggcattcggattgtatatccgttacaaagcaaatggcactcccttttatgtacttgtaacgcctgatggaaaaattactgatatttggtacggatataataaagatagcctctccgaaagactgaaacaagggataaaataa

SEQ ID NO: 267 - DNA, 636 bp, B.fragilis
atatactgcatgaaacagcttattgatttagaaaattggaatagaaaagaacattttaaattcttttctgcttttgacgacccattctttgggatcactactttggtcgattttacgaatacctaccatcaaagcaaggatgagaaaaagtctttctttttgtactctgtacattttctgctgcaatgtgtaaatgaagtagaggcttttaaattacgcattgaaggcgaacaagtagtgaaatatgattttatccatttatcacctaccataggacgtgaagatggaacattcggtttcggttttttcgaatacgatgcagaccttgaagtatttatacaaaatgctgaaaaagaaatagaaagagtgaaaaacagtactggcctgtctttttccgaaaatataggccggttagatcttatccgctattcggctttgccttggttcgcattttcagagatgaaacatgctgtttcttttggcagaggtgattctgtaccgcgcatttccactggaaaattaataaaagagaatggtgtatacctgcttccaatttcaatttccggtcatcacgctcttatggatgggcgtaatgtggcagaacttatcgagaagttagaaacaacaaagaaataa

SEQ ID NO: 268 - DNA, 432 bp, B.fragilis
accgtcttaatccttattatactggaatacatctacatattgatgttatggagtgtcttgtgtcaaaggggaagaagtcttaatccttattatactggaatacatctacataaagacgaaaacggatattacatcaaaagtgttacacgtcttaatccttattatactggaatacatctacatctaaacagggcggcgaagaagttgaactgcttttgtcttaatccttattatactggaatacatctacatgaaaaggagaaggatgaggttggtgaaatgacaagtcttaatccttattatactggaatacatctacattgtttgtgttccatccgtgaagaaggctatcggcgtcttaatccttattatactggaatacatctacatattacttgtttgggcagttatctgtcttgtatcgtgtcttaa

SEQ ID NO: 269 - DNA, 285 bp, B.fragilis
caagtcttaatccttattatactggaatacatctacattgtttgtgttccatccgtgaagaaggctatcggcgtcttaatccttattatactggaatacatctacatattacttgtttgggcagttatctgtcttgtatcgtgtcttaatccttattatactggaatacatctacatgttacaatcaacaatcaggatatgggccttggtgtcttaatccttattatactggaatacatctacatgaacagtgacatcctttaccggacgccacacgtgtcttaa

SEQ ID NO: 270 - DNA, 420 bp, B.fragilis
aagctagaaatgaaaatcagtaagaagcaaattgagtacgctattgaagcactcagagcgaacaatattatcaccaacgacaatcaatatcccaaggtctttaagggatatatctcttcgtttggagcagctgtcatccaatccggcctgattccggctattatattctttgaaaacgaagataatgatgccaacgctgacagacataaaatcattggagttttaaaagatatcatcaatgctatgcgtcagcaatatactgtaaccgatgcaaccatacttgtgtcaagtcagattcctgcaaattattctatggcacagtatatcatagaacatggaaacactgatcaactgctaaaagagataacagaagcagctgttgccatgaaattagcattaagaatgtacaaaagtgaatga

SEQ ID NO: 271 - DNA, 2250 bp, B.fragilis
aacgaagaaatcaatatatctatgatactacattatttaaagattgttttcaggcagatggctaaacgcaaagtacaaactgctatatctatattgggaatcactgccggtttgctctgtttcagtgtatgcaactattataatcgtattttcagtacaggtaacaaggatttggcaacttacgaaaatcaagcagaaatatgcataaaagaaagatcttaccaagtaaatattccgatagaggattttgaaaagaaaataggtaaagacaaatttgaagcagttgctttttatgtaaattcttcatctacaatcacattagatgaaacgatatattgtaaagtggacaaaacagaatgtaatgctgattatttcaaagtatttcctacagaatgtatagacggctccttaaaacagtttggtatttcgggtaacgaagctgtagtaacgactgagtttgtcaaacaattctgtggaggcgtcccgccgctgggaaaaacgatccttaaccagagaggcaaaatacataccattattgccgttatcaagccctatccggcagggatgaataattatcacagcagctacgatgtttttcttccactacctgaaaatgcttcatttgggatacacaaactactgctcaaacgcccggaagatgccgaacacatttcacaattactgcctaaattgggactttttcccaaccatccggaatggataccacaaatagtgctggatagccagacagaacataaggcaggcgctgaattatgggtggctattttggggctattggtcttattggtaggcatgatcaactatttctcattcagtataggagcatttgccaaccgttacaaagagatcagtctacgtaatacgctgggttctacttactggggacttttcatattgctattccttgaacaggctgtcatcatcctgatctgtggaataattaccctggccattactgagagcttgctaccttggtttataagtacattttctaatgaaatacaaagaaacttatacatagatatacatcgattgtgggtttatgaatgtcaatatataggaggcttgttgcttatcagcttactgatctcattcatctcttcctggcacattgcccataagacaatagcgcaaggattgaggggggggacaactaccggacaacgtcacataatccgtaacacgttactgagcgtccagctactcttctcttttctattcattgtaggtacagtcggcatccgtatgcaaatgaaagaatacgatctctcagccaatcccaatctgagcacagaggtaaaaaaagaaattatggtagtaaatataggcagatacgatcgtattcgagagcatcaaccggaactgataaacttcctgcgctcacgccgttggaatgccgaaacagcctacactaacagggattacagccaagagtatggatttaccgaactctgcttcgtttcggatgattattttaatttaatgaacatcaaatgccatcacaaaccgggagaacctttttgttacgtaaacgaacaattataccaaactttgcaagcagattctacctccgagtcttttcgttttcaaaaccaagtatatccggttaaaggtttagtccatataggtcccgattctccaagtgcaaagcaattggctcttttaccactttctgccatgaatgacgaaatcgggaaaatatatatacgattggtccctgatgctcctcgcaaggaagtaaaagcagaaatgagcaaggagatgaatcaatatctaccacagaacgaacctttcgagttcatcagtttatatgaggaacaaaccggattaggaactatctcggtgatgtggctgttcgttgtctgctcttccatttgcttagtgattacggtacttggcgtttatggagctatcagcattgacactatccgtaaacaaaaagaagttgccatccgtaaaattaatggtgcacgtttaccggacatctattggttgtttgctaaaaactacctgattttatttttaatagcttcggtagtaggaggtttaattagcctcttcgtcatggtcatcggcagccagcatcgagtcatattgtttgattatgccgatccatggctttggatgggtcccctcatgctattaataggcataataacagctacaatcagctggcaaatatattatattgcacggactaatccggcagaagtaattaaaaacgaataa

SEQ ID NO: 272 - DNA, 426 bp, B.fragilis
tgttgcggaattaaggataaatatctgcgttccgaaagtgcgttgatgaccctgttggggatcgtttctatcgtatgcgtcattatctctattttcggcatcttttcgcaagtaactttgtcgtgcgaacaaagacgcaaagagatcgctatccgcaaagtgaatggagccaccataggaagtatcctgcagatgttcatcaaagaatatttcgtccttttgcttgtcgcggctcttatagcattcccggcaagctatggaatgatgagagtgtggatagaaagttacgtcagacaaacttccaccccattttggatatatatcgtcctgtttgcaggtatcggtatcatcatcgtcatcagcatcttctggagagtgtggaatgcagccaaacaaaatccggcggaagtagtaaaaacagaataa

SEQ ID NO: 273 - DNA, 996 bp, B.fragilis
cctttattgatacgtatgaaaataacttttggacaacaaacgaccaaagtaaagcaactggctgataagatcagttttgatatctcgatgggagtatataaatcgggagactcattgccttctattaatcagctcagtcaggcgtatgaagtttcccgtgatactgtgtttaaagcttttcttgatttaaaagaaagagggattattgattctactccgggaaaagggtattacgttgtggggagattgaagaatgtattgcttctgcttgatgaatattctccttttaaatatgcactttacaatagttttgtaaagcgtttgtctatccgctataaagtcgacctgctgtttcatcaatacaatgaacgtttgttcaataccatcatccgtgaatcgttggggcggtataataaatatattgtgatgaacttcgataacgaaaaactgtctcctaatctttataaaataaatccatctaaacttcttcttcttgatttcggtaaatttgagaaagagggattttcttatgtttgtcaggactttgatcaaggattctataatgcgctatttcaactggcagatcgattgagaaaatatcaaaaactcgttttcgtgttagtagatgatagtatgcatccccggagtagccgtgacttttttgagagattttgtgccgatcaacatcttggttgtgaagtggtgagtgatattgagggacttcaggttcgcagaggagaagtttatatagcaattcgccaaatagatgtagtaagtattattaagaaaagtagggttgagggattgcaatgtggggttgattttggcttgatcggatataatgatacacctgcttatgaagtgatagatcagggaataactgcactaagtgtggattgggaaaagatgggagataaagctgctgagtttgttttgcaggggaaaaccatacaagattacttgcctacggaggtcaggttaagggcttctttataa

SEQ ID NO: 274 - DNA, 687 bp, B.fragilis
aaaattacgattatgattaagacaatcaatttgcaaaaaatcttcaagaccgaagaagttgaaacatgggcattaaataacgtcagcgtagaggtaaaagagggcgaatttgtcgccatcatgggaccttccggttgtggaaaatctactcttctcaatattctcggtttactggataatcctacaggaggagagtattatctgaacggaaaagaagtatccaaatatacagaatcgcagcgcaccaatctccgcaaaggagttattggctttgtattccaaagtttcaatctgattgatgaactgaatgtatatgaaaatattgaattgcccttactctacatgggtattccggcctctgaacgtaaacaacgagtggaaaaagcaatggagcgcatggccattacccatagaagcaagcattttccacaacagctttccggaggtcagcaacaacgtgttgccattgcacgcgccgtagtagccaaccctaaactgattcttgccgatgaacctaccggtaatcttgactctaaaaatggtaaagaggttatgggactattgagcgaattgaataaggaaggcactaccatcgttatggtaactcactctcagcatgatgcaggtttcgcagaccgggtaattaatttattcgatggtcaagttgtaacagaagttactatttaa

SEQ ID NO: 275 - DNA, 630 bp, B.fragilis
agatacacgatgttacaaatagacaatgcatgcattgctttcggcgaggatatactcttctcggaattttgtatgcgactaaataaaggcgagacagcttgcatagcaggtcaatcaggacgtggaaaaacctctctactcaatgcaatcatgggatttgtcccattaagaaaaggcaaaatcaaagtaggaggtatcttgcttgaacctactactatcgatgccatacgcagacatatagcttggattccacaggagttagccctgccctccgaatgggtaaaagaaatgatatcgcttccttttgcattgaaagccaatcgacacatctctttttcaaaagaaaagcttttcacttgttttgatgaattaggactggacaaagagctctatcagaaacgggtaggcgaaatatcgggtggtcagcgccagcgcattatgatagccgttgcagccatgctggaaaaacctttgattattgtagatgaaccgacatctgcactcgatgccggttccacagacaaagttttagctttcttccgtaatcaggcagaaaagggaacggctatactcgccgtttctcatgaccggacattcgcttacggatgtaaccagctaatcacactgtag

SEQ ID NO: 276 - DNA, 513 bp, B.fragilis
acgctttacttttgtgaatcaactaataagtcatacatttgtaaatcttcaaaggatatggaaataaaagataggattaaaattatcatggaaaaagagaatatggcttccggtgctttcgccgaaagcataggtattcagcaatccactctctctcatattttgaatgggcggaacaaccccagtttggatgttattatgaaagtacatcagaaatataactatgtaaaattggaatggctgttgtatgggcaaggcaatatatccgaagaaagcatccaatcagcttctgattttcaaccttccttatttgctgagaatgccataattccgcccaacgggacagttactccggaaaatcgcagggaaatgccgttagaaagttcccaaaacaccccgaaagagattgtaaaacaagaaattagatacatagaaaagccttccagaaaaataactgaaataagaattttcttcgatgataatacgtatgagacattcagaggagaaaaataa

SEQ ID NO: 277 - DNA, 189 bp, B.fragilis
tttatttttgtgaaatatcctccgtcaatgaatattcctattgatgtgatagattcaatcatttttggtcttttttgtattagtttcgagttatcgtaccatatccaatgcttgtatgtttgcctattccaatataatccggaagatttagattacattggaaatctgcatcaaacgacattaatttaa

SEQ ID NO: 278 - DNA, 2061 bp, B.fragilis
aaaatatacgttattatgcaaaaaggtaatattggggttacaacagagaacattttccctatcatcaaaaagtttttgtacagtgaccatgaaatcttcctgcgggaattagtatccaatgccgttgatgccactcagaagttgaatacattggcttctatcagtgaatttaagggcgaactgggtgatttgaccgttcacgtttcattaggcaaagacaccattaccatctccgatcgtggtatcggtttgactgctgaagagattgataaatatatcaaccagattgccttttcgggagctaacgatttccttgaaaaatataaaaacgatgcgaatgccatcattggacacttcggacttgggttctactctgcattcatggtttccaagaaggttgaaattatcaccaaatcatataaagaaggtgcacaggccgtaaaatggacttgcgacggtagtccggagtttacacttgaagaggtggagaaagcggatcgtggtacagatatcgtattgtatattgatgatgattgcaaggagtttctcgaggagtcacgcatctctgccctcctgaagaaatattgcagcttcctgcccgttcccatcgcttttggtaaaaagaaagagtggaaagacggcaaacaagtagagacggcggaagataatgtcatcaatgacaccattcctttgtggacaaagaaaccgagtgaattgtcggacgaagattataaaaaattctatcgtgagctttatccgatgtcagacgaacctttgttctggattcatttgaatgtagactatccgttccatctgaccggtatcctctacttcccgaaggtaaagagcaatattgatttgaataagaataagattcagttgtattgtaatcaggtttatgttacggattctgtagaaggtattgttccggatttccttactctgctccatggtgtgctcgattcaccggatattcctttgaatgtatcccgttcttacctgcaaagtgattcgaacgtgaagaagatctctacctatatttcgaaaaaggtatcagaccgtctgcaatctatctttaagaatgatcgcgctcagttcgaagagaagtggaatgatttaaaaatctttattaattatggaatgctcactcaagaggatttctatgataaagcacaaaaattcgcccttttcaccgatacggatggcaaacattacacctttgaggagtaccagactttgattaaagataatcagacagataaagataaaaacctgatctatctgtatgccaataataaggacgaacagtttgcctatatcgaagctgccaaaaataaaggttacaatgtgctgttgatggacgggcaactggatgtggccatggtaagtatgctcgaacagaaactggagaaatctcgcttcacccgtgtagacagtgatgttgtcgacaacctgattgtgaaagaagataagaagagcgatgtgcttgaggcttcaaaacaagaagctctgtcagcagccttcaagagtcagttgccgaaaatggaaaaggttgaatttaatgtcatgactcaggctttaggcgaaaacggctctcccgtgatgataacccagagcgaatatatgcgccgtatgaaggaaatggccaatattcaggctggcatgagtttctatggtgaaatgcccgatatgtttaatctggtattgaattcagaccataaattggtgaaagaagtattggctgatgaagaaaaagagtgcagtgctgccattgctcctatacagacggaactggaagatgtgacaaaacgtcgtgatgcactcaagaaaaaacaagaaggcaagaaagacgaagatatccctactgcggagaaagatgaactcaatgatctggataagaaatgggatgagttgaagcagcagaaagattctatttttgccggatatgcaggcaaaaacaaagtggtacgtcagttgatcgatctggcattgttgcaaaacaatatgctgaaaggtgaagcattaaataactttgtaaaaagaagcattgagctgatttaa

SEQ ID NO: 279 - DNA, 402 bp, B.fragilis
aatcactcagtaaaaaaggagtgggaactatcaagaatatctaatataacaaatcagaagagcatgaaaaaatatatactatcgagtcttacaattacttttttgttactcagcatcacagcctgttcgcaaggaaagcaaatcagtggaagttccaactacatcactaaaaatataaaagtcggttcattcgaccaaataaaatcgatgagtagttcagatattgtttatacacaaaaacagggcgcccccaccgttcagatttatggtcccgacaatatagttgaattgatggaaacctctgtcagcggtcgaacattaacgattaaattcaaaaagaatacctccatccgtaatagtgggaaactcgagatcagagtatcttctccatcattaacctaa

SEQ ID NO: 280 - DNA, 912 bp, B.fragilis
agattattattaatactcatgatacagactagattgaaaggaatgggggtagcgctgattactcctttcaaagaggatgaaagcgttgattacgatgcgttaatgcgactggtagactatctgctgcaaaataatgcagattttctgtgtgtgctgggaactacagccgaaactccgaccttgagtgaagaagaaaaaaagaaaatcaaaaagatggtaatcgaccgtgtcaacggaagaatccccatcctgctgggagtcggaagtaacaatacacgcgcagttgtagagacactcaaaaacgacgatttcaccggagtagatgctatcttatccgttgtcccttactacaataaaccctcacaagaaggaatttatcagcactataaagcaattgcaagcgctacagagcttcccatcgtattatataatgttccgggacgtacaggagttaatatgaccgcagagaccactttgcgcattgctaaggactttcagaatgttatagccattaaagaggcttctggtaatatcacccagatggatgatatcattaaaaacaaaccggctaactttgacgttatttccggagatgacggtattactttcccgctgattacattgggagccgtaggagtcatttcggttattggaaacgcctttccacgtgaattcagcagaatgacccgtttggcgctgcagggcgactttgccaatgcactaaccatacaccataaatttacggaactgtttaacctcttatttgtagacggaaacccagccggagtaaaatccatgttgaacgctatgggaatgatcgagaataaactccgtttaccattagtaccgacacgcatcaccacatttgaagcgattcgtaaagtactcaatgaactgaatataaaatgttaa

SEQ ID NO: 281 - DNA, 2236 bp, B.fragilis
  unsure (16): Identity of nucleotide sequences at the above locations are unknown.
ggatgcattcttacanccccgtggtgaatacgtactgctggccatccttaaagataaggataatctggcagcaacggttcttgaagcgaatcatgtgaattaccagcaggtattcgaacaattgtccttacagccggatatcagtgccggcatgggatttacagaagatgatgatgacgaagaagagatgaatcagtcccgttcgtcccatggatccggtgaacgtcagcaacaggcgcagactgcctccaggaagccgactaatgatactccggtgcttgataattttggtactgatatgactaaggccgccgaggaaggccgtcttgaccctgtggtgggacgtgagcgggaaatcgagcgcctggcacagatattaagtcgccgtaagaagaataaccccattttgatcggtgaaccgggagtcggaaaatcggccatagtggaaggtctggcacttcgtattatacagaaaaaggtgtcccgtattctgtttgacaagcgtgtggttgcactcgatatgactgcggttgttgccggtaccaagtaccgtggacagtttgaggaacgcattcgttccatcttgaacgaattgcagaagaatccgaatgtgattctgttcattgacgagatacataccattgtaggtgccggatcggcagccggatcgatggatgctgccaacatgttgaagccggcattggcgcgtggagagattcagtgtatcggtgccactacccttgacgaatatcggaagaatatcgaaaaagacggggcgttggagcgtcgtttccagaaggtaatggtagagcctactacagctgacgaaacgttgcagattcttcgtaatattaaggataaatatgaagatcatcacaacgtaaattatacggatgcggcattggaagcttgtgtcaagttgacagaccgttatataaccgaccgtaacttcccggataaagctattgatgcactcgatgaagccggttcgcgtgtacatcttaccaatgtgagtgtacccaaggaaatagaagatcaggagaagttgatcgaagaagctaaaaataacaagaacgaggctgtcaaatcacagaatttcgaacttgctgccagttttcgcgataaggaaaaagaacttgctgtccagttggatgtgatgaagaaagactgggaggaacgtttgaaggataatcgtgagacggtggatgaggaagaaatcgcaaatgtcgtatcaatgatgtccggcattccggtacagcgtatggcacaggcggaaggcatcaagttggcaggcatgaaagaagacctgcaatcaaaggtgatagctcaggacgatgctatcaaaaagctggtcaaggccattctgcgcagccgtgtcggactgaaagatccgaataaaccgattggtacatttatgttcctaggccctaccggcgttggtaaaactcatttggccaaggaattggctaaatatatgtttggttcttcggatgcattgatccgtatcgatatgagtgagtttatggagaaattcacagtctcacgcttggttggagcgcctccgggatacgtaggatacgaggaaggcggacaattgacagagaaagtacgccgtaaaccctattctatcgtattgcttgacgaaatagaaaaggcgcatcccgatgtgttcaatctgcttctccaggtgatggacgaaggtcggctgactgacagttatggcagaatggttgacttcaagaatactgttattatcatgacatcgaatatcggaacccgccagttgaaagagtttgggcgtggagtcggttttgccactcaaagccgtcttgacgataaagaattctctcgcagcgtgattcagaaggctctgaataaatcgtttgcacccgaatttataaatcgtgttgacgaaatcatcacctttgaccagttgtcattagaagctataacgaagattatcgatattgagttgaaaggactgtataacagaatcgaatctatcggctataaactggtcattgaagacaaggctaaacagtttgtcgcttcaaaaggctatgatgtccagtacggtgcacgtccgctgaagcgtgccatccagacctatctggaagacggcttatcggaacttatcatttcggctgatctgaatgaaggagatacgatcactgtctctttgaatgaagaaaagggtgagttggaaatgaagaatgaagccaaaacggctgaataa

SEQ ID NO: 282 - DNA, 717 bp, B.fragilis
tctaaatcttccggattatattggaataggcaaacatacaagcattggatatggtacgataactcgaaactaatacaaaaaagaccaaaaatgattgaatctatcacatcaataggaatattcattgacggaggatatttcacaaaaataaatcaggctcttgaggaaaaattgtcactgaatatcgacataacctttttctttaaatttataaaagagaaaatagcctatgaatataatttaaacactgaattctgtcaaataacagaaagtcattatttccgtggacggtatcgtgttaacgatgctaataacaaacatttgttattcagtgaacgtaagtttgaagattcactaattgaaaatgatgtcatttttcattacaagcatttacgtgaaatacaaaaggaaggtgaaattaacgttatagagaaaggcattgatgtatggttcgctcttgaagcatacgagttatcactctttcgaaaatttgattttgttattctgattacaggtgacgccgatcacgaaatgttaataaaaaaattaaaagctctcaaaatccatacaattcttttaacatgggatttatctccagaatctgcaactgcacggctgttgcgggaagaagcatgtaaacatatagaattaagtgaaatcgctatagaagataaggatctaataaaaaagatatgcagaagcaagcaaaagagataa

SEQ ID NO: 283 - DNA, 771 bp, B.fragilis
aaaattatgtctgaaaatataagagtaagcgaagtatccgacattctgcggcagcagcttgaagggatcgagaccaaagtgcagcttgacgaaataggtacggtgctacaggtaagcgatggtgtagtgcgtatttatggtctacgcaatgccgaggccaacgaactacttgaatttgacaatggtatcaaggccattgtgatgaacttggaagaagataatgtaggtgccgtgttgctgggaccgacggataaaatcaaggagggatttacggtgaaacgtaccaagcgaattgcttctatccgtgtgggagaaagtatgttgggacgcgttatcgacccgttgggtgaaccattggatggaaaagggctgataggaggtgaactttatgaaatgccgctggagcgtaaagctcccggggtcatctatcgtcagccggtgaatcaacctttgcaaacgggtctgaaggctgttgatgcaatgatccctatcggtcgtggacagcgtgagttgataatcggtgaccgacagacgggtaagacatcgatagccattgatacgatcatcaatcagcgaagtaattatgaagcaggtgatcctgtatattggatttatgtaactatcggacaaaaaggttccacggtagcttctatcgtaaacaccttacgccaatatggggcgatggattatactattgtggtggcggctacagctggagacccggctgcattgcaatattttgctccgtttggcgggggctgccatcggtga

SEQ ID NO: 284 - DNA, 798 bp, B.fragilis
aaaggagctttatctatggagttgcgtactgtcaatgtcactcgttatattatgcctctgcgtgaaggtggttcactgcctgcattggcagaagctgatgacagttttaagtatgttgtcaagtttcggggagcgggacatggaaccaaggcattaattgcagaactgattggcggtgaggttgcacgagtattaggctttcgtgtaccggagttagtgtttttgaatttagatgaagctttcggacgttcggagggtgacgaagagatacaggatttattgcaaggaagccgcggattaaatatgggactacattttctctcaggggctctaccattcgatccggttgtcactgaagttgatgaaaaactggcatcacaggtggtatggttagatgctttattgactaatgtagatcgtacagtgaagaataccaatatgcttatgtggcataaagagttgtggttgatagatcatggtgcatctctattttttcatcattcatgggtcaattggcataaacatgcacttagttcttttacccaagttaaagaccatgccttattgccgcttgccggtaagttggacgaagtggatgccgaatttcggaaattactgacttcggaaaaaatacgtgaaatagtggatctgattcctgatagctggatagagtggcgtgataaagatgaaactcctcaagatattcgtgatatctattatcgatttttgaaagaaaggattgaacattctgaaatatttgtaaaagaagcacaacatgccagaaaagcatatttatga

SEQ ID NO: 285 - DNA, 441 bp, B.fragilis
tctgtttttactatgaatatgagcatcacaaaacgcaattttctgggttatctcagcatccttactcttgtagggggaggattgggagccttggtcttgcattatctggaacccggacattatttcggaggttatccgttgataccggtgtacttttatatattcggtgtattttatatttatatgtttgatgcctgcaggcgtcatgcaccggagaagatggtgatgctctttttagtggcaaaagtattgaaaatgattgtatcagttttcttactaatcatttattgtgtggctgtgcccgattccgctattgaatttctattgacattcctggcgttctatctgggctatcttatatatgaaagctggtttttcttcgttttcgagtggaatcagaaacttacaaagaaatcaaaaaaatatgaaacagttgcgtaa

SEQ ID NO: 286 - DNA, 1386 bp, B.fragilis
aaatatgtaacgcttcactatatggcacaacaaaccgatccccgcatactgggtacagaacctattggcaaacttctgttacaatattccatcccggccatcatcggaatgactattacgtcactttataatatcatcgacagtatttttatcgggcacggtgtcggtcccatggctatctccggactggcgatcaccttcccgctaatgaatctggtcgtagcgttctgtgtactgatttcggcaggtggagctaccatctcatccatacgcttgggacaaaaagacatcaagggtgcgaccgatgttctgggaaatacattgatgctttgcctgacgaatgcagtgctgttcggtggattggcttatctattcctggacccgatattgtttttcttcggcgccagtaccggtacacttccctatgcccgtgattttatgcaagtgattctcttgggaactcccatcacttataccatgatagggttgaacaacgtgatgcgtgctacgggatatccgaaaaaggccatgttgacatccctggtgacagttattgccaatgtcatcatcgctcctgtcttcattttccatttcggctgggggattcggggagctgctatggctacagtcctgtcacagtttatcggaatgatatgggtagtaaaccacttccgtaacaaagagagttttgtccatttcatgccgggtttctggaaaatgaagaaacgcatcatcggcagtatcttctccataggaatgtctccttttgccatgaatgttacggcatgtatcattgtcatactcattaataatagtttgcaaaaatacggtggcgatatggctatcggtgcctatggtatcattaatcgcctgctgatgctgtatgtaatggtggtaatggggttgactatgggaatgcagcccatcgtcggatacaattatggtgcacagaagattgaccgtgtaaagcatacgctccgtctcggtatcattgtcggtgtattgataacgagtagcggtttcattatctgtgaactttttccgcacacagtttcggccatctttaccgatagcgatgaattgattgacatggcatcgtccgggctgcgcatttgcacgttgatgttcccgtttgtaggtgcacaaatcgttatatcaaatttcttccagagtataggaatggctaagatcagtatttttctgtcactttcgcgccagttagtatacctgctcccgggattacttctgcttccacccttatatggtgtaaagggggtatggatcagcatgcctgtctctgacggattggcttttgtaacagcggtagtgattttgatggtgtatatcaagaaagtaaaagagaaaacatccggacagaagctataa

SEQ ID NO: 287 - DNA, 993 bp, B.fragilis
actgaggtaactatgaacagatttatcggatacatacaggttgcatgttgctgccttctgctatgtgcttgctgcgtcagagacgggatggatgaagattgcaactgttatgtgcgctttgtatacgactacaacctgcaatacatagacttgattcataagcaggcaaccaagatgaacctgtatgtattcgatgaaaaaggtgtatttgtgacagaatcggaagaagaatccggtgcttgtgcaccggattacctgatgactctacccggagccatggcaggcagaagatatatttttgtggcttggtcggggttgtatgacaagtcgtatgacaaagttaccctgactcccggggtatctacgttggaagatctggaagtcagtgtcaacaatctgaaaacccggattggaggaggggtggtcgacagagaactccatttactgtggcatggcaaacagacggaagtatctccacagtataataatgatatcaccactgtctctttgctgaagaatacgaagaaattccgtatcatcatgcagatgctcgacgacagcagtattcacgtggatgattatgattttcgaattatttcgcccaatgggaggtacaaccatgaaaatgggcttttgggagacgaaacggacgagaaagtggaatatactgcttatcataccgaagacgatcctgagaccggagctatagccaaactgaatacgttgcgtctgatgactgataccgaaaacagattggttatcacgcataagtcatcgggtaatgtgattcttgacatccccttgaataaatatcttaatgcgctgaggcttcagcaatatgctgatatacctttgcaggaatatctggaccgtgccgataaacacggtattattctattctttaaaggtatggatggcaacggaaattatataagtgtggatgtacagatcaacggttggttgatccggaagcaagaggtcgatggagtttaa

SEQ ID NO: 288 - DNA, 2307 bp, B.fragilis
aaagacaaaacaatgaaacaattccattataccattcagacattaattcgcgatcgtagaagttgtgtcattaaggtgatctcattgtcgttgggattattggtatctatcattttattttctcgggtagctttcgaactgagctatgataactgttttcaggatgtggacaacctttacattgtaaagacggaatggattaaggatggagtgatcaaaggaaatgcaggatcatatacattaataccgatagcatcgacagttgctgaggagtttccgaaggaggtggaaagtgcggtttgctcaagtatatcttttgaagctattttcaaaataggtaatcggaagatgaataaatcttttattttatcagactccctttatttccgtactatgggaattgaggtcattagtggtaatccgaatgatttgaccaatcctgatgtgctctttttatcacagtcggttgcacgagaagcattcggtgaagaaaatcctattggaaagactttgcatatgatggtttggggcactcccgtagaaactttggtaaaaggagtatttgccgatcttccgtataatgtatcgttggaacgtcacgaagcagtcctgtcttttgccagtcatagtaaatatggttggggacgtcctggctggacgagtggtggtaattacaatgcctttattcgtttaaaagatggagaaaggagtgctgatgttattaatactgacattgataaagtaattgcaaaacatattccctcagacatgaatatgcacttacatatgattgtggttcctttgcggactattcacctggaacattcagatgtgaaaaggacgattctcatattatctttgttaggattcgccattctttttgcggccaccatgaactatgtgcttatttttgtttcctcactttctcagcgtgccaaaggaattggaattcataagtgtaacggtgcatccgataaggctatattttctatgtttatatatgaaacggctttgattatcggtgtttccttggtgcttatgatcatatttctattccaatttcaggaaaagatcgaagaattggcagaggtatccttatcatctctttttacctggcataatttatgggctccattatcggtagttacctttctgtttgttattggaggcatattgcccggaaaaatattttctttgattcccgttactcaggtcttccatccctatattaaagagaataggggatggaaaaggatattgttgtttattgaatttgcaggggtggcttttatctttggattgatgtgtgtggcatatcttcagtgtcactacattataaatagggatatgggatatcagccgaagggtgttgcatcttgtaagcatgattttgctgaacctgacaacgcacgtaataacctgaaatctttaccttatgtggagggggtagcttctattcgtggaagtatgacctggtttgggaatcgggaggtaactgatgaaggtggaaaagttcttttcactcctcgttgtgcggcattcgacaaagactttgttccattattgggacttcatatcaagaccgggcgtaattttacaggtgaaaggcagtttctggttaatcagccatatgtagagaagatgggctggaagggtagtggggttggcgagatagttcctaatcgaggtacggtggttggcgtgcttgctcctttttgttgtggtgtgcttccggctgataatgaacctttggaaattgaatatggtactaatttgaggaatgtccatgttcgtctcaaggaaccttttacagagaacttgcatagactgaataatgaaatgaaaaagatatatccgcaagaggatatagagtttaggtctttagaacaggatttagaacgatactatcgccccacaataatttttcgtgacgccacttttttggcttttataacgatactgtttatcactctgatgggattgattggttatataaatgatgaagtccgtcggcgtagcaaagagatagctattcgtaaaataaatggtgccgaagccagatctattctctttttattatctaaagatatcttctgggttgcaattctctcggttgccatcggtacatacggagcttactacatgagtctgttgtggataagtcaatttgaagatacaatctgtgtttatgcaggttggtatgtagtgacagctatttgtttattggtctttatctttgttttcattatagggagatcctggcatatcgctaatgaaaatccggtgaacagcatcaagtctgagtaa

SEQ ID NO: 289 - DNA, 1215 bp, B.fragilis
  unsure (295),(339),(357): Identity of nucleotide sequences at the above locations are unknown.
agaactgcgacttcccgaacgagaaagaacaatattaattgtcgtatggcgactaaattatggacattgcattttatgcggatatgccttgctaatttattgttgttcatatccctgtatttgttgtaccctgtactcccggtaatgatggcttcacgtttaggcgtgcctgtcagtcagacgggagtcatatttatattttttacgcttgcaatgttttttatcggcccgttccatgcctatttggtcgatgtttacaagcggaaatatatatgtatgctttcgtttgggggtnttggttgcagcaaccagccgggttatacgttggtgcagaacgcnacacatctgttgatgctntgcattgtgcagggattatcttttggaatggctgccacggcaggcatcacattggccatcgatatcaccaattccacttttcgcagcgcaggtaatgtggtcttttcctgggctgcacgcttggggatgattatcggagcggctttgggagtatatttgtttcggacacatggctttgagactttgctatatgttgctgtggcgttgggagcgttgggaatattatttgtgtcaagggtatatgttccctttcgtgcacctatcgggatgaaagtttgttccatggaccgattcctgcttctccggggacttattccggcattcaatttaatattgattgcttttataccgggattgatgcttcctgtgcttgccggtgcgccgagtgatgtgccggtaggaggcgagacagtacctttttttgctttggtcggatgcggatttctcttatcagtattaattgtgaaattgtttttccgctatgataataaaatgtggttgcagatagttgtcgggctggtgacagtaatcggatcgatggctatgctgttctctcctgaaacaagctggaatgctccggcagctgtattgatgggtttaggactcggcttggtcactccggagtttcttatgatgtttgtcaaattgtcgcaacactgccagcgcggcacggctaataccactcatctacttgcatgggaacttggagtcggattgggtattgcatctgcgtgtcatttacatcttacggctaatgaacaggccgtttatcgggtcggattgttatcggcaatcgtgtctttggcattcttcgttttacttacgtatccttattttaaaaggaagaaggtaagataa

SEQ ID NO: 290 - DNA, 1401 bp, B.fragilis
aatgcgcggacccttccagccccgtggtggaagaccgacccgacaacttcgggacgtactgaagagcaagtcgtgaatcatgtacgcatggtgctgtatgaaaccaagaataataccgtgcgttactcttgggacctgaatgtatctactgacggaatgaatgaatttaccggaggagatgtagtgagaggagaagatgtgccatcggctacgccgactgtgagtcgttttgttacagtaggtcgtgaagtggtgaaacaggattatgagttattgatattgatcaatcctcccggtgaattgctggagattaccgaacagggaaatcccagaagttatttatcgcgtgcagccaatatgacaaaagagtcgctgatacagccttatggtattgctgccgataataacttttatatgactaatcatcaggaccttatttttgttcctgaggtggagttgagggataatcaacggatggccgaagaaaatccggtaagggtcgaggtggaacgtgcggtagctaaagtcgttgtcagcggagtgcctgaggtagtaccgcacggtgatcggattgacaatctgaaatggggactggatgtgaccaatatgtatacctactggatgcgtaagatgacttttatagctaactcgggtggtgttccgaatgaaatggaacaactcaatgccggataccgcgaggaacgctatgccgaagatcctaactttacaagattcagttcctggaatggaggaaaccctgtcggacagtttgagtatttgtcagggactccggagttgagcaagaattttgatgactatgattatacgctggaaaatacgatggacgctgccgaccagcggcatgacgtaactacccgtgtagtgattagcggaacttacacgccgaatggcttcggatcggttgcgactcgtaacggagggggcatcagtttctactatttcaaaggcaatgctatcagagtggaagccatgcgggatatggtaaatgacagggggcagattcctcaggaattacgtgatgcaggtttggaacaggctatagagaacgtactggcctggaacccgaatgcatttaattcacctacggtttctttttcggagggtggcattcatttctactatcaaggagtgtgctattatacggttctgattcgtcatttctccaataacatggtacctgtattgatgggatacggacgctatggcgtggtacggaataatgtatatcagcttagtatcaataagattatcggtccgggacagccggtgatcaatcctcccggaacagatccggatgacgaagacacttcctggatctcggctgacgtcaacattatgcggtggtatatccgtaatcagaatgtagaggaacttttataa

SEQ ID NO: 291 - DNA, 1395 bp, B.fragilis
ggaaatgttgctaactttgttgccgacaaattattattcgtatttaatattctattgaccaaaatgggaactatcatcattgttgacgataataaaggagtgctgacagccgtacaattactattgaaaaatcatttttcgaaagtcattaccttatcctctcctgtcagtctgtccacagtgcttagagaagaaaacccggaagttgtcttattggacatgaatttcacttccggaatcaataatggtaacgaaggtctgttttggttacatgaaatcaaacggcaatacagagaccttccggtagtactattcacagcttatgctgatattgatcttgccgtacgggggataaaagaaggagcatctgattttgtagtgaaaccatgggataatcaaaagctgttggaaactcttttaaatgccgcttcacaagcaaaagacggaaagaaaaagaatcgcaaaaaagaatcatctccggtttctgccatgtattggggtgaaagcagtgctatgcagcagctccgcacgttgattgagaaagtagcaacgaccaatgcgaatatactgataacaggtgaaaacggaacgggaaaggaaatgctcgcacgtgagattcatgctttatcaccacgctctgccgagagcatgatatccgttgatatgggtgctatcaccgaatccttgtttgagagtgaactgttcggacatgtgaaaggttcttttactgacgcccatgccgaccgtacaggtaagtttgaagcagcagaccgaagttccctgtttcttgacgaaataggaaaccttccctttcatttgcaggctaagctactgacagccattcagcagagaagcatagttcgtgtaggtagtaaccaatctatccccgtagacattcgcctaatctgcgcaactaaccgaaacttgcaggagatggtagacaaaggcttattccgtgaagatttattataccgtatcaacaccattcatgtagaaattcctccacttcgcaaacgtaaagaagatattgttccgctagctgagcgttttatagcccgcttttgcaaacagtatgacaaagcctctatcagcctgagtccggccgcttgcgagaaactgaccgcacatgcctggtatggcaatatccgcgaattggaacattccattgagaaagcagtcattattagcgatggtgaaaccatccccgctgaaatgttccaattagtgcagaaaacggagaacccggaaacagagacctctactcttgaagatatggagaaagccatgattcgcaaggctctcgacaaatgtggaggcaacctttcggctgtagccgctcaattaggcattacccgccaaacattatataataagatgaaaaagtttggtttatga

SEQ ID NO: 292 - DNA, 1230 bp, B.fragilis
aaatgttatttttgcagcttaaataatatcattctattctatatggattcaaatcatctttctcctttacgcaaaggagtagtaggagtacagttcctttttgtggcttttggagctactgtacttgtccccttattggtcgggctcgatccttctacagctttgtttactgccggtatcggcacacttctttttcatctggtaacaaaagggaaggtccctatttttttaggtagtagttttgcatttattgctcctattattaaagcaaccgaactgtatggacttgctggcacactttcgggaatggtaggcgttgcaatggtctactttgttatgagtgctttagttaaatggcagggtatcaggttgatcgagcgcctgtttccaccggtagttattggtccggtaattatattgatagggctttcacttgccgggactggagtgaatatggcaaaggaaaactggacattggcgttgctttcgttgtttactgccgtgattgtatctattcgggcgaagggactattgaagttaatacctattttttgtggaattattgtgggatatattgctgcgttgatcttttatgatgttgatatgtcgggagtcagaaacgctgcgtggttgggttttccacagtttgtgtttccacagttttcgtgggaacctattttgtttatgatgccggtggctattgctccggtgatagaacacattggggatgtgtatgtggtaaacactgtgacgggaaaagactatgtaaaagatcccgggttgcatcgcacactattaggtgatggcttggcatgtctttgtgccggtttattgggaggacctcctgtaactacctattcggaagttacaggagccatgtcgcttactaaagtgacgaatcctcaagtaataagaatagcggcgattacggccattctgttttccgtaatcggtaaagtcagcgctttattgaagtctattccttcggctgtattaggaggaatcatgttactcttattcggtacgatcgcttgcgcgggaattgctaaccttgtcaataattgtattgacttgagccggacacgtaatatcattattgtctcactgactctgactattggcatcggtggtgccgtattggcatggggcgaattctcactgtcgggaatcggtcttgccgcattggtaggagtaggcttgaatctggtactgccaaaagaagagagatga

SEQ ID NO: 293 - DNA, 933 bp, B.fragilis
acaccttacgccaatatggggcgatggattatactattgtggtggcggctacagctggagacccggctgcattgcaatattttgctccgtttggcgggggctgccatcggtgagtattttcgtgataccggccgacatgcactggttgtttatgatgatttgtcgaaacaagcagtatcttaccgtgaagtgtctttgattctccgtcgcccctcgggacgtgaagcctatccgggcgatattttctatttacactcccgtttgctggagcgtgcagccaagattattaatcaggaagaagtggcccgtgagatgaacgatttgcccgaaagcctgaaaggtaaagtgaaaggtggaggttcgctgacagcattgcctattattgaaactcaggccggagacgtttctgcctatattccgactaatgtgatctctattacagacggtcagatattccttgatacggatttattcaatcaaggtaatcgtccggctattaatgtaggtatatcggtttcccgtgtgggaggtaatgcgcagattaaggctatgaagaaagtggccggtacattgaaaatcgatcaggcacaatatcgcgaattggaagcattctccaaatttagtggagatatggatccggttaccgcactgaccattgacaaggggcagaaaaacgcccgtttgctggttcagccccaatactctccaatgccggtagagaagcagattgccattctctattgcggtatccacggattattgcgaaatgttccgttggataaggtagaagattttgaagcagcgttcctcaatacactcgctctcgatcatcaggcggatgtgctggatgtattgaaaaccggagtgatcaatgacgaggtaacgaaggccattgaagaaacggcggcaatggttgccaaacagtatagttaa

SEQ ID NO: 294 - DNA, 879 bp, B.fragilis
aagattatggcttcactaaaagaagtaaaaaccagaataaattcggtacaaagtacccgaaaaatcacttcagcaatgaagatggtggcttctgccaagttacacaaggcgcagggagccattgagaatatgttgccttatcagaggaagttgaataagattctgactaactttctgagtgctgatcttccggtagagtctccgttctgtgtggaacgtcccgttaagcgggtcgctattgtggctttttcttccaacagttctttatgcggtgctttcaatgcgaatgtactgaaaatgtttttgcagacggtgggagaatatcgcgagttgggacaagataatatcctgatctatccggtgggcaaaaaaatagaggaggctgtcaagaagttaggattctttcctcaaggcagttatcagaagttggcagataaaccgtcgtatgatgaagccgctgcattggctaaattgttgatggaactttttctggaaaaaaatatcgaccgtgtggagttgatttatcaccatttcaagtcaatgggggtacaagaactgttgcgtgaaagatatttgccgattgacttgtctgccgttcaaaatgacgaagagagaggcggagtagtgaatgactatatcatagaaccttctgcagctcaattgatagcagacttgattccgcaggtgttgagtcagaagatatttacagctgctctcgattctaatgcatccgaacatgctgcacgtactttggctatgcagatagcgacggacaatgccaacgaactgattcaggagttgacaaagcagtataataaaacccgccagcaggccattacaaatgaattgctcgatattgtaggtggcagtatggcatag

SEQ ID NO: 295 - DNA, 858 bp, B.fragilis
agaaaactctatctttgcattgagttttcatgcactaaaataaaaattatgagacaaataaaaggaattaccgcaatctttctttgttgtctgctagttgccggatgtgacttgatagattatcatccatatgacgtcgacataaaaggagaaagagacattaatgcgaaaaatattcaaaagatcgaggccaaatgcctgggaaagtctactatacgctttatcgccatgggtgactcgcaacgctggtatgacgaaaccgttgactttgtaaacgctgtcaacaaaagagacgacatcgactttgtagttcatggaggcgacttcagtgacttcggacttaccgatgaatttctttggcaaagggatataatgaataaactaaaggttccttatgtaggacttatcggaaaccatgattgtttgggaaccggagaagatgcattccggcaaatattcggcgatacaaacttttcgttcatagccggaggtgtgaaatttgtatgcctcaataccaacgcaatggaatatgattattcggaaccgatccctgattttgactatattgaaagacaactcacagaacgtgccgacgaatttaataaaaccgtattctgtatgcatgcccgtcccctttgtgatcagttcaataacaatgtggccaaagtgtttcaaatgtatgttcgccaatttcccggtttgcaattttgcactgtagctcacgaacatcggatcagtgcgtcagatgtgtttgacgatggcgtgatgtattatggaagcaattgtatgaaaaatcgcagttatttagtattcacgataaaacctgatggttatgattatgaagtggttgaattttaa

SEQ ID NO: 296 - DNA, 981 bp, B.fragilis
tcaataacccaaacggcagttatgaaaaattatatcgttaacgaactcattgcagcaatgaaagaacggattccccgtggaataaatctggccaactacctgacagatgccctatgtatgggaaaagaggctgtataccgaagattacgaggcgaagtggctttcacctttgacgaaattgccatgatttcatgcaaactgggaatatcaattgatcagattattggaaatcaccagtcgaaccgtgtgactttcgatttaaacctgcttcactcacccgatcctctggaaagttattatgagattatagaacgctatctgcgcatattcaactacgtaaaagatgatatcagcacgaagatatataccgcttcgaacgtaattcctttcaccctctattcttcgtacgaatacttatcaaagtttcgcctgtgcagatggatttatcaaaatggaaaaatacgtaccccaaacagcttatcgggaatgcacataccggacaaagcggtccatgcccataaactgttgagtgaggctgtcaaagcgtgcagaaagacctgttttatatgggacagcaatgtcttctactcgtttgtaaaagagatgaagtattttgccggcctcaatctgatttcggaaacagacctgatacatttaaaaaacgaactggagctgttgctgcatgaactggaacagatatccgcaaaaggtgaattcagtaacggaaacaaagtagccatttacttatccaatatcgattttgaagcaacctacagctatatagaaaagaaagatttccaaatcagtctcctccgggtatattctattaactcaatggactctcaaagcccacgaatttgcggcatacaaaaagactggatacaatcattgaaaagacactccacactgatttcagaaagcggagagtcccaaagaattactttcctggaacagcagaagagtttcatcgacaccctgtaa

SEQ ID NO: 297 - DNA, 987 bp, B.fragilis
acagagaaacagtacaaactgaaaattatgataacaaacgaattaaatataggcttaatagaagccgcaaaagaaaagatgccgaccggaaccaacctggcaaacactctaatggacattttatatataggtaaggaggccatctatcgccgactgcggggagaagtaccgtttactttggcagaagctgccgtcatctcgagaaaattgggaatatcgctcgacaaaatgatcggtgtgagtttcagcaacaatgcggtattcgacctgaacgtcgtacaccataccaatacattcgaaacctatcacgatattctcacgaaatatgtcaatgcattcgataacatccgggaagatcccactacagaaatggcaacctcttcaaacatattgcctcaagcattatatctcaaacatgatgtactttcaaagtttcgtctgtttaaatggatgtaccagaatgaaaatatcaaatgcaagcattttgatgaactggagattccccacaaaatatataacatccagaaagactttgtcaatatgacacagcagatgaagacgactgattatatctgggacaataccgtattcgaacatgtagtgagagacatacagttcttttcggaaatccacctggtttcggaagaagacaaagagttgataaaagacgatttattgcttctgacggatgaattggaagagttggccggaaaaggtaagtatgaaaccggtaacgatgtacgtatctatatctcaaatatcaagttcgatgccacctatagctatgtggcaaccagcaacagccatatcagtatgatacgcatatactccatcaatgccattacaacgcaggatgacggcatgttccgcagcctgaaagagtgggtacaatcactcaaaaaattctcaactcaaatatccgaaagcggagagatgcaacgtatacgtttctttaatgaacagcgtgaaataataaataccttataa

SEQ ID NO: 298 - DNA, 1392 bp, B.fragilis
caattcttccttgtcccgttttttctgctttctaataactttctaatcttatctgagtatcttataattgctttcaaacggtttgcttcatgggggagttgtacttttgcttccaaaataacaaggactatgatcagaaagttttttattctcttttttcttggctttttcggatttgccgaagcccaacagccgtccgtcggcttgactctgaaggaggcagagcaacgtttcctgaaatgtaatttatccctattggccgagcgctacaatgtagacatcgcacaagccaggttgcttcaggccggactgttcgataatccggtaatttcattcgaacaaaatgtgtataaccgattgaatggaaagtactttgacttcggcaaaaaaggcgagtcggtagtcgaaatagagcaggtgatacgccttgccggacaacggaataagcagatacggctggaaaagataaacaaggaaattgccggttatcagttcgaagaagtgatgaggactttacgccaggaacttggcgaggcatttacagaagttttctatctctcaaagtcattgtctgtttatgataaagaaatcaattcgctggagcatttgctgacaggtataaaagagcagcatgcaaagggaaatatctctttaatggaaatggcgagactcgagtctatgctgctttctctgaagaaagacaagaacgaatgcgaaagcaactatttgtcccggagaggagaactgaatctgttactgaatctgcctgccgactttcggacagagcctgtaatagatgaaggagatcttcgacaattaaacatggaccggttgtcttatgccgatttacaagagagggtacacgggagacctgaccagaagttggcacgcagctgtgtcactgcttcgcaagccgatctgaaattgcagaaggcgttggcttttccggaattcgcagtaaaaggtagttatgatcgccaaggtaattttattaataactactttgcaatcggattcagtatgtcggtgcctatctttaaccgtaaccaggggaatattaaaatggcccgtttcaatcttctgaaggcggatcgggagcaagagtattcccgaaataaagccgaggccgaactatacgcagcttatactgctttagagaaagcatgtcagttgtatcagtcgactgatatgggactggaacagaattttgagaaactgatagccggagccaacgagaactttatcaaacgtaacatcagtcttttagaattcatcgacttttatgatagctacaaagagacttgcatccggctttacgaaatcaagaaaaacgtactgctcggtatagagaacctgaatgcggtggccggacaacctatttttaactactaa

SEQ ID NO: 299 - DNA, 678 bp, B.fragilis
caaacacgtaaaagaatgtttatggatgcaacaaagaaaataacggcattattcgattgtgatggtgtaattgtcgatacagaagggcagtataccgttttctggaatgaaatgggccaaaagtatgtaaatgatgcaaactttggttccaaggttaagggccagacactggtacagatttatgataaatactttgcaggagaaccggaaaaacagcgggatataaccgaggcattgaaccgctttgaaataaaaatgaattatgactatgttcccggaatagttgagtttatagcagatctgcgtcggcatggtgtgaaaatagctttggttaccagttccaatacggcaaaaatggagaatgtttatcatgcccatcccgagtttaaatccctttttgatgaaatattgactgcagagcgttttaagcgttctaagcctgatcctgaatgtttcttgttgggaatgacaattttcggttccgattcaaaagattcgtatgtgttcgaagattcatttcatggtttgcaggccggtagatcatccggagccattgttgtcggattggcaactacgaattcacgcgaagccattgccgacaaggcagactatgtaatagacgatttcagagggatgacttacgaaaaactgctgactataacttcacgttatatctga

SEQ ID NO: 300 - DNA, 687 bp, B.fragilis
tatcatttcaatcttaaaattatgacctacctcgctaccaaccccctattccatggaatctctccagaaacgctttcccgtgattttgacggaatcgtatctcacctccgcatgttccgtaaaggagacattcttgccaggcaaggtgatgtatgcaatcggctgatgatattactgaaaggcagtgtccggggagaaatgatcgattactcgggcagattgattaaagtggaagatattattgctcctcgtgcaattgcccctcttttcttatttggtgcagacaatcgctatccggtagaagttacagcaaacgaagctaccgaagttttcgaaattccgaaagaaagcgtactgaaattatttcgacggaatgagaaattcttagagaactacatgaatctttctgccaattatgcccgaacacttgctgacaaactgttttttatgtcctttaagacgattcggcagaaacttgcttcctatctgctacggatgttgaaacaacaaggagacagtccgatacaacttgaccgctcgcaacaggaactggctgattatttcggagtatctcgtccctctctggcacgcgagctggctcatatgcaggatgacggcctgatcaaaacggacaggaaattagtgcatatcttgagaaaagaagatatgatgcaactgatacaataa

SEQ ID NO: 301 - DNA, 213 bp, B.fragilis
  unsure (16),(34),(78): Identity of nucleotide sequences at the above locations are unknown.
tccctgcacaatgcanagcatcaacagatgtgtngcgttctgcaccaacgtataacccggctggttgctgcaaccaanacccccaaacgaaagcatacatatatatttccgcttgtaaacatcgaccaaataggcatggaacgggccgataaaaaacattgcaagcgtaaaaaatataaatatgactcccgtctgactgacaggcacgcctaa

SEQ ID NO: 302 - DNA, 396 bp, B.fragilis
aagaagcacaacatgccagaaaagcatatttatgaatacgccgttgttcggatagttccgaaagtggagcgtgaggaatttatcaacgttggggttatcttgttttctaaacaggctgcctttatccggatgcgttatgaaattaataagaagaggttggaggccttatcaccggaacctgatatcgattctttccggaaatatttggaggctttcagtaaagtgtgtgcaggctgtccgacgggaggaggcattgctaaactggaagttccggaacgttttcgttggttgacagcccatcgtagttcctgcattcagacctcaagacctcatgttggctattctgacaatttagaggaaacattggagcggttgttcgaggaattggttctttga

SEQ ID NO: 303 - DNA, 207 bp, B.fragilis
tttcgtggcaaatatacagtttttgtacgagaaaacggacacttcagcacagaaagagagtatgccgatactttcttttcgattagaattttgcataaaaatgtgagattcattcgtgaaatagagaaaaaagataaaaatagatcattcttattaggtaatatgagctattttgttacctttgcgcccccttattccatagcgtag

SEQ ID NO: 304 - DNA, 279 bp, B.fragilis
accattttaaaactgaaaattatgttactatcagtattattgcaagctgctgctgcaggagtaggattaagtaaattgggagcagctctcggagctggtttagctgttatcggagcaggtatcggtattggtaagatcggtggctcggccatggaaggtattgcgcgtcaaccggaggcatcgggagatatccgtatgaatatgattattgccgctgccttggttgaaggtgtagcgttgttggcattagttgtttgtctattggtacttttcttataa

SEQ ID NO: 305 - DNA, 1140 bp, B.fragilis
agctacataaagatgaatatggaaataaatccctcggaatataaaattctcattgtagacgatgttatgtccaatgtccttttattgaaggtattgctgaccaatgagaagtttaacatagtgacagctagcaatgggaatcaggcattggaccaagtaaagaaagagaatcccgacctgatattgctagatgtgatgatgccggatatgagtggttttgaagtttctcaaaagttgaaggcggatcccgaagcggcccatattccgatcatctttttgaccgcattgaatagtactgccgatatagtcaaaggatttcaggtaggcggcaacgattttatctctaaaccttttaataaagaagaactgattattcgggtcagtcatcagatttctttagtagcggccaaacgtattattgaagccaaaacggaggaacttaaaaagacgattatcgggcgtgataagctttattctgtgattgcccatgacctccgttcgcctatgggatctattaagatggtgcttaatatgctgattcttagtttgcccaaagaaaaaatcggcgaagatatgtatgaactgctgactatggccaatcagactaccgaagatgtgttttcgttgttggataacttactgaaatggacaaaaagccagataggtaagcttaaagtcgtatatcaggatatcgacatggtggaagttgtagagggagtaggagaaatcttcgcaatggttgccggcctgaagaatattcgtttgcgaattgaatcgccggaatgtcaggcggtacatgccgatatcgatatgataaagacggtgatacgcaatttaataagcaatgccattaaattcagtaatgaaggttccgaagttcttataaaagttgaagagtcggatggaatgtcggtagttagtgttaaagatagcggatgcggtattgacgaagaaagccagaaaaaactgttgcataccgatacacatttcagtacattcggtactaataatgaagaaggttcgggactcgggttacttttgtgccaggattttgttgtgaaaaatggaggaaagttgtggtttacttctgttaaagatgaaggttcaactttctatttctcgattccactgaaaaaataa

SEQ ID NO: 306 - DNA, 1599 bp, B.fragilis
atttgcacaaaattcagagattacatgaaaactgtcaaaacacatatcacccaattgttgcatgccatgaacaagggaattttcgaaaaagaacatcccatcgcattatcactactctccgcaatttcaggagaaagtattttcttcctcgggcctccgggagttgccaagagccttattgcaaggcgcttgaaactggctttcgaccaaagtactgcttttgaatatctgatgtctcgttttagcacccctgatgaaatattcggtccggtatctatctctaaattgaaagatgaagacaaatacgaacgcattatcgaaggttatctcccctcggcaacaatcgtttttttagatgaaatatggaaagcaggaccaagcatacaaaactcactgctaacagttatcaacgaaaaggtataccgcaatggacaatataccatacagttaccattaaaaggattaattgcagcttccaatgaattgccggctcagggagaagggttagaagccctgtgggatcgtttcttaatacgctattttatagggaatatcgaacaggaattcgctttcgatcaaatgatagcctctgtcaatgacatggaagcagaaattcccaccggactttctattacagaagaacaatatacagattggagaactcaaatcagccaaatcaagatacattatactgtttttgaattaattcattccatcaagcggcaaattgaaaaatataacatacagaaagaagaggttccacactcaacgctctatatttccgaccgtcgatggaagaaaatcgtatcgctgctcagaacttctgcttttctgaatgaaacagataccatccgcttttcagattgtactttattacttcattgcttatggaatgaaatagaacaaataccaattatcgaacaaatggtgtcatcggcacttgacgaatgtatcagccattatctttgtggcgaacggactttagaacaaaagctgagcagtattcgggaagacatgaagtcagaacacagtttgcgtgaaacaaaagatccggccctgcaaattgtagacactttctatcatcaaattgaaagatatcctgtagcaggcaatctgttgatttttgcttccgactaccaaagtttacaaaaagatactcaaaaattattttacattcaaagagataaatatcgtcctgttaactggatattaaaagtatatgaccatgtccgcaaccggaacatatcccaatcagccatagtttcactcaagaaaggcacacgttctgtattcatcaacaatcaagagtatccactagcttgcaacgcaggatacgacatagcttaccctcaagaagcctctttaccctttgaatttcgttttcaggaagtgatcgatttatatcacaacagggagaacgaattaaagcgcatgaccgacattgaactgacctattgtaaagaacatctattcatggatgacaaacaacgtaatatggtcaaacaaatattaaacagacaaaaagaaatgttggaaatttaccaaaatgaaatcagagaaatagcttatacgcatggattggaaaataaggaatattag

SEQ ID NO: 307 - DNA, 2991 bp, B.fragilis
agcaaacaaaaaatacaacaaacaggtaaaaggatacatgcagctcctctcccgaatgggatacaaaaacatcacaggttatctgtggtatgtagaagaagaaataatcgaaaaagtatgaaaacatttctccaattggtcgcgcaggacctttactgtaaaataggaaatgatctgtcacgcacagctatcatattccctaacaaacgtgccagtctgttctttaatgaacatttggcaaatcagtccgatcaacctctttggtcaccggcatatttaagtatcagcgaattatttcagcatttatcggtgttaaaactaggagatccgattcggttagtatgcgagctttataaaatattccgtgaagaaacaaatagtgacgaatcactggacgacttctacttctggggtgagttattaatcagtgattttgatgatgtagacaaaaatctggttcatgcagataagttatttactaatctgcaggacttaaagaatgtcatggatgattatgaatttctcgaccaagagcaagaacaggctatccagcagtttttccaaaatttttctatcgaaaagagaacactgttaaaagaaaagtttatttctctttgggataaattgggtgatatttatcgccgatatcataaaaagctggaagaattaggatttgcctacgaaggtatgctctaccgaaacgttattgaacaacttgaaccggattcattgaaatatgactgctatgtatttgtcggcttcaacgtactgaacaaggtggaaactcacttcttccaacaattgcagaatgcgggtaaggctcttttctattgggattatgacgtgttttacactcagcttccttcccggcaaaaacaacgccatgaggccggagaatttatcaaccgcaatctcaaactcttccccaatgagcttcctgccgaattgttcaatgaattgataaaacccaaaaaagttcgttttatctcttccccaaccgagaacgcacaagcccgttatctgcctcaatgggtacatgagaacctgagtaacgaagaaaaagaaaatgccgttgtgctgtgcaatgaagctttacttctccctgttttgcactctataccggaggtagtaaggaatgtcaatatcaccatgggatttccgttagcacagactccggtatatagttttatcaacgccatactcgaactgcaaaccagcggataccggacagactcgggacgatatatctatgatgccgtacagacggtattgaaacatccctatacccgccgcctctcagataaagctgagccgctgcaacgggaacttacaaagaccaaccgtttttatccttttccatccgaattaaagaaagacaaatttctggacatattgtttacgccccgcaatggtatccgtgaactctgtgtctacatcacggaactgctgaaagaagtatctgttttatatcgtcaggaacaggaaagcgatgacattttcaatcagctgtaccgtgaatctctcttcaaaagtttcacattagtcaacaggttgctcaatctgatagacaacaacgaattgcaggtacgcatagaaactctgaaacgtttattaaataaaatactgaatgcagccaacattccttttcatggtgaaccggctataggaatgcagatcatgggagtattggaaacacgtaacctcgacttccgtaacttgctccttctatcgcttaatgaaggccaattgcccaaatcgggaggtgagtcatcattcatcccttataatttacgcaaagctttcggcatgactactattgaacataagaatgctgtttatgcctattatttctatcgcctgattcagcgtgcagaaaatataaccttaatgtataacacctcatcagatgggttaaacagaggagaatggtcacgtttcatgctacagtttctgattgaatggccacatgaaatcagccgtgaatatcttgaagccggacaatcgccacaaaacagcaaggaaatccgcattacaaaaaccccggaaattattgaccgtttataccggacttatgacttctcacgcaacccggatgccctaatactttcgccttcagcattaaacacctatcttgattgtcggctgaagttttatttccgttatgtggcacgccttaaagctcccgatgaagtcagtgctgaaattgactccgccctgttcggaaccatcttccaccgttctgcccaattggtttatttagatctgacagccaacaaacgagatgtccataaagaagatcttgaacgcctattgcgcgataatatccgtcttcaaaactacgtggatatagcttttaaagaaatattttttcatgttcctatcgacgagaagcccgagtataacggaatccagctaataaactcaaaggttatcacttcgtatctccgccaactgctgcgtaatgacctgcaatatgcccctttccgaatgatgggtatggaacaggaagtagtggaggatatccggatagaagggcctgtgggaaagttatcactaagaatcggaggcaccatcgaccgtatggatagcaaagaaggtacactccgaattgtggactataagaccggaggcagccccaaagtaccgacaaatatagaacaattattcacacctgccgaaggacgccccaactacatcttccaaactttcctatacgccgccattatggcacggcaacaggcactaaaagtagctccctcgctactctatattcatcgggcagcttccgagagttactctcctgtaattgaaataggagaagctcgcaagcctaaactgccggtcgatgatttttcggtttatgaagatgaattccgtgagcgtctcctgaaattgcttgaagagatatacgatgacaaagaggaattcactcaaactgaggatacaaagaaatgtgaatattgcgattttaaagcaatgtgcaaacgataa

SEQ ID NO: 308 - DNA, 183 bp, B.fragilis
tacagacaaaagaaaggcccggtttcagcgaaaccgagcctttctttcatggaattgaaacattactcagacttgatgctgttcaccggattttcattagcgatatgccaggatctccctataatgaaaacaaagataaagaccaataaacaaatagctgtcactacataccaacctgcataa

SEQ ID NO: 309 - DNA, 369 bp, B.fragilis
aaaagtaaaaatatgaaagtcattgatttaacaaaagaaagcttcgtagagaaagtggccgaattccaagaatacccgaataaatgggattttaaaggtgataaaccttgcctggtagattttcatgctccctggtgtgtatattgcaaagccctgtcacctatactcgaccaactggctgtagaatatgatgggaaaatagatatttataaagtggatgtagatcaggaaccggaactggaggctgcttttgccattcgtacaatccctaacctgttgctttgtccgatgggaggaaaaccaagtatgaaattaggaactatgaataaaacccagttaaaagcattgatagaagaagttttgttataa

SEQ ID NO: 310 - DNA, 1347 bp, B.fragilis
gtcgaaaaaaagaagatgaagaaaatatatgttttggctttgttgagctgtctgttgatgttatcagcttgtgacagttatcttgatatcagacccgtggggagcgtgattcctcaaaccgctgaggagtatcgtgctttgctggcacgtgcttatctgaatgtgcccaatgacagagggctggcttgtcttcgttctgatgaaatgttggttaatgataatgaatatgaccgaaattcgtatggagacattgaacgttggaacgatgtgtcaccatttccgggaaccagccagtttacctggtctaatttctataatgtactttttattgctaatcaagtaattgagagtcaaaaggagattacagaaggaactccggaggtcgtgaatcagttggtgggtgaagctcatttgcttcgggcttatttgcattttgtattagtgaacctgcatggacagccatatacgaagtccggtgctttaaattcaaaatcaatacctttaaaattggacacggatcttgaaaaaacgttgggacgtaatacggtagaagaagtttatacttctattttatcggatatagagcatgcccgtgaattaataaataaggaaaagtgggaaactgtcttttcatatcggttcaatgttttgtctgtagatgcgttacagtctcgtgtcagcttatatatgggagcatggccgaagtgtttggaatcggctgaagcagtattggcaaagaaatctgttcttgtcgatatgaatgaaactcctttggctcttcccaatcattttgagtcggttgaatcgataactgctttggaacaggttatgggttcttctgtcaacaatgctgtgtgggtacctgctacttttctggctctttatcaggaaggagataagagattggccgcttattttgctgctccggatgaaaatgggaaccgaaaaagttctaaaggaggaaaaagagagttttcttgtacttttcgtgtaggtgaactttatcttaacgcagccgaagctgcagcaaacatggataaactgccacatgcacgtatgcgtcttttagaattaatgcggaagcgttatactcccgaagcatatgacaagaaagagaatgcagtgaatgtgatggataaaaatgccttgattagtgaaatactgaacgagcgtgctcgtgaattagcttttgagggacatcgttggtttgatcttcgtcgtactacacgtcctcggatggtgaaagtacttcaaggtaaaacttatatattggaacaggacgatcctcgttatacaattcctattccgagagatgctattgctgccaatccgggattagctaactaa

SEQ ID NO: 311 - DNA, 1683 bp, B.fragilis
atgtgcagaaattacaaaatggaacaagaacaacggttcattggttatattgaacaaagcatcataaacaactgggatgcaaacgccctgacagactacaaaggaatcacccttcaatataaggatgtagcccgcaaaatagccaaatttcacattatattagaaatggccggtattcaaccgggtgataagatcgctgtctgtggccgcaatagtgcccattgggctgtaacctttttggccaccgtgacttatggtgctgtaattgttcccattttacatgaatttaaggctgacaatatccataatatcgtcaatcactctgaggcaaaactcctctttgtaggtgatcaggtatgggaaaaccttaatgaagatcggatgcctttacttgaaggtatatcttctttgacagactttactccacttgtgtcgcgcaatgacaaactgacatatgcacatgaacaccgtaatgagatatatggacagcgatatcctaaaaattttcgtccggaacatatctcctaccgtaaagatatgccggaagagctggctgttataaattacacatcaggaacaacaggttattccaaaggagtgatgttaccctatcgtaggctttggtcaaacattgcttattgtcacgagatgcttccggtaaaacctggtgatcacatcgtttcgatgcttcccatggggcacgtattcggcatggtctacgattttctttacggattttctgcgggtgcacacctctacttcttgacacgtatgccgtctcccaaaatcattgcacaatcatttgccgaaatcaaaccgagagtaattgcttgtgtaccgttgattgtagaaaagattattaaaaaagatattctccccaaactggataataaaataggtaagttgttgctgagagtacccattgttaacgataaaattaaagcagctgcccggcaggcagcaatggaaatttttggtggaaattttgatgaaattattatcggaggagctccgttcaatgcagaagtggaagcttttcttaaacaaataggatttccatacaccattgcctatggtatgacagaatgtggtcccatcatttgttccagccgctgggaaactctcaaacaggcttcatgcggtaaagctaccagccgaatggaagtgaaaatagattctcctgatccggaaaatattgcaggagaaattatttgtaaaggtacaaacttaatgttgggatactacaaaaatacggaggccacttcacaaatcatcgatgtaaacggatggctccacactggagatttggctaccatggattcggaaggatatgtaacagtacgaggtcggagcaagaatatgttacttacttcaagcgggcagaatatttatccggaagaaatagaaagcaagtttaataacatgccttatgtgtccgaatcgttggttctactccagaaagataaacttgtagcactaatctacccggattttgacgatgctttcgcacacggactgttgcaaagcgatattgagaagataatggaaaccaaccgaatagaactcaatcaacaacttccggcctactgtcagattactaaaatcaaaatccacttcgaggagtttgagaaaacagcgaagaagagcattaaacgattcatgtatcaggaagcaaaaggataa

SEQ ID NO: 312 - DNA, 252 bp, B.fragilis
ggaatcatgaaagaactgcatttgaatattgtatcgccggaaaaagaggtctttaatggtgaagtgaagagtgttacccttccgggcaccagtggagtcttttctattctgccgcagcatgcaccgattgtttcttccctgcaagaagggacagtcagttacacgacaacggatggcgaagagcatacgctggatattcacagcggttttgtggagctaagcaatggtgaagcttccgtttgcgtatcctga

SEQ ID NO: 313 - DNA, 567 bp, B.fragilis
aaacggaagaatactatgcataagtttatagacaatattgtggcattttcgttgaaaaataagttcttcatctttttttgtacgacgattgccgtcattgccggtgtggtttcgttcaagcatacaccgatagatgcatttcccgatgtgacgaatacgaaagtgaccatcattacccaatgggcgggacgcagtgcggaagaggtggagaagttcattacgattccggtggagatagccatgaactcggtacagaagaagacggacatccgttcgacaaccctattcggactgtcggtcatcaatgtgttgtttgaagatcatgtggatgattttgttgcccgtcagcaggtatacaatttattgaatgacgcagatcttccggatggggtgactccggaagtacaacctctttacggacctacgggtgagatttaccgttatactttgcgaagtgacaaacggagtgtacgcgaactgaaaacaattcaggattgggtgatcgaccgtaacttgcgtgccgtatcggaagtgacggatattgtcagtttcgacggggaagtattc

SEQ ID NO: 314 - DNA, 231 bp, B.fragilis
agctttaggaagtgtaaatcagagatgaaagttctcaatgcgaacattgaggaaatacatgtgagagttaaaccaataaaaacctcttattgtttgatgttgcaaagtaaggcattaattccggataatacaccatatccgcttctttttatccttttaaatattctttattgtgtaattagaccaaaaattaacatttctctttggctatatgtgtcttatttgttataa

SEQ ID NO: 315 - DNA, 747 bp, B.fragilis
atgataaggaataaagttatggaacagagttttatcgaatattcattaggaaaagatgcttcttcggctgtcctttgggtttatccggttcgcaagccaagaggtaaagccattattatgtgtcccggtggcgggttcaatcagatagcttcagatcatgaaggacgtgattttgctgcgtggtttaataatcagggcatcacatacgccgtactgaattatcgcatgcctaacggtgatgttgaagtgattcgtgaggatattcgtgaagcgattcgcctgatccgccgtcagtcggcagagtggggaatccatcaactgggtgttatgggagcttctatcggaggctatatcgctgctactgccgcaactctttataccggaacagaccggcccgactttcaagtattgctttatcccgttatcagcatgaccgacaggctgactcattggccttcacgcgaacgtatgttgggagaaactatctccgaaggtttgaaagaaacactatcccttgaacttcacgtcacagccgatactcctcctacattcatcgttttggccgaggatgatcaggccgtatctcctctcaacagtattgtctattatacagcattattgaaacatggagtctctgccggactgcatatttatccggaaggcggacatagcttcggatttcgtgacagtttcatatataaggagttatggactgatgaactacaaaaatggttgctgaccttttaa

SEQ ID NO: 316 - DNA, 204 bp, B.fragilis
agggagtctgataaaataaaagatttattcatcttccgattacctattttgaaaatagcttcaaaagatatacttgagcaaaccgcactttccacctccttcggaaactcctcagcaactgtcgatgctatcggtattaatgtatatgatcctgcatttcctttgatcactccatccttaatccattccgtctttacaatgtaa

SEQ ID NO: 317 - DNA, 765 bp, B.fragilis
gtattgagagaagctattcctgcagcgctatctattccgggacgtgaggggtatccggtatatgctatcttcgcgataaaaacagccggtctggatgaagaaggttatcctttgttttatgataaagaagggaaaaaagtaactttgaaagaactgtatcgctggcaggatccttttggattaggttttacggttaattcggatgtaactccggcagaagagcgtagcttttattcgtatattggttcacaagatactccttatacgggtggcctgatcaatacattcagttataaaaattgggaattaacagccaatttatcatttaatctgggaggatatgtgcgtacaacgccttcctataatttcattaattttgatagagggcagaacgtaaatagtgatattttagatcgttggactccggagaataccgatgggcgtctgccggcattaatcaccagcgagaaacgggctgacgagtattattggtatgatcagaagagcgaaatttacaagaatttagatatttgggtaaagaaattaaattatttccggttgcaaaatttgcgtttaggttaccgtctacctgagaaaatgactaaatctttaggaatgggatcggcttctgtggctattgaaggacgcaatttacttgtttttggttcaagttataagaattttcttgatccggagtcgatgtataatccgtatgcaccgcctatccctaaatcaattacgtttagcttgaatttaaatttttaa

SEQ ID NO: 318 - DNA, 1050 bp, B.fragilis
catctcagggaagaatcccttagctttgcatggtatttaaaaagagagaaagccatgtataagcaaacgattcgtcctgttttatttctgatggaacccgaaaaggtacatgccttgttggtttcctgcctcaaatgttaccggcatttgccatggtgcagatgctggatacgtcacctttatacttgttccgacaaacagttgatatggaatcatcttacttttcgaaaccgtatcggtctgtcggccggtttcgataaaggagccgaaatttttgatgaattggccgattgtggtttcggatttatcgaagtaggtactgtaactcccgattctcaggatggaaatccccgtccgcgtatttttcgcttgcctcagtgtgaatctttaatttcccgtacgggcttcaataatcccggattggatgttattaaacgccgtcttgaacagaaaagcggttcgtatgttttaggtgtaaatataaataagaatccctcttcggaaggagagcaggcggtggctgactttttgcgtctgtataaggagttacatcctcatgtcggttatttcacacttaattggggatctgtggatgttgctctgatgaaacaggtgctacaggggttggcagcttttcgtgtggagcaaaacatacatgttccgttgttactcaaacttcctgccgatatcacagaagaaggaatggatgatgtgatcgactgtactcgtctgtaccgggtagatggagtgatagctaccggacctaccatggagcggagttacttaaaaggttattcacctgcacaattacagaagatcggctccggtggaatcagtggacgcgggataggggagaggtcattaaaagccgtcagctatttgcgtgcccatgccggaaaaagccttctgatagtaggggcaggcggaatcattactcccgctgatgcccgtaggatgttggatgcgggggccaatctgatacaaatctattcttcgtttatttatgaagggccgggtatagtgaaaaaaatgattcaggaaattaaatga

SEQ ID NO: 319 - DNA, 3174 bp, B.fragilis
atgagcgaactcattgtctataaagcctccgccgggtccggaaaaaccttcaccctggctgttgaatatatcaagttactaatccggaatccgcgcgcctatcgccagattttagcagtaacctttactaataaagctactgctgaaatgaaggagcgtattcttagtcaattatatggaatacagataggcgatccggattcggatgcctatctaaaacgcataattgccgagacagggcattcagaagacgagatacgaacaacggcaggcatagctttgggttatatgcttcatgactacagtcggttccgcgtcgaaaccattgattctttttttcaatcggtcatgcgtaatctggctcgtgaacttgaattgagtcccaatctgaatatcgaactgaacaacgtagaagtattgagcgatgctgtggacagtatgattgaaaagttgggacccaattcacctgtactggtatggctgctcgattatatagatgaacgtatcgctgacgataaacgctggaatgtttcggatgagatcaaaagtttcggacggaatatttttgatgaaggatacatcgagaaaggtgatggtctccgccgacgcctccgtgacccgaatgtaatccataattatcgtaagacattaaaagagatggaaacagccgctcttgaacagatgaaagagttcgctcaacagtttgaaaatgtactttccagtcaatcactgaaaccaactgatttaaagaacggagccaaaggaataggaagctatttcaataaactaaaaaacggtatactcggagacgagatagtcaatgctactgtaatcaaatgcctcgatgacgagactaattgggctgcaaaaacatcaaaacaatatacggatattatattgttggcttcttccatcttaatgccacttctacaaaatgccgaacaatatcgctcacgcaacaatcgaatagtgaacagctgccgactgtcgacacagcacctgagcaaagtccggcttttaaccaatattgatgaagaagtacgtcaactgaatcgtgaaaacaatcgtttcctcctttcggataccaacgctttgctccaccaattagtgaaagacggtgattcctcttttgttttcgaaaaaatcggaactaacatccgcaatgtgatgatagacgaatttcaagacaccagtcgaatgcaatgggataattttaaactcctgctacttgaaggattgtctcaaggagccgacagcttgattgtaggtgatgtcaagcaatctatttatcgttggcgaaacggcgattggggaattctgaacggattgaataagcaacttggatatttttctatccgtacagaaacgttaaaaaccaaccgccgaagtgaaaccaatatcatacgattcaacaatagtatattctccgcggctgtggactatctcaacgaaatgtataataagcagttgggaagtatttgtgagcctctgatcaatgcatatgccgacgtggaacaggaatccccccgaaacaaacaacaaggatacgttaaggtagagtttctcgaaccggacgaagaacacgattatacagaacaaacccttatcagcctgggaatggaagtagaacatctgttacaatccggcgtcaaactgaacgatatagctattctcgtcagaaagaataaaagtattccgcgtattgccgattacttcgataaacaactaaattataagattgtgtctgacgaagccttccgtctggatgcctcgctcgccatctgtatgatgttggatgccttgcgctatctttccgatccggagaatcggatcgtgaaagcacagttggccactaattaccaattacaaatacttcattcggagtatgatctcaattcgctgctcctccataaagccgaagaattatttccaccggcttttctggaacgaatggcagaactacggttaatgcctctgtatgaactgttagaggaacttttcagtttatttgaactgcaccgtattgaacaacaggatgcttacctgtttgctttctttgatgcagtaaccgattatctgcaaagccactcttctgatccggacagctttatacgatattggaacgagacgttatccgggaaaacaattccgagtggcgaagtggagggtatacgtatcttttcaatacataaatccaaaggactggaatttcatacggtactcctacccttctgcgactggaaactggaaaatgaaacaaacaaccaactcgtctggtgcgtacctcaagaagcccctttcaacgagttggatattgtgccggtaaattactcttccgccatggcagaatctgtataccgcacagattatttacacgaacgcctgcaactatgggtagacaatctgaatctgctttacgtagcatttacacgtgccggcaaaaatttgattatctggagtcggaaaggacaaagaaatacaatggccgaattgctaaccggagcactaccacaggctgccaacaaattagatcaggaatgggatgaagaacaggtatatgaattaggtgacctttgcccatccgaaaatgagaaaaaaatcgattcaggtaacaagctgactcgcaaaccggaaaaacttccggtcaatatggaatctatgcatccggatatagaattccgacagtccaaccgatctgctgattttatcaaggggctttctgaagaagaatccgatgaccgcttcataaatcacggacaattgttacatactttattttctgccattgagaccaaggatgacatagaaccggccattcatcacttgatattcgagggaatcattggcagcaaagaagcggaagaacgaatacgttctctgaccgtaaaggccttctccctgcctgaagtacaagagtggtactccggtgaatggagattgttcaacgagtgcgcaatcatttacaaagacaaaggtgtattacaaacccgtcgccctgatcgtgtaatgatgaaaaacgagcaagtagttgtggtagacttcaaatttggtaaagcaaacaaaaaatacaacaaacaggtaaaaggatacatgcagctcctctcccgaatgggatacaaaaacatcacaggttatctgtggtatgtagaagaagaaataatcgaaaaagtatga

SEQ ID NO: 320 - DNA, 1095 bp, B.fragilis
tttatgaattggacaaaataccttccatgcctattgattttgggtatggggagtggttgctcatcagaagtgaagcaccccggagaaaatcaagatctgtgtctgacagacagtttactgaaaatagtttccgtcgatacggtgcatctgcatgatgtggcagatgaattgactttgaacggacgtgttacttttaatcaggaacaggtggcacacgtctatccgatgtttggcggaacagtgacggagcttcgcgctgaagttggggattatgtgagaaaaggagacatacttgccatattgcgtagcggtgaagtggccgattacgaaagacagatgaaagaggcggagcagcaggtgattattgcccgcagaaatgtaaatgctacccgggatatgttcgattccgggttggcatccgataaagatgtattgcaggcacgtcaggaattgatcaatgctgaagcggaagagaatcgcatcaaagaaattttttccataaataactttagtggccggtcattctatgaagtcaaatctcccgttagcggttttattgtggaaaagagtgtgagcagaaatatgcagcttcgtcccgatcagggtgaggagatatttactgtctccggtctggagcatgtatgggtgatggcagatgtttatgaaagcgacatcagtaaagtagcagaaggagcatcggtacatatcactacgctggcatatccgggtaaggtgttctccggaaatatagataaagtataccacatgttgaatactgaaagtaagacaatgaacgtacgggtaaagctgtgtaacgaagactatctgctgaagccgggtatgttcaccacggtcaatgttgagtgcaaatcttccgggaaacagatgcctcggatcaatgcacatgccttgatatttgaaggaggtaagaattacgtcgtaaccgtcacccccgacaaccgcctgaaagtgaaagaagtcgatgtatacaaacggcagaatcaggaatgctatgtccgttccggactttccgagggtgacagagtgctgaatcagaatgtattattggtctacaatagtttaaatgcagactaa

SEQ ID NO: 321 - DNA, 627 bp, B.fragilis
gtaccgagttgcgtaagcacttggtatgaaacacttttctctgcaggatatggttttgatcgccagacgttgactacaaaaccggttgtctttccggatgaagaccgtgccagacagtttcctcttcatcagaaaacgtataaagaaaatgcctatgtctctttcttctctacagcttcctattcgttgatgaaccgttatacattcggaggaagtatccgttttgatggttctgacttatttggcgtagacaagaaataccgttatttgcctctgtactctgtaagtggattatggagattgtcaaatgaaccttttatgcagggaactagaaaatggatggataaccttgcattccgtgtttcgtatggtattcagggaaatattgataaaaatacatctccctttctgttgggtaaatatattgtagataatattttaccgggtggttcggaacatatgattgatataaattctgctccaaacaagaaacttcgttgggagaaaactcaatcagtaaatgttggacttgatttttcggtactcaatcaggcgcttaatctgagtgtagattactattatcgtaaaggtacagacctttttcgaagttcaaatgattccacttaa

SEQ ID NO: 322 - DNA, 2574 bp, B.fragilis
acatacggctggcagcacccgaagcgggtacaaacttcacaatcgttttgtctgaattggtataggcattccatgctgcaagataagctttctgctcctcggcatcaggagccaaaatgcctttttctacagatgcggcagcatctaacttcaaataaggaaagcctttttggaagcaagccaactgctcagcgatttgtacttccgaaatgccctttttggcaagcaattctttgtcttcaggtgttatcatactatctaattttattaattcatgcccaaaaatacaaaaaaaggaagaggacaccctacaaaacccggaaaaaaactatctttaccgacgataaatttgagctgcttatggaaagagatgaattctttacgaaagaagagagagaattattgttctcactatacaaaaaactactgcgtctcaccggagaaaccttacaaaaaggagattgcagaaagctgaaaaagcatcttatcgactccactcaaaacaatacgatgcagagggacagttttgggctgaatcctgttatcaaagatatgcagactgctgtaatcgtggctgaagaaatcggcatgaaacgggcatctattttaggcattatgctacacacgcctgtacgttgccactcttatacaatagaatacattcaacaggagtatggtgaagatgtggccggaattatccggggattaatcaagatcaatgacctctatgataagagtccgaccatagaatcggagaatttccgcaatctgctactgtcttttgccgaagatatgcgggtaattctgatcatgattgccgaccgtgtaaacgtgatgcgacaaataaaagatgccgaaaatgacgaggcccgcagacgggtggccaatgaagcagcctatctgtatgctccgctagcccacaaactgggattgtataagctgaaatcggaactggaagatttgtcactaaaatataccgaacatgacatctattaccatatcaaggaaaagctgaacgagacgaaaaagtcacgtgaccgttatattgccaacttcattgctccgatacaacagaaattggaggaagcaggactgcatttccacatgaaaggacgtaccaagtccattcattccatctatcagaaaatgaagaaacagaaatgccagttcgaaaacgtatatgacttgtttgctatccgtatcatcctggaatctcagtttgaaaaagagaagcaggaatgttggcaggcatattccatagtgacggatatgtatcaacctaaccccaaacgtctgcgtgactggctgtcggttcccaaaagtaacggttacgagtcattacacatcactgttatggggcccgaaggcaaatgggttgaagtacagattcgtacggagcgtatggacgatattgccgagcgcggattggcagcccattggagatataaaggcgtgaagggtgaaagcggactggacgaatggctgacttcaatacgtgaagcactggagaatacggagaacgacctggaaatgatggaccagttcaaactggatctgtatgaagacgaagtattcgtatttacaccgaagggagacctttttaaactgggcaaaggggctaccgtacttgattttgctttccacatccacagcaaattgggatgtaaatgtatcggagcaaaagtaaacggtaaaaatgtacagttaagacaaaagctgaacagcggggatcaggtagagattatgacatcgaacacacagactccgaaacaagactggctgaacattgtcactacttcaaaagcccgtactaaggttcgtcaggccctcaaggagatggtggcgcgtcagcatgattttgccaaagagaccctggaacgcaagttcaagaaccggaagatggaatacgacgaagctgtgatgatgcgcttaatcaaacgcttgggattcaagaacgtgacagagttttatcagaagattgccgatgaggtactcgacgtaaacgatattctggataaatacatcgaacaacaaaagcgggacagcgaacgtgatgaggtgacctatcgcagtgcagaagaatacaacctgcaaaaccagatagacgaaacaacagtcactaaagaagatgtactcgttattgaccaaaacctgaaaggattggatttcaaactcgccaaatgttgtaatcccatatacggagacgatgtattcgggtttgtcacagtatccggaggtatcaagatacaccgaaatgactgccccaatgcaggacagatgcgcgaacgcttcggctatcggattgtaaaagcacgctgggccggtaaatcggaaggtactcaatacccaataacactccgcgttgtgggtcatgatgatatcggtattgtaacaaatatcacttcgatcatctcaaaagaaaatggtatctcgctacgttctatcggtatcgattcgaacgacggacttttctcgggtacattgaccattatggtaagtgataccggacgtctggaagcgctgatcaagaagttgcgcacagtaaaaggagtaaaacaggttagcagaaattaa

SEQ ID NO: 323 - DNA, 1479 bp, B.fragilis
tactcattgcttatgatttttaccgctgaaaacattctactcattggttctattttactatttgtcagcattgttgtcggaaaaaccggatatcgcttcggagtgccggccttattattattccttcttgtaggtatgcttttcggaagcgacggattgggattacaatttcataatgccaagatagcccaatttataggtatggttgcccttagcgtcattctgttctccggaggtatggatactaaattcaaagaaattcgtcctattctttctccgggaatcgtactttcaacagtgggagtatttctcacggcactttttaccggattattcatttggtatctttcgggaatgagttggaccaatatccactttccattgatcacttccctattacttgcatctaccatgtcgtcaacggattctgcttcagtattcgccatcctccgttcgcaaaagatgaatctgaaacataacctacgtcctatgcttgaactggagagcggaagcaacgatccaatggcctatatgcttaccatagtcctgatacaattcattcaatcagatggcatgggtacaggcaacataatcggttcattcatcatccaattcttggtaggtgctgctgccggatatatcttgggaaaactggcgatattgatactcaacaaaataaatatcgataaccaatcactttatcccattctgttattgtcttttgtattcttcacttttgccatcaccgatctgcttcgcggtaatgggtatttggctgtatacattgccggcatgatggtaggtaaccataaaataactttccgaaaggaaattgcaacattcatggatggtctgacctggctgttccaaatcattatgttccttatgttaggactgcttgtcaatcctcacgaaatgattgaagttgccgttgtagcattgcttatcggagtattcatgatcgttatcggacgaccattaagcgtattcctttgtcttttaccatttaggaagattactttaaaatcccgtctgtttgtctcgtgggtagggctacgaggagctgtacccatcattttcgcaacttatccggtagtggcaaacgtggaaggatcgaatatgattttcaatatcgtgttttttattacgattgtttcattgattgtacaaggaacaagtgtttcgtttgtggcacgcttgttacacttgtccactccactcgaaaagaccggaaatgacttcggtgtagaacttccggaagagatagatactgatctttcggatatgaccattactatggaaatgctgaatgaggcagacaccctgaaagatatgaatttgccaaaaggtactttagtaatgatcgtcaaacgtggtgatgaatttcttatccccaacggcacactaaaattacatgtaggagacaaactactgctgatctcagagaaaaataagcaggaaacggttaagaatgaatag

SEQ ID NO: 324 - DNA, 312 bp, B.fragilis
ttactgatgctgttcacgcaacaggtcgttcacagtctttaccggattgaaagtggaaagtggaacctccacaaataccgtactccaatcgctcatagcaccattccacaaaccgggaagttcaagagctttcagatccttaccactcttcgacttataagagatgaagccggtagctttatccacatatttcgccaaatcaaatttatgacccttataatcacgtacggcgcaaaccagatcgaccgggttgaagtgcgtacccttttcaaacatttcctttgcttccggattattcatatcgatttgtga

SEQ ID NO: 325 - DNA, 1248 bp, B.fragilis
  unsure (473): Identity of nucleotide sequences at the above locations are unknown.
cattcctggcgttctatctgggctatcttatatatgaaagctggtttttcttcgttttcgagtggaatcagaaacttacaaagaaatcaaaaaaatatgaaacagttgcgtaacatagttgccggaatgcttgtcttgataggaggaatgttgcctgctacaacctttgcacaggagcctgtaccgggtgataccaccggtactttgcagcatgagattattgtaggtaaagacacaatcaatcaagaagctaatcaggtagatgtaaaaggcattgtgttcggccctattggagattcttacgagtggcatattacgaatataggaaaaacttcgatttgcattccgttgcgattaatcgtgtatagcgaactttctggttggcatgcttttctgtcttcgcgcctagaagagaatggcggcaaatacgagggattttatatagctcctgccgggagcaagtatgagggganagtagtagaacgtaatgcgacgggagaggaagtacgtccgtgggatatttccattacaaaggtaactttgtctctctttatcaatagcgctattttgctggcgatcattctgagtgtagcgcattggtatcgcaaacgtgaacagggtgcatatgctccgggaggatttatcggatttatggagatgtttattatgatggttcatgatgatgtgattaagagttgtgtgggacccaactataaaaagtttgctccctatctgctcacagcctttttcttcattttcattaacaatattatgggactgatccccatctttcccggaggagcgaatgtaaccggaaatattgccataacattggtattagctttattcacattcgttattgttaatatattcggaacaaaacactattggaaagatattttctggcctgatgttccctggtggctgaaggtacctatacccatgatgccgtttatcgaatttttcggtgtatttaccaaaccgtttgccttgatgatccgtctgtttgccaacatgttgtccggacacatggccatgttagtgcttacctgcctgatatttatatcggcaagcatgggaccggctatcaatggttcgcttacggtggcttccgtattattcaacatctttatgaatttgctggaagtgttggttgcctttattcaggcttatgtgttcacgatgttatctgctgtattcatcggactggcccaggaaggcggtaaaaaagaagaagtaaaagaataa

SEQ ID NO: 326 - DNA, 2658 bp, B.fragilis
gtgctaattagatttaacatgagactaaaaacaatcctactgaccactatggccaccggttcatttttgtgcgagcctgttgctgctatgtgtattgaacctcccgcaactcctgatatgggatggtttttgaaaaagaaaaaaaagagtaatccccaagacagtattaaggttaagaatgagtatgagaaattaacaggaagcgatagtgtcgttcgtcgtggtatgttcaatgtataccaaaagaagaacgattattactttgagattccttccaccctgttggggcgtgatatgctggtggtgaataaactgcaacgggtacctgcagaactgaatgaagccggagtgaatcgtggaactaattatgagaatcagatgatccgctttgagttggataaatcggctaataaattattgatccgtcaaagtcgtccgttacctatttcaccatctgaagatgccattagccaatcggtgaaggataattatatttctccgctgatagccgggtttaaggtagaagcatataataatgattctaccagcatactgattaaagtgaacgatatatatgatggtacagagacaagcataaataacgtatttaccaatattaatcttggcacatcggccatcaagaatttatcaagaattctatccatcaagtcctttgataataatgtggtagcaacctccgaactgactactcgtgtgaccgaaggtactactactatctatgtgacggtagaggttagttcctctattttgttgcttcctgaagtgccgatgaccggacgtttggataatccgcgtgtgggatatttcactaatcctctgactaatttcagtgatggacaacaacgggtaaataaaaaacaatttataactcgatggcgtctggagcccaggcctgaagatcgggcagcgtatttacgtggagaattggtagaaccccgaaaacctattgtcttttatatagaaaattcgacaccttatcgttggaggaagtatattaaacaaggaattgaagactggcaagtagcctttgaacgtgccggatttaaaaatgccattatcgctaaagatattaccgaggacatggaggtagatatggatgatgtgaattattctgtgctgacttatgccgcatctaccaaagcaaatgcaatgggaccttctattcttgatccgcgttcgggagaaatccttgaggctgatatcatgtggtggcataatgtactttcaatgcttcaggagtggattacggtacaaacaggtgtagtgcgtcctgaggctcgtggtgttgctttaccggatagtctgatgggagatgccatgcgctttgttgcctgtcatgaagtgggacattcactcggactgcgccataacatgatgggatcatgggcttttcctacagattctctccgttcgaaaacatttaccgaccgaatgaattcgacttcatcgtctatcatggattatgcccgctttaactatgtggcacagccgggtgatggtataaaggcactttctccccacatcgggccgtatgatatgtttgctatagaatatggttatcgttggtatggcaagcaaacaccggaagaagaaaaagaactgttgcaggattttttagcgaaacacactgatcggctttataaatatagtgaggcacaggatccgcgggatgccgttgaccctcgtgcacagaacgaagatcttggcgatgatccgatccgttcttcacagtatggcattgccaatttgaaatgtattgttccccaaatcattcaatggacaactaccggagagaaaggacagacgtacgaagaggcttctcgtttgtattatgccgttattaatcaatggaataattatctttatcatgtaatggcgaacattggaggtatttatattgaaaatacaacggtaggtgatggtgagaaaacttatacgtttgtggaaaaggagaagcagcaggctgctttgaggtttttgcttgatgaggtgctatgctatccgaaatggttgttcgaccctgaaatagctcaatatacttatctgcttaaaaatactcctttgggagtagtagagaatgccccaacacaagtgctgaaaaatgcacaggcttatgttttttgggatttactgtcgaataatcgcctgatgcgtatgcttgagaatgaatcggtaaacgggaaaaaagccttcacagctgttgaattgatggatggtttgcataaaagtatttttgctgtaacagagcgtggtggactgcccgatgttatgacacgtaacttacagaaaggttttgtagatgcattgattactgctgctgccgaaagcgagggagtgaaagttaacaagaaattgattgataatcacttcttgttcgactttcagacaccgatttgtagttgtgatgaccatgcacatcgttcggcacatactgatcgcatgggggctcgccgtgaactgaatttttatgggtctcagataaaccgtatttccgacgccatttcagtaaaacgtggtgaattgcttcgcattaaagatttgcttcaaagccgtttgggcacatcggatgtagctaccaaatatcactataaagatttgattttacgcataaatactgcgttgggcatttcgaaataa

SEQ ID NO: 327 - DNA, 933 bp, B.fragilis
aatacaaacagggctgatatgagacaattgtactacactttccgaactcttctccgtggaagaggtggaaatctgaccaaaataatttcgttaactttagggcttttggtcggcatcctgttatttgccagggttgcatttgaattaaactatgatagctattatcaagaaccggaaaatctttttctaactttacgtacagttgtttcgcaaggtgaaaagaaagagcctgtttgtagtaattacggaaaacttccagcagcaattcgtgaaaattttcctgatgaagtggaagatgcaactttgattgacttatttagtcgcagttcgctttaccatgaaggccaggaaaagaaagatgcaatactggctacttcccgaagccatattttttccactttgggcgttaaagtactttccggaaatgtgtctgaattggataatatggatgcactgtttatatcccgttctcttgctcaaagtctttttgcagatgccgatcctattggaaagacagtaatgattaatattgattatccattgactgttcgaggtgttttcgaagatattccggaaaatgccgagtttcggtttgatggggtctattcatttgtgactcgtgctaatagattcagagatgaacgtggtggatggcggggtgatatcagctatacatgtatggttcgtttccgccatccggaagatgtagagaaagtggcggcacgtatgcctgatatgctgaagaagtatatacagtataataaagactggtttgaagaattttcgtttataactccttcacagtttcatttgcagaaaaaggaatcacgtaaaattatcagtattctatcgattctcggatttgccatcttgctgattgccggcatgaacaatgtacttgatttctatttcatcattggctcaacgagctaa

SEQ ID NO: 328 - DNA, 399 bp, B.fragilis
cagaaattaagaatggaaaaattcagcaccagaaaaagaatacggagcttcggatatgcctggaaaggtatccgaagttttgtaagcaaagaacataatgcctggatacattgcacggcaattattatagtaacagtggccggattctgtttcggcatcacccggaacgaatggatggctatcatactttgttttggagtagtactggcagcagagggattcaacacggctatagaaagattggtcaatcttgtatctccggaacgtaatccgatagcaggtgatgtgaaagatatcgcagcgggttccgttctgatatgtgctatagttgctgccattgtaggaattatcatcttcatgccttatgtacttgctgttttactgtgtaatatgggataa

SEQ ID NO: 329 - DNA, 1536 bp, B.fragilis
tatataaaaagattgcttatgtcacagattatcggacatatctctcaggtaattggccctgtggtcgatgtgtattttgaaggtacagaatcggacttgatattgccaagtatccacgacgcattagagataaaaaggcacaacggcaaaaagctgattgtagaagttcaacaacacattggtgaaaataccgtacgtacggttgccatggatagtaccgacggcttgcagcgcgggatgaaggtatttccgacgggaggtcctatcacaatgccggtaggcgaacagatcaaaggacgtttgatgaacgtagtcggcgactccatcgatggaatgaaagaactcaatcgcgacggtgcatattctattcaccgtgatcctcccaaatttgaagatttaaccactgtacaggaagttctgtttaccggaattaaggtgatagacctgcttgagccttattcaaaaggaggtaagatcggtttgtttggcggggccggagtgggtaaaactgtacttattatggagctcattaataacattgccaagaagcataatggtttttccgtatttgccggagtgggagagcgtacccgtgaaggtaatgatttgcttcgtgagatgattgaatcgggtgtaatccgttatggagaagcattcaaagaaagcatggaaaaaggacattgggacctctcgaaagtggattataatgaggtagaaaagtcacaggctacattggtgttcggacagatgaacgaacctcctggagcacgtgcttcagttgctttgtcaggattgactgtcgctgaatctttccgggatatgggggcaaagtcgggagcgagagatatattgttttttatcgataatattttccgtttcactcaggcgggttccgaggtttcggctttgttggggcgtatgccttctgcggtaggttatcaacctacgttggctaccgaaatgggtgctatgcaagaacgtatcacttcgacaaaaacgggttctatcacttcggtgcaggctgtttacgtaccggctgatgacttgaccgaccctgctccggcaacaacttttacccacttggatgcaacgactgtgttgagtcgtaaaattactgagcttggtatttatccggcagtggatccgttggagtctacttctcgtattctcgatccgcacattgtgggtcaagagcattatgatgtcgcacaacgtgtgaagcagattcttcaacgcaataaagaattacaggatatcatctctattttaggtatggaggaattatccgacgccgaccgtctggtggtaaaccgtgcgcgcagggtacagcgtttcctgtctcaaccatttacagtggccgaacagtttaccggagtaccgggagcaatggtggccattgaagatacaataaaaggattcaaaatgattttggatggtgaagtagattatctgcctgaaccggcgtttctgaatgtgggaaccattgaagaagctatcgaaaaaggtaagaaactgcttgaacaggctaacaaataa

SEQ ID NO: 330 - DNA, 1809 bp, B.fragilis
caaatgaaaagacacgtttttattcttttattgtcttttgccggagttttgacttctgcttttgctgccagtaggcaagtacaaggagtggtgatctcttcagaagataatatgccgttgatcggtgcttctgtctatataaaagcagaagacctgtcgaaagatggtaattctccgacaataacaggagtaattaccgatatagatggaaaattcaatatttcagtaccggagggggtgacacgtttattctgcagttatgtaggacatgaagtacaggaactcaagctcgttcccggaaaagatcaatatgaaatcacgcttttcccatcagctcagatgcttgatgctgtggtagtgactggttatcagacagtggagcgccgtaagttgacagcagctgtcgggaaactgaacatttcggatgaaaccatcggtgctgtgaaaagtattgaccaggcactggccgggcaaattgccggtctttccgtaacctctacttccggagcgccgggtgcacctgcaaaaatacgtattcgtggtacttcgtcattgaacggaactcaggatccattgtgggtattggatggtattccgttggaaggtacggatgtacctcagtcgaatgtattgaatgatgtttctaatatacagcaatcgtctattgccggactgaatcctgcagatattgaaaatattactgtgctaaaggatgcggcagctacagccatttatggagcacgtgctgcaaatggtgtaattgtgataacgactaaaaaaggaaaagtgggaaaaccggtgattaatttctcctcgaagtttacttatatgcctacattgagtacaaaccgactcaatatgttgaattcacaagagaaagtagatttggaacttgaattgcttcgttctaattttgcgtacggtgacaataaggggggagtttctaaaataatttccggttacggattgactgatgcctataaaaaaggggggtggagtgcgctgactcccgaagcccaaacggatataagtcggttgcggaatacagaaactgattggggcgatattcttttccgcgatgcattcaatcaggagtatagtttaagtctttcgggaggtaacgaacgggtgacttattatacttctatcggatattatcaagaaaatggtaatgttaaaggcgtcgggctggatcgtctgaatattgtagcgaagacttcatataaagtcaaccggatgttgaaattcggagtttctttatttgttaatcgccgtaacaataaaacctacctgaccgatacttatggattggtgaatccggtatactattcgcgtaaggctaatccatactatcaacctttcgatgtaaacggaaattatgtatatgatttcgatgttcagaacaattctgatacggatttagggtttaatatttttgaagagcgtaaaaatacttcgaatgaggaaacgattaatgcactttcgtctatttttgatgcagagttacgttttaatgataaactgaagtttacaactcaacttggtttgcaattggataaagcatcgaaagaacagattgccgataaggagagtttttcaatgcgtataattcgcaaaaacagtaaatattgggattctgcctcccaaagcaataaatactttattccggacggaggagtgcataaagcgtatgagaatacgaactcccagattacctggaaagcaatgggagagtaccgggacagtttcaatgatatccacgaactggaagtaatggtaggtaccgagttgcgtaagcacttggtatga

SEQ ID NO: 331 - DNA, 1593 bp, B.fragilis
tttttttccgggttttgtagggtgtcctcttcctttttttgtatttttgggcatgaattaataaaattagatagtatgataacacctgaagacaaagaattgcttgccaaaaagggcatttcggaagtacaaatcgctgagcagttggcttgcttccaaaaaggctttccttatttgaagttagatgctgccgcatctgtagaaaaaggcattttggctcctgatgccgaggagcagaaagcttatcttgcagcatggaatgcctataccaattcagacaaaacgattgtgaagtttgtacccgcttcgggtgctgccagccgtatgttcaagaatctatttgaatttttggatgctgactatactgaacccactacaaagttcgaacaaactttttttgaatcgattgaaaaatttgctttttatgatgacttgaatacggcttgtgtgcggacagaaggcaaaggtattcctaccctgattgcagaaggcaattataaagcggtcgtttcaggattgcttaatgtagcgggactgaattacggtgcgcttcccaaggggttacttaagtttcataagtatgaagaaggttcgcgtaccccgcttgaggaacatttggcagaaggtgctatgtatgctgccggaaaaagcggaaaagtcaatgtgcattttaccgtctctaccgagcaccgtgaactgtttaaatcattggttaccgaaaaagtcgatgcttttgccaaacgttatggcgtggattataatatcactttctccgaacagaaaccaagcactgatacaattgccgctgatatggaaaaccagccattccgcgataacggtaagcttttgttccgtcccggcgggcatggtgcgctgattgagaatctgaatgatctggatgcggatgttatttttattaagaacattgacaatgtggttcctgataaattgaaaggcgatacagtgctttataagaaactgattgccggtgtactggtatctctccagaagcaagcttttcaatatctggaattattggatagtggtcgttatacacatgagcaggtgatggatatcctgcaatttgtacaaaagaaacttttctgtaagaatcctgaaacaaaagatctggaagatgccgagttggtcatttacctgaagaataaattgaaccgtccgatgcgtgtttgtggtatggtgaagaacgtgggcgagccgggcggtggtccgttcctggcatataatagtgatggaactatctccctgcaaatccttgaaagctcacaaatcgatatgaataatccggaagcaaaggaaatgtttgaaaagggtacgcacttcaacccggtcgatctggtttgcgccgtacgtgattataagggtcataaatttgatttggcgaaatatgtggataaagctaccggcttcatctcttataagtcgaagagtggtaaggatctgaaagctcttgaacttcccggtttgtggaatggtgctatgagcgattggagtacggtatttgtggaggttccactttccactttcaatccggtaaagactgtgaacgacctgttgcgtgaacagcatcagtaa

SEQ ID NO: 332 - DNA, 2595 bp, B.fragilis
cttattattatattgctttcttctttcttttgctttaactttgtcgcaaagtattattgcatggaagagaaccacgaaatagaattagcctggcaagtcattgaaaataccggtacgcatctttttctgacaggaaaggccggaaccggaaaaacaacttttctccgtcggttaaaagaacttaccccaaagcgtatggtagtggttgcacctacggggattgctgccattaatgccggaggtgtcactatacactccttttttcagttgaacttcgcaccttacattccggaaagcacatttaattctgctcagcaaggttttcataaattcggaaaagaaaaaatcaatattatccgtagtatggacttgttggtgatcgatgaaatcagtatggtacgtgccgatcaactggatgcaattgatgctgtactgcgtcggtatcgtgatcgctcgaaacctttcggcggtgttcagctcctgatgataggcgacttgcagcaattggctcccgtggtgaaagaagaggactggagcctgttgagctcttactatgatacagcatttttctttggcagtcattcactgaaagagacggaatatatcacgatagagttaaagaaagtctatcggcaaagtgatacggaatttgtcggattattgaataaaatcagagagaaagaggcagacgacgctgttctggaagaattgaacaaacgttatcttccgggattccgtccgagagaggaagaaggatatatccgactgactacacataactatcaggctcagcaatataacgaccgacaactgctttctctttcaggaagagctttcagtttccaggcgaaggtggaaggcacttttccggaatcggcatacccggctgatgaaatgcttaccgttaaggaaggggctcagataatgtttattaaaaacgattcttccggtgaacatcgatattataatggaatgatcggtttggttacggctgtcagtaaagatggcatccgggtgaaagggaacggagaatcacaggattttctgcttgaaaccgaagaatggacaaatagtaaatacagcctgaatccgcagacgaaagagattaccgaagaggtggaaggtactttccggcaatatcccattcgtctggcatgggcaataaccatccataaaagccaggggttaactttcgaacgtgcaatcattgatgcaaatgcctcttttgcccatggccaggtttatgtcgctctgagtcgttgtaagtcgcttcagggattggtgcttagttctcctttaaggcgagagtccattatcagtgacgatacgattgatgaatttacccgtaatgccggagagatgactcccgacaagcataaattggctctattgcgtcaacattacttctatgaattgttgtgcgaacagtttgattttcatccgattgaacagcattttttacgtttgcttcgcttgcttgacgagcatttatatcgtctctatccaaagttgttggaacgatataagacaactgccgatctgtataaaacgcagataatgaaagtcgccgatacatttaaactgcaatattctgccctattgatggaggctgaagattataccgccaacccgaaattgaatgaacgggttatggccggtgcccactatttccgtcaacatctggaagatttattaactccgctgattacttctacaaaagtagaaacggataataaagaattgaaaaagaaattctccgaagcggcagatgcaatgaagacagcattgcacgtaaagctgggaaccttgtgctataccgagaaggaaggtttttctgtttccgcatttctaaaacagaaggctgttcttacgttatctgtttcgggaggagaagctgcgtcctcttccggaagatcggagcgtaaatcccggacagccgagaaaatagaagtaccgactgatattcttcatccggaattatataagcaattgattgcctggagaaattctgaagctgcaaaagctggtttgcctgtatataccatcatacagcagaaagcaattctgggtattgtaaatctcttgccgaatgatgcggcttcactgatacgtattccgtatttcggaaaacgcggtgccgaaaaatacggtgatgccttgcttgaaatggtgaaccgatacgtagaggagcatggcatagaacgtccgcaaatgccaacagcgacgttgactgtcaataatgggattaaaacgtcgaaagagcccaaacctttaaaagaggctaaatcggtgaaagaaccgaagccagataccaaagaggtaacgtatcgtcttttcaggcaggggaagagtattgaagaaatagccagggaacgcgagctggtttccggaaccatagcgggacatctggaacactatgtacgctctggtgaagttaaaatagagcagttggtggcaagagagaaaatcacgaaaatcatccgttacgtacaggcccatggaagtgataaaggactgacggttattaaagcagctttgggggatgatgtctcatatgcagatataaggttggtacttgctgccggaataaaatag

SEQ ID NO: 333 - DNA, 1587 bp, B.fragilis
attaaccccatgaaaaactatttaggactgattttcctcttgtttgcttttacagcaaccgcacaaaacaatcgttcagccctgttgcctatgcccaatcacatagagcaagtgcaaggtaaaccttttagcttaacaggtaagaacatcacgattcaccccggacaaccggaattaaagtttgcggctactactctgcaaagtatactgaaagaccgcatgcaagtagacattcccctttccggctctcgccaatcccccatccggttaattattgatccacaattggaaggaaaagaacattatcaactcaaagttgaccagaaagggatgaccattagcggagccagtgcagcagccgttttctatggtgtaatgactgtcgatcaagttctcttgggagatgtatgctccagcaatcggaaagaaatgactcctatcagtatcgatgatgcgcctcgctttggctaccgggctttaatgctagaccctgcccggcattttttaccaatagaagatgtaaagttctacatcgatcagatggtacgctacaaatataatgtgcttcaacttcacctgacagatgatcaaggatggagaatcgaaattagaaagcatccgaaacttaccgcaggacaatctttttatactcaagaagagttggccgacctgattcgttatgcagccgaacgccatgttgaaatagtgccggaattggatattccgggacacactgtcgctgtattagccgcttatcctgaactgggatgtacacacaccgataccattgcaaagaatgtaggtgagactgtaaacttaatgctttgtgccaataatgaaaaagtgtatgaagtgtacaatgatattattgatgaagtaagtgctctctttccttcacgttatattcacctgggtggtgacgaagcagttatagaaaagaactggaccaaatgtgaacgttgccaaaagatgatgaaggaactgaaatacgaaaaggcttcccaattaatgattccttttttcagccgtatgctcagtttcgtagaggctgatggaaaataccctattctctggtgtgaattagataacattcgcatgccggccaacgattatctgttcccttaccctaaaaatgtaacacttgtgagctggagatacggattgacgccaacttgccagaaactgacccaacagcatggtaaccctctgattatggctccgggagaatttgcatatctggattatccgcagttcaaaggagatcttccggaatttaataactggggaatgccggtaactacactcgaaacatgctatcagtttgatccgggatacggaaaacccgcagcagaacaggcacacattctgggagtaatgggaacactttggggagaagcaataaaggacattaaccgagtgacatatatgacctatccccgcggtctggcactggcagaagcaggatggacccaaatggaacatcgcaattgggattctttcaaagaacgtttatatcccaatctgaataacttaatgaaaaaaggcgtttcaatacgtgtaccattcgaaatagtaaaaagaaaataa

SEQ ID NO: 334 - DNA, 948 bp, B.fragilis
aataattacatgaaaagaatcttagttagcggaggtgcgggttttattggttcgcatctttgtacccggctaatcaacgaggggcacgacgttatttgtctggataatttttttaccggatcaaaagaaaatattatccatttgatggataaccaccatttcgaagtggtacgtcatgatataacatttccatatagtgctgaagtagacgaaatatacaaccttgcctgcccggcgtctcccatacattatcagtacgatgccattcaaaccattaaaacatccgtaatgggagctatcaatatgttggggttagcccgtaggctcaatgctaaaatattgcaagcttcaaccagtgaggtttatggagatccggaggttcatccgcaacctgaatcttattggggaaatgtcaatccgatcggcatccgttcttgttatgatgaagggaaacgttgttctgaaactctctttatggattatcatcggcagaataacgtacgcattaaaattgttcgtattttcaatacatacggtcctcggatgttgccgaatgacgggagagtggtttctaattttcttatccaggcactgaagaacgacgatattactatctatggaacaggtgagcaaacccgtagcttccagtatattgatgatttggttgagggtatgatccggatgatgaatacgggtgatgattttatcggaccgataaatcttggcaatccgaatgaattttccatgcttcagttagcggagaagatcatccagaagaccggatcgaagtcgaagattacttttaagcccctgccgcacgacgatccccaacagcgtaagcctgatatcagactggcacaggagaaattgggttggcaaccgactattttgctagatgaaggtttggatcgtatgattgactatttcaaaatgaagtataagttataa

SEQ ID NO: 335 - DNA, 375 bp, B.fragilis
ttttgtgacataagccggaaagcttgttttttatgtcaaacccctaaagcgattacgatggatttagaaaaggtattaattagagagataaacaatgatagtcgtatttttctgtataaagagggagattgctggagtgcgcacgataattccgcacggcatctttgctttttatattcgcagttcaatgcgtatgatcgcatttatcaggcgtatgagattgtattaaagtgcgttatgctgagtaatgcaatgattgagaagtttatcgaacatacattggtgagtacggttcatgaagatgaaattgaaatctgcattccaaaagaaaaaagagcagaatttgaaagctggcgtagtacgtccggggtataa

SEQ ID NO: 336 - DNA, 1380 bp, B.fragilis
cttatacgcatggattggaaaataaggaatattaggctacaagaactcagggagatttatcaagagaagctgaaaaacattgcttatagagtatacgagtcacattttcaaaatggtatcgtgaaacaagaggaacttgagggagaaattatgtcttattatcagcatacacaaccttctctacaagagttttattcacactacgctacacagtgggaacatttttacgagggacatgagcttacagacagtgcatttttacgctttcttgaaaattcggcttaccctctacaaatgaaatataaccgtggtgatttaaatcttcaatattatattgaccgatttcatacactcaaaaaacgatcaaaagagtggaaacaccttcgtaatcttttttttgataaatggtatcacctgttggcaaataatgaatataattaccaaatagaacgtatcaacaatctttgtgagagattctatcgcttacagaaaaatattgcagatcaacttccccaacgaggcaatgcccgtttaatgtggctgttgagaacacaccaagaacttgccaaacaactgtttcattatgatgaaatagccaaaaatcacccggctatcagagaactgacaaagatactgggaaagcagcattatggtaaagaaaagaaattccgtatggttgcaggtatccaccgggaacaaatcatcactcatgccactaaaagtgatattaccggagtatgtgaaggtaatgatttaaacagcctcctacccatagagtattgttatctgtcagatcctgctttgcaaccacttttctttgagcgattcaacaagaagaagctgcaaatgatggattatgaatcaaaagatcaacatcgcattaaagatataaaaatacaagggaatgaaattgtagaagaacaatcaggtccatttatcatttgcgtggatacttcaggatccatgagtggagaaagagaagagttcgtgaaatcggccattcttgccattgcagaacttacagaacaacaagatcgaaaatgttatcttataaatttctccaacgacatagcttgtatcgaaatcgaacgtctgggacaaaatatacaggaactggcaaactttctttgtcaaagttttcatgggggtacagatttaactcccgcacttctacacgcaatacacattctaaaaacaaagtcctatcgaaatgccgatttagtaatgatgtcagattttgaaatgcctcctttaaacgaagaactttcagaggaaataaaaaaaataaagcaaaataagactcatttatacgccctctctgtacataaacaaagtgaaaatacctatttaaacgtctgcaataagttctggtttgtttaa

SEQ ID NO: 337 - DNA, 1644 bp, B.fragilis
tacgtaaaaattatgagtatgttctgttttcagtgtcaggaaaccgcaaaaggtacaggttgtatcttaagcggagtatgcgggaaaactcccgaagtagccaatatgcaagacttgctgctttttgtagtacgcggaatcgcagtctacaatcaggcattacgcaaagatggacgttcttctgcccgggcagataagtttatctttgacgcattgttcactaccattacaaatgccaactttgataaacactccattatcgagaaaataaagaaaggactggagctaaagaaagatctaagtaaccaagtcacaatagaacatgcgcccgacgaatgtacttggtatggtgacgaaactgagtttgaagagaaagcccaaacggtgggggtactgcgaacttctgacgaagacattcgatcattgaaggagttggttcactatggtatcaaaggaatggctgcttatgtggagcatgcctataacttaggatatgagaatccggagatatttgcattcatgcaatatgctttggctgaattgacccgcgaagatattactgtggacgaactgataaccctcacactcgctacgggtaaccatggtgtgcaggctatggcccaactcgatactgccaataccagccattacggaaatccggaaatctccgaagtaaacattggtgttcgaaacaatccgggtatccttgtcagtggacatgacttgaaagatattgaagaacttttgcaacagactgaaggtaccggtatcgacatatacacacacagtgaaatgctaccggctcattattatcctcagttgaagaaatataaacacctggtaggaaactacggtaatgcctggtggaaacagaaagaggaatttgaaagtttcaacggtcctattctcttcactactaattgcattgttccaccacgcccgaatgcgacttataaagatcgcatctatacgacaggcgcaaccggcttggaaggtgctacctacatacccgaacgaaaagacggaaagcagaaagatttctccgttattattgagcatgcacggcgttgccaaccaccagtggcaatagaaagtggtaagattgtaggtggatttgctcatgcgcaagtaatcgcactggccgataaggtggttgaagcagtaaaaagcggtgctatccgtaaattttttgttatggccggatgtgacgggcgaatgaaaagtcgcagttactacacagagtttgcagaaaagctaccggcagatacggtaatcctgacagcagggtgcgccaaataccgatataataaattacctctgggggatattaatggcattcctcgtgtactggatgcaggacagtgtaatgacagttactcattggctataattgctatgaagttgcaggaagtcttcggactaaaagacatcaatgatcttccgattgtatataacattgcgtggtacgaacaaaaagccgttattgttctgctggctctgttggcacttggagtgaaaaagattcatttagggccgacgcttcctgcattcttatctcctaacgtgaagcaggtactgatcgataattttggaattggcggtatcagtacagcagacgaagatattgcaaaatttttagcatga

SEQ ID NO: 338 - DNA, 510 bp, B.fragilis
acaaagaagattatgtcattgttactacccgatagtggcctgatattctggatgctcctttcttttggaattgtattcgcagtattggcaaaatacggcttccccgtcattattaagatggtggaaggccgtaaaacctacattgacgaatcattggaggtagccagagaagcaaacgcccagttgtcacgactgaaagaggagggcgaagctattgtggctgccgctaacaaggaacagggacgtatcatgaaagaggctatgcaggaacgtgaaaagattatttacgaggcccgcaaacaagctgaaatagctgctcagaaggaactggatgaagtgaaacgacagattcagattgaaaaagacgaagccatacgtgatatccgtcggcaggtagctctgctttctgtggatatagccgagaaggtcattcgcaaaaatctggatgataaacaagagcagatgggaatgattgaccgtatgcttgatgaagtattaacgaagaactaa

SEQ ID NO: 339 - DNA, 570 bp, B.fragilis
cagaagaagatggaagtcggaataatttcaatgcggtatgcgaaagctctgatggcttatgctgaagagagaggagcggaggagaggctttatcatgagcttgtcacactggcgcacagtttccgtactgtgaagggattttgtgccgtgcttgacaatcctattgtttctgttaacgaaaagtttaatctgatctgtacggcagccgatggggaccataaaccgagtgaagaatttattcgtttcattcggttggtactcaaggagagaagggagacctatctgcaatttatgagtctgatgtatctggatctttaccggaagaagaaacacatcggtgtagggaaactgatcactgctgttccggtagacaaagctacagaagagcgtatccgacaaactgctgcacatattttgcatgcatatatggagttggaaacagtggttgacccttctatagaaggcggcttcgttttcgatattaacgattaccgactggatgccagtatcgctacacagttgaagaaagtcaaacaacaattcattgataagaatcgaagaattgtataa

SEQ ID NO: 340 - DNA, 1437 bp, B.fragilis
acaatgtacttgatttctatttcatcattggctcaacgagctaagtctgttggcatacataagtgtaatggtgcttctgatgggcatatctatcgtatgtttctgtatgaatcagcactattgatattgctttctttattgttcgtgacagtcctgttattcacttttaagttggagatagaagatctttccggagcttcattaaaggctttatttacatggcaaactctgtgggtaccgattttggtttctttggttttatttctggtcatcggactatttccgggcaagttgtttgccgctattcctgtgacacaagttttccatcgttttactgcacatcgttttgtttggaagcgatcattgctttttatacagtttgcgggaattgcatttattttaggcctgttgatggttattcttttacagtatcatcaggtgatgacccgtgacatgggatataaggtcgataatttggcagttgggtggtcgccatatagagaaattgataaaatggacggtattctccgaggactgcccatagttgaggagttttgtaatgcaagtacgattatttatggtggctacatgggtcaaccttacacagatgcacatgggaaggaatttatgggacgtatcgaatttgttgatgaacattatgttccggttatgggacttcagattataaaaggcaggaatatccagcaagataaagagatcttgattaatgaagagatggttcgtcaaattggttggacggatagtcccatcggtaagaatctggaagatggcaaaaataactttggtacgattgtcggagttgtgaaagactatgttgtacaaagtgcgtacatgccacaggctcctgtagcactgatgagtaatttggaatggatgaatgtgcttaataaacggaatattattttgaaagaaccttttggtgagaacctggctaagattaacacattgatgaaagaggcttttccgacagtagatattgtattccgttctgcccgtcaggagattgataagcaatatcaagaggtccgccgtttccgtaatgtcgtgattatagcttctattgctatcctgttgattgctttgatgggactgttcggctttgtaaatgatgaaattcaacgtcgtagcaaagaaattgccattcgtaaagtgaacggtgccgaagtgccggatattcttcgtttggtttccgggaatattttctggacggcactaagtgctgttctggtcggaatagtatttgcatatattgtaagtaataaatggctggaacagttttctgaccgggtatcagtcaatgggggacattttcttgtcgtgatcataattatcttgttgttgatcataggaagtgtcatcgggaggtcctggaatgtggctaatgagaatccggtgaacagtatcaagaacgaatag

SEQ ID NO: 341 - DNA, 288 bp, B.fragilis
agctttattgttattttattaattttttatttttgtatatttatgaatatgtacgttggaaatcttagctataatgttaaggagtcagatttgagacaagttatggaagagtatggagtagtagaatcagtaaaactgatcacagaccgcgaaacaagaagatctaaagggtttgcgtttgtcgaaatgccggaatcttcagaagcaagcaatgccattaaagaattgaacggagcagaatatgccggtcgtccgatggtagtaaaagaagctttgccaagaaattga

SEQ ID NO: 342 - DNA, 921 bp, B.fragilis
ccttttaatgtggatccgctaatttattcacttttacttgtatggtatgaattaaaagttatacctttgcgcccgatttttaatttaaaaagattggatatggctggttatatatcagatgacacaagaaaagtgacgactcatcgcctaatcgaaatgaagcaaagaggcgaaaaaatatctatgcttacatcgtatgactacacaatggcacagattgtcgacggtgccggtatcgatgtaattcttgtaggcgattccgcatcgaatgtgatggcaggtaatgtgactacacttcctattaccctggatcagatgatctatcatggaaaatcggttgtacgtggtgtaaagcgtgcaatggtagtagtggatatgccttttggctcttatcagggtaatgaaatggaagggcttgcttcagctatccgcataatgaaggagagtcatgccgatgcattgaaactggaaggtggtgaagagattatagatactgtgaaacgtattctgagtgccggtatccccgtgatgggacatcttggattgatgccacaatctatcaataaatatggtacatacacggttcgtgccaaggatgatgccgaagcagagaaattgattcgtgatgcacatttactagaggaggccggatgtttcggacttgttcttgagaagattcctgcagcattggcatcacgtgtcgcaagcgaactgaccattccggtgatcggtatcggtgccggtggagatgtagacggacaggtattggtaattcaggatatgttgggtatgaataacggtttccgcccgcgcttcctccgtcgttatgccgatctttatacggtaatgaccgatgctatcagtcactatgtttcagatgtaaagaactgcgacttcccgaacgagaaagaacaatattaa

SEQ ID NO: 343 - DNA, 1332 bp, B.fragilis
gatgaaaaagtttggtttatgaaaatccatttaaagttactcacagagcgctattggtttcgtctcggactaagcctctgtttcgccataactgcggctctgtcttatgccgacagagacttcatttggatgggattgagcctctgtttgctactattcagcatttggtggcaactttcactttaccgtattcataccaaacgagttcttttcatgattgacgccctcgagaacaatgacagcgccattcacttcccggaagagcagataatgcctgagacccgagaggtcaaccgtgcactcaaccgggtcggacgcatattatataatgtaaagtcggaaacggtacagcaagaaaagtattacgaactgataatggactgtataaacaccggtgtactcgttctcaatgaaaatggagcggtttatcaaaaaaataatgaagcgcttcgcctgctcggattaaatgtgtttacccatatccgccaactgaacaaagtggatatacagctgatgaagaaaatagaattctgccgtccgggagataaaatacaaactattttcaacaatgaacggggtacaatcaatttatccattcgtgtatcaggcatcactgttcgtgaagaacaattgcgcattctcgcttttaacgacatcaacagtgaattggatgaaaaagaaatcgattcgtggatacgactgacacgtgtattgactcatgaaatcatgaattcggttactcccatcacctctcttagcgaaacactactatcgttggccgatacccgggatgaagaaatacgccggggcttacaaacaatcagtactacgggaaaaggcctgctctctttcgtggaatcctaccgccgttttacccgtatcccgaccccggaaccatccttattttatgtaaaagcttttattgaccgaatggtagagctggcacgccatcaaaacaaatgtgacaacataacattccatatagatattgctcctgctgatctgattgtgtatgccgacgaaaatctgatttcgcaagtagtaattaatctattgaagaatgccatacaagctatcgatgcacaggccgatggaaagattgaaataaaaggacgatgtaatgctgctgaagaaatattgattgaaataaaaaataatggccctgccattccttcagatatagcagatcatatattcattcctttttttaccaccaaagaaggaggtagtggtatcggattgagcatttcacgtcagatcatgcgtctgtcaggtggaagcatcactctgctgcaaggcaaagaaactaaatttattctgaaatttaaataa

SEQ ID NO: 344 - DNA, 723 bp, B.fragilis
aacctgatggttatgattatgaagtggttgaattttaattccattattggcatggcagtactatcgctgctgttttacacagaaaacgtcgctgcacaaaccgacaaaaacgataccaaacaaaagatagataccatccagacaacacagccggaatacagcaaatatgacaaacgtattcaccgttttcgtaaaggatggaattcacttatacctacacacaacaaaatacaatatgcgggtaacatgggaatgttctcgttcggaaccggttgggattacggaaaaagagatcagtgggaaacggatctgttcttcggcttcatacccaaacatgactcccatcgggctaagatgaccatgaccttaaaacaaaattacatgccttggagcctggagcttgggaaaggattttcaaccgaacctttggcatgtggtatctattttaacactgttttcggacacgaattctgggtacacgagcctagccgttatccggaaggatactacggattctcgtccaagatacgcacacacatctttctgggacaacggctgacatacgatatagatagagaacgccggttctttgcaaaatctgtgactctcttttatgagctgagtacctgtgacctattattgatcagccgcgtaaccaacagttacctgcgggctcgggattatctgagtttatccttcggacttaaattccaatggctttag

SEQ ID NO: 345 - DNA, 255 bp, B.fragilis
cttgatatattcaacagccagggtgaaggtttttccggacccggcggaggctttatagacaatgagttcgctcattcacagtttgtattggataatgattattttctttttactatttcgaatggtacacgtattgaaacgccttttttcattaagttattcagattgggatataaacgttctttgaaagaatcccaattgcgatgttccatttgggtccatcctgcttctgccagtgccagaccgcggggatag

SEQ ID NO: 346 - DNA, 1269 bp, B.fragilis
ttgtctttttctctcttttatcgtaatcatttagtagctcgttcgggatttattggaagaaaagtagtatttttgcgtcattatatcttaaaatattcaatcatgaagaaaatacttttactcggatcgggcgaattgggcaaggaatttgtaatttctgctcaacgtaaaggtcaacacatcattgcttgtgattcatatgccggggcacctgccatgcaggttgctgatgaatgcgaagtattcgatatgctgaacggtgaagaactggagcgtattgtaaaaaagcatcggccggacattatcgtccccgagattgaagccattcgtacggaacgtttatacgatttcgaaaaagaagggattcaggtagtgccgagtgcacgtgccgttaattacacaatgaaccgaaaggctatccgtgatttggccgctaaggaactgggactgaaaactgcgaaatactattatgccaagtcattggaagaactgaaggaagccgctgagaaaatcggtttcccttgtgtcgtgaagcctttaatgtcatcatcgggtaaagggcagtcattggtcaagagcgctgccgagttggaacatgcttgggaatatgggtgtaatggcagccgtggagatattcgtgagctaatcattgaggaatttatcaaattcgatagtgagataactttgcttacagtgacacagaagaatggtccgactctgttttgtccgcctatcgggcatgtacaaaagggtggggattatcgggaaagtttccaacctgcacacattgatcctgcacacttgaaggaagcagaagatatggctgaaaaagtaactcgtgcattgaccggtgcaggactgtggggagtagaatttttcctgagccatgaaaacggggtttacttttcggaactgtctccacgtccacatgatacgggaatggtgacattggccggaacacaaaatctgaatgaatttgaacttcacctacgtgccgtattggggttgcccattccgggaataaaacaagaaagaataggagcgagtgccgttattctgtcgccgattgccagtcaggaacgtccgcagtatagaggtatggaggaagttaccggagaagaggatacttatctgcgtatatttggtaagccgtatacacgtgtgaatcggcgtatgggagtagtgctttgctatgctccaaacggttcggatctggatgctttgcgtgataaggcaaagcggatagccgataaagtagaagtatattaa

SEQ ID NO: 347 - DNA, 645 bp, B.fragilis
  unsure (97): Identity of nucleotide sequences at the above locations are unknown.
aataagagatttatgagatcattaattggaaaacaagcgccgaaattcgatgccacggctgtaatcaatgggcatgaaatcgttcagaactttcgtntggatcagtataaagggaaaaaatacgtagtattcttcttctacccgatggacttcacttttgtatgtcccaccgaactgcacgcatttcaggaaaagctcgaagagtttgaaaaacgtgatgtcgctgtggtaggttgttcggtcgactctgaatattctcacttctcttggttgcagatgcccaagaacgaaggaggtatccagggcgtgaagtatcctattgtatccgacttttctaagtcaatctctgagagttatggagtgctggccggaagctatgcccccgatgaaaatggcaattgggtatgcgaagggacaccggtagctttccgtggtctgttcctgatcgacaaggagggcgtagtaagacattgcgtcatcaacgacttgccgctgggacgtaacgtggatgaagtattgcgcatggtagacgctttacaacattttgaagagtatggtgaggtttgtccggccaattggtcgaaaggcaaagacgccatgaaagctaccgaagacggagtagccaactatctgagtaagcattaa

SEQ ID NO: 348 - DNA, 234 bp, B.fragilis
gatcatttgttttgtgtgattatttgcaacttgatacttaaaaacaacagtttattctttatacggaataaaagacattattacgtattaaaaaagtctcttaaatatttgccatttaaaaataaaggtttacctttgcacccgaaatcaagaacgcttgatggcaatgcactcttagctcagctggtagagcaattgactcttaatcaatgggtccagggttcgagtccctga

SEQ ID NO: 349 - DNA, 900 bp, B.fragilis
actttaactccaaagaaaagcgaatattcacctctatatcataacaatatgcacaccattcagataaatgatgattgttaccgagttccggaaagttgggatgaactcaccgaaaagcaattgagctacctggttaatcttacacaaagcgatattcccatcgaagaactgaaggtacacatgatgctatattgtctcaatgcacatgtttgccggtatcgggatatctatcgccatcaagtaaagatcagcattgggactcccggcaataaaatccctttccggacacacaagaagaaatatttgcttcttcctgaagaagtcaatcggctggccaaactcttcaactttctgttgatgtgcgaaaaggataccgaaatgaaataccatgtacacccggaactcaccgtcaatccctatcgggcattcttttgccggttccgtaaattccgtggtccggaagatggcctgctcgatattcgcttcgaacagttcatgcacctgcaacactatcttgacgccataaatcaggacccggaacaaattaaccatgctctggcctgtttatggcacacaagcaaaacattcaatatcaatcgtctggagaaagatgcttccattctcagccatcttccccacagagtgaagatgattatgtactggtacattatagggagcctggcctatcttgccaatggctttccccgtatcttttccggaaatggaaagagtaatggtcgtgtctttgattcgcaaatgcgtcttttagactccctcgcacagtcagacatgaccaaaaagcctgaaataaaaaaaggattcctgatcgatgccctgtatacaatggatgaatctctgagaaaacaacaagagctgaatgaaaatatgcagaacaaataa

SEQ ID NO: 350 - DNA, 498 bp, B.fragilis
cccctgacttttatggagatatacaaccactttgaatatggcaaaacacttgccatccgcttaaagcctattgcccacacacccgaaaagcccagattcttcaccgctttcggacttgaggacttatataattttaatgataaactatcatccgtatccggcatgatcctgattgcagttgatggttgtgaatctgaatcaaaacgaaacgaatccgatgcgcttaataacaatgatatattctctttcattgttgtacagaacactgtttctgatcgtccggaaacagtcaaccaggcagcaaaagaatgcaaagctatcgcaaaacaaattcggaaccatatcctgcaagaccccgacatttcagaattcattgacgataccattcaatttaatggtattgggccgattggtgataatttctatggcgtagtactgacattttctttggttcaacctgaaacctatttcattgatcaaacatactgggaggattaa

SEQ ID NO: 351 - DNA, 204 bp, B.fragilis
atctatcccccaacttccaacgtatacttaaagatgcatatgtcggacaaatacgaaatgctgtcgctcatacacaataccattgtattcaaggaggaatcttatatgacaactactcaccatcaagtaaatattctatcctgcaaggtctttcttatgaagaatgggagaagaaatatgtctactcttttttcatatttatag

SEQ ID NO: 352 - DNA, 714 bp, B.fragilis
atgagccaacctttttttcagtttaaacagtttactgtctggcacgataaatgtgccatgaaagtaggcacagacggtgtcttgctcggagcttggaccccggtagagtcctcggcacgtattcttgatattggtaccggtaccggattggtggcacttatgctggcccaacgctgttccgcttccgttattgctcttgaaatagacggaacagccgcacaacaggctgcagagaatatcacccgttcaccttggggaagcaggatagaagtcgtttgccaggatttcaggttatacagcaataagaataatagcctgaaatatgatacaatcgtatcaaatcctccatatttcacagactccctgaagtgtccggacagccagcgcaacacagcccgacataacgataacctgtcttatgaagagttgctgaagggagtatcgaatttactttcgccaaatggtacttttacagtagtcataccgatggatgcaagtgattcttttaaagacatcgcatcttcacaaggcctgtatccatcccgccagctcttggtcatcactaaaccgggagcacccccaaaacgtaccttgatctcatttacatttataaaacaagactgcaaagaagagaaattattaacagaagtttctcgccaccgttacagtgatgaatacattaaattaacccgggagttttatttgaaaatgtaa

SEQ ID NO: 353 - DNA, 480 bp, B.fragilis
gaaccggagcccaacctatcccgaaagaagataatagccggttaccacaaccgacaggtaaactcgttttctaacttaaacataaaaacaatgagtgtaaacaaatgtatttttatcggcaacatgggacgtgatgccgaggtccgtaccactgaaaccggcatcaaagtagcccaattttctattgcatgtacagagcgtgcttatacaaacaaagccggtcaaacgattccggagagaaccgaatggatacccgtcgtagcctggaggagattggcggaaaccattgagaagtacacccacaaaggaagcaaactgtatattgaaggcagattcacaacccggaagtatgaaacaaatgacggccagaaacgaaccgtttctgaaatcgtagccgaaagtattgaaatgctcgatcccaagcgggatgctccctcactccctccggaacccgagcagaaattgagttataatccataa

SEQ ID NO: 354 - DNA, 609 bp, B.fragilis
agcagaaagtttatgtaccaatttattgaaacgatacgtatagagagaggagtagtgtataatttggattatcacacagagcgaatgaaccagacgcgtgctgttttttggccagacgaaccgccattaaatctatcggaaagcctgcaaccaataatgaatgtagaaatgataaagtgtagagtagtctatagtcgatggatagaagagatcctatacacaccttatcaaatacgcccagtacattctttacagattgttcattcggataatatcgattacacttacaaaagtacagatcggagtgcaataaatgaactttatatgcataaacgggaacaagatgaaatattaattactagaaatggcctgttgacagatacatctatagctaatattgctctctttaacggaaaagagtggcacactcccaaacaccctctccttaaaggtgtccaaagagcggcattgattgacaaacatctaatcagagaaaaagaaataaccgtagaccaattgtttaactattcccagatttgtttattcaatgcaatgattgattttggtaagataaagattgatgtcaatagagagctaatacggatataa

SEQ ID NO: 355 - DNA, 1260 bp, B.fragilis
acgatgaagttttccgaattacaattaaatgacaatgtacttgaagcactcgacgctatgcgttttgaggaatgtactcctatacaagaacaagcgatcccagtaatactcgaaggtagagacttaatcgctgtagcgcagacaggaaccggtaagacggctgcctttttgttgcctatattgaataaattgtcggaaggtggacatccggaagatgccatcaactgtgtgattatgtcacctacccgtgaactggcccaacaaatagatcaacaaatggagggcttctcttattttatgcctgtttcaagtgtggctgtttacggaggaaatgacggaatactttttgagcagcagaaaaaaggcttgatgcttggtgccgatgtggttatagctacaccgggacgcctgattgcacatctgagtctgggatacgttgatttatcccgggtttcttattttattcttgatgaagcagaccgtatgcttgatatggggttctacgaggatattatgcagatcgtaaaatatttgccaaaagaacgccagacgattatgttttccgctaccatgccagctaagattcagcaattggccaatactatcctgaataaccctgctgaagtcaaactggccgtatcgaaacctgctgaaaaaattgttcaggctgcttatgtctgttacgaaaatcagaaattgggtattgtaagaagcttgtttgcggaagaggtgcccgaaagagttatcatttttgcatcttcaaagataaaagtaaaagaagtggcaaaggcgctgaaaatgatgaagttgaatgttggagaaatgcattctgatcttgagcaggtacagcgtgaatttattatgcatgaattcaaatcgggacgtatcaatattttggtcgctacagacattgtatccagagggatagatattgatgatatccggttggtgattaatttcgatgttccacatgacagtgaagattatgttcaccgcatcggacgtactgcacgtgcgaacaatgatggagttgccctcacgtttgtgaatgagaaagaacaaactaattttaagaatatcgagaatttcctcgaaaaagaaatttataagataccggtaccggctgaattgggggaagctcctcaatataatcctcgttcgtatactaacgcaggaagaggaggaagaaacttccggaacggaaatagaaaaaataataacggtggacgttctacggcacccagatcgggcagaagataa

SEQ ID NO: 356 - DNA, 471 bp, B.fragilis
atgataactaccaaaatcgaagttcccccgcatctatgtgagtatatccgcggcaaatactgtaacctgacctctgatccggtccgtttccccgataacctgaatatctatcacgtgatattcgaccttctccagaagagaccgtcggaagctccggttgatcgtggtaatttagaaatctgtctgcctgaacgaagtataggcaaatccccagtgacctacaactatttagggcttcgctcccaggtaatcatttcccggaaaatagaattgatgatgtgggcggagttgcatgaatacctggacgaacagaagcaccggtacggaatcaaatacattgatggagtgcaattcttcatgcgcagatatggaattgattctcttacggaagaagcttttctcaaacactaccagcgttggagggcaaaagtgaggagaaaagaaaaaaggagctataaaaagcgagaataa

SEQ ID NO: 357 - DNA, 312 bp, B.fragilis
gaggatgatactggcgataatggatatacttttaccagttgcattcctacttcttcttacaatagcggtctcgacagtgacaaaacctataataatacaaaagtctatcatagttcttctcttattcaggtaataaaatccgaattaactcacgaagctgcattgctgcacgttctttttctatcggtgatgtgccttcggataataggatatcgacgagggttaatgctttcttcttattcatggcattctcctttcttttctttctcaatttggttaataagattacgtatagcgattaatctgtcatag

SEQ ID NO: 358 - DNA, 312 bp, B.fragilis
gcaggatgtacatcactcttggctaataaaacgaaagcccagatccaggcaatcaacgatatagtgatagctattgtttttaatatacgctcttggcccttggtaaacgctccttcaggaataccgttaccaatcatttttgagttggcaggaatcaatgaaaaacgggtagaagatgttgctgcggttgctatacaagtagttatcagtcccactccggcaactacatgtccagctacgaaagaggaggtagaggtagatcgggtaaacatgcaaattccgccaataattgtgacaacagcagccagataa

SEQ ID NO: 359 - DNA, 1143 bp, B.fragilis
ttacaatgcactatgagtttaacagcaaacatatatccgtctacaatcgctttagccggaaatcccatcaagctgaccataaactccagttcagtagtcagctacactattcgtcaggccgaccgcaccatcttttccggaagtggtgaaggtgagttctctgtttttcttcaggatatcctttcaggtattctcagtcccaaacatctgctcaatgaatccactgatatattactgctcgattctacttcagctacagatattgccattagtgtccaaaacacccagggagagactaaaactctttctctgaaagcagttataggaggcatcagcaagcggctattacggcgtctgttagatgaaaatagcaatatattcacttggaagctgttcaattcatcggtcaatttcttcaagaccacccgtaccaacgggcgtatcatcaccatccgcgaaactgaactcctacctattcctttcctttatccggatggtgcattaaaagtcgttgcagccggcattgaaacctctttatccggaacagccggacaaccggtagcccttaacctatatcggctccggaaaaaactgtttcaaactaatcaaaagttagcttctgttttcgatatctattccggatcaaccaaaagttgtactattgtcatcactcccggaacagtatcccgtgagcgttatttacttgaatttctcaactcctatggagcctatgaacgcattgaagtcaccggtatcggtaacatcgagtctgaaattgagtccgactccacttatcagatttacgatgaaagcattgatgattatatcgaggcccgcgagcgacagtctgcccgtgacaagcttctggtcgaatcaggatatcgcaataccgaagaacttgtgcatttaatggatatgcttgcttccgatgacataaagatactcggactttccggacgaaacatcagggtaaatgccgtagctgacaacctcacccatgccatacgctccactgtaccagaaagcattaaaatgactcttcatttcgttgactccgatgttcgctacaccggatcactttcagaggacgaaataggaaatccccgtatacataccgaacagttcacacctcaatttaattga

SEQ ID NO: 360 - DNA, 969 bp, B.fragilis
aaatacaggtttaacctcagaaacagaagaaaaatgaatgctatcatccctgacatcgacacactcaagaaagtagtcaaaatcaatgctacactgcctgacgaagccatcaatccgtatattgatgatgctatggatatctatctgacgccatacatcggtattaaaaccgtagaaaaggcactgaccggaactgataaaaggctgaatgataaaattctccgcaccctggggcctctcaccctaatgcttgccactccggaacttggcatacgtatcggagacagtggaattacggtcgaaaacaaacaaggtacctactcgccggccaatgaagcaaaaattgccgccgctaaagaaagcttctattttcgtggcatgcaggcccttgatcggctgctcacttttctgaccgatcatccggaaacttaccccgaatacgccgagcactgcaaacaagccacagattcttcatgcttcatccgtgatgccagagaatttcaagataccggtttagtcaatatcgagtattctaccgtatcgttccgtatgatgctacctactgtccggcagttgcaagaacgcaatgtgcgtgaaatgctcaaagaagacctataccaacgtctgcttgatgcccataccgcagggaaagaactgacaccaaaagaaaaggtactgctggggcacatactccgttacctcgctaacaaaaccgctgaactctatacatcacagacctcacgtgaacagcgtaccatcaacgacacaccggagtttactcccattatccggcccatctaccaggatcaggcagcaaccggtaatttcttcgctgatcaagcgacctactacgccggaaagatacaaaacttcatttccgaaaatgctgaggagttaggagtcacaccaaccgttaccgctataaactttaactccaaagaaaagcgaatattcacctctatatcataa

SEQ ID NO: 361 - DNA, 789 bp, B.fragilis
aacatgataacctgggataacttctatttgttcgcagtcgcttcaatctgtctttggttgacaggagctatatttgcacttcgttcgtcagtacgaagtagaatggccgttgtgctcactatagcaggcatcacctgcttgggaatattcattgccgggctgtggatatctctgcaacgtcccccactccgtactatgggcgagacccgtttatggtactctttctttatgggtattgccgggttattgacttatattcgttggaaatatcgatggatactttctttctccaccttattgtccactgtctttgtaataatcaatctgctgaaaccggagatacatgaccagtcgcttatgccggctttgcaaagtatttggtttattccccatgtcaccgtctatatgttctcctattccgtattgggatgtgctttcatcatagccctctgcggtcttgtccatcacaaagaagagtacctggtgacagcagacaatctggtctattccggagtggcgtttttgtcaatcggaatgcttctcgggtctttgtgggctaaggaggcatggggtaattattggagttgggaccccaaagaaacctgggcggtagtaacctggatgggatacctattatatatacatctgcgcttgcgaaggaagtttcgcaaaaagatgctgtacgtcatactgattttctcctttctggcattgcagatgtgctggtatggagtgaattatttgccttcggctcaacaaagtgtacatttatacaatcgtaataattaa

SEQ ID NO: 362 - DNA, 3750 bp, B.fragilis
ataaacgaaacagtctctaatatggcaaacgacctaaaccgcagtattaaactttatattgatggctcagaagccactaataaaatagacctggtaaaagaaagtatttctcgtcttgaagataaactcaggtcacttaccggaaaagaagtagattatgcaaaacgctcccaggatctcaaaaaagaactggatgcaaaaaaccgaactcttcagaattacgagaaacagttagccgaaacagaacgggttctcaaaagcctctccggagcaacttacaacgaactccttgctgtccagtcccgcgttcggaaagagcttcgtaatgcagtgcccggaacgaaacaatatactgctgctcttgagcagaatcggcgtgtcactgaagccctttccagagcacaggccaacatgcgcgtcgaggtaggtgcacaaggtaatatctggtcacgtgcctccggattcattaacaaatatattggtctgatcggtactgtcatagcagctatcaccggagtttcaatgaaactcaaccaactccgagaacagcgaaacaaacgcgaggaagccaaggccgatgttgaagctcttaccggactttccaaggacgatataaactggttggaacagcaagctgtccagttgtcaacgacaatgaccgaatccggcattcgcattagacagtccgcaacggaaattcttgatgcctacaaattggtaggctctgccaagcccgaatttcttgataacaaagaagctttggccgaggtgactaaacagacccttatattagcttctgcatcaggtatgaccctgaaggatgcagtcgatgccgtaaccctttctctcaatcaatacggtgatggtgccgaccaagcttcacgctatgcaaacgtcatggccgccggctctaaatatggagcagcagccgtggagtccgtcaccacagccgtcaccaaatccggggtagctgctgcctctgccgaaattcctatcgaacagcttgtaggtactattgaaacactggccgaaaaaggtatcaaagacgaaatagccggtaccggtttaaagaaattcttccttactctacaaaccggagcagatgatacaaatcccaaaatcgtcggtttagagaaagctttggataaccttcagaaaaagcaactctcagcagcccagattaagaagcaatttggagaagaaggatacaatgtggcctccgtacttatcaatgaagccgataaggtaaaatactacactgaggcagtcaccggtacgtccgtagccatggaacaggccgccacaaaatcagaaacagcggcagctaaactatcgcaagccaaaaaccgcatgcaggaacttggtattgaattattagaaaagctcaatcctgccctcatatcagcagcaaatggtgctgtcagttggactggaaaactcattaaactattaaacttcatcaatgaaaacaaaagggcaattacgttattgaccattgcccttatagcttacacagctgctaagaactctgatgtaataatcagtaaagtcgttacattttggaataataatattgcaaagtctttaaaagccattaagaaagagctgatgacaaacccctatggtataatagccgtagtcgcggccacagctatagcctacctcataaacttaaaaaagaaaaacgatgaattgaaagattctgtatcaggaataaaaaaagtaaatgaagagaccaataaatcatttattcaacaagaatcgaagatacgtgctttgactgctgtcatcaatgataatggaattgcgcttggtgttcgtcgaaaggctttaaatgatctaaaagaaatcattccagactacaatgcccaactaaccgatgaaggaacattaacgaaaaacaatacagacgcaatcaaagattatctggtacaacttgaaaagcaaatcaagttaaaggcagcacagcaagaacttgaaaatctttatgcccagaaacgtacactggaaaaagatgaagaaacccaaagtgatcaatattggaagattcgccaaaccaataccttacaaggatataatcggaatagccttacagctaaaatttccagactttttggtacagaaaaagaaggaaaagcattagaaactcttaatgaaacgcgaaaaaatttatcctcaatttctgagaaaatagatgaaataaccaaagagataggtgaatcagctttagccatagaggaggtcaacaaagcgaatgaagaaactacaaataacaaaataacaactcccataattgatgaagagaaagccaaagcccttcttaaaaagaaacttgaagaagaagctaagctctactcccaacaccagtcggaacttaaagaagcctatctcaaacgccaggacgaaaccttgcaaaccgaacagcagtttaatgaccggatggaaaccctcgaattagaacatcagcaacgtatcattaatatagccggtgcaaaaagtaaagaaggtattgatgctcaaaatcgaatcaacgatatcaaaattaaacagcaaaaagagcagatgaaccgacagctcgctgaagaaaagacactttatgaaaaccaacaaaaggacctaaaacttctctatgtttccggtaaggatgaaaatctgaaaacagagaaagagtacaatgaagcaatggagcacctcactatcatgcacctggaacgtgttctcaaaattgctaatctcgacgctgatcaacggcgcaccattgaacaacaactactcgactttaaagtaaaatgtcttcaagatgaagaaaaagaacggaagaaacttgaagatgccgctcaaaagaaaaaagatgaactggccaggaaggagaaacaaaggctcactgaacaggcacaacagtaccggcaatacggtgaacagatcggcgataccctcggacaaatgatatcaggtcaagaaaatgccctgcagaactttgctgatactatgctcgatatactattcgatgtactaagccagatgattgatattgaaatagccaaggccacgggggtagctgtcggagctgtagcccgttccgctgccgaagcctatgccatgcccgactctgttgcaacctttggagcaactggtgcagcccgtgctgcagttctctccggactgatcatgggagcattggccgctgcaaaatcaacgctcaaaggactgattaaaagggggagttcttccacttccgcgatcgataacaataccgacagtaccaaaactgcccaggtgcaagtcaagcaatgggcatccggcagatacgatgtcattggtgaagatgatggccggacttatcgggatgttccctacataggtgattcaccgaccggaatcgtccgccgtacctcattgatatccgaatccggagcagaactgatcatcaatgccgaagatctttcccgtcttcagcaccacattaattaccccattgtcgtgcaggccattcaggatgcccgcagtggccgagttccccagcgtgctgaaggcaattacgatccgatccgtaacagtatttcccgtacctctcagacaacttcttcaccgactgataaggaagcaaacttggctcaactgatcaaagagttacatgcactgattgagaaacttaaatacctcaaagcatacgtcgtgcttcgcgagctcaacgaagcacaagaattagcagataaatcaaaggaaccattcacccgcaaaaaacaataa

SEQ ID NO: 363 - DNA, 462 bp, B.fragilis
actatggaaacattaacggcattacaatgggctaaaaagggttttattcccaatgagggggtcaaaggtacagaacagtggactaactgctattattctgccaaagctgtctatttcaaagacagtgaggtccatgaagataaggacgctgccaaagccatcctgtctgccaaaaggaaggagtaccgggatgcagccaagaaacgggaggagaaaagaaaaaaaaatgctgcataccgagagaaaatgaaaacccggtggcaatggttacaggagggaagaatacctaacgataatgccagatggaaagttggagaggagctgaataagacattttgtacatgtgcttacggaagtaactattgttattgccatgagagatatacccatgaacctaaaaatgatgaagagatgcaaaaagctatttttgattttcataagaacggaaatagctgggtatga

SEQ ID NO: 364 - DNA, 1098 bp, B.fragilis
cgacttatgacaaagctaatcagaacatttcatcctgtaggacatggagctttttataccgaaaagcatgttttagaagatcagactataaatattgtgtatgactgtggctctaaaactttggaaaaacaattaccaagtataattaataatacttttaagaaaggagaagagatcgaatttttatttatctcccattttgatgcagatcatgtcaacggaatagagtacttgaaaacgtactgtaaaattaagaaggttgtcattcctttaattgaagataaagacgctatcttaattatcaaagcaattaatacatctaaaataggaagtaataaactggatactttaatagatagtcctgaagagtattttcccggatctgagattataaaagttaaggctgtaaacgaaggttatgatgatgatcgatattttgctaatgatttgaacaatgggggaacaataccaagtggaagtgaaattatattacataaatcaagcgctgaaaataaatggtgctttatcccattcaactacaattacactgaaagagtaaatctatttaaagataaaatcaaagaaaaaggattgattttcaataaattaaataatattgattatgttcaaatatcacagaaaaccataaagtctatatataaagcaataaaagggaaagccaatgggaactctttagttgtattttctggaggagattatgcaatttctgcaacgcattatttttctactgacaaaaaaatagtattagaatatgatagatgcagctatataagctgcatctatttaggagattcttttgctaacaagtcggacttttatagtcaattaaaaggaagattggataagttgaccgaaagtattggtataatacaaatagctcatcacggagccaagggaaatttttctcctaatatcttaaagttaggaactaatcctttggctataatatcctgtaaatcaacagacaagcatcacccatctgttaatgtcgtaaaacagatacaggaaaatggttcaataccattcatagttacagaaaaaccaactacagaagtagaacagataggatactactaa

SEQ ID NO: 365 - DNA, 351 bp, B.fragilis
ttgttttattttactctattttctactgaatcagttgaatccagatctaatctcaaacttctgttgtttctaaatttatttatcaatttttattttttttattttatgaacatgtacattggaaaccttagctatcgtgttaaggaagcagatttgagacaagtaatggaagagtacggaacagttgattcagtaaaactgatcatcgatcgcgagactcgcaaatcaaaaggattcgcattcgttgaaatgccgaacgacgatgaagcaaaaaatgtgatctctgagttgaacggagctgaatacgaaggccgtcagatggttgttaaagaagctctgcctcgtaactaa

SEQ ID NO: 366 - DNA, 1299 bp, B.fragilis
aaaaacattgcaaaggtaagctttatctttataaccggacagctttcatataattttatacctttgcatttcataacaactatcaagagtatgcgtaaatttattatttctttctgctgctatgtcttctttatttttactttggcagcgcaggacaaggctccgcattacaccgtaattgtttcattggatgccttccgctgggattatccggcaatgtatgatacccctaacctgaaccagatggcccgcgagggagtaaaggcgactatgcttccctcctatccggcgtctactttccccaaccactatacattggctacgggattggtgcctgaccacaacggtattatcaacaacactttctgggatgtaaaacgtcgtcgccaatactctatgggagatcccgccacgcgaaacaatcccgactactatctgggtgaaccgatctggattacggcacaaaagcagggagtgaagacaggaaacgtttattgggttggttcggatattgccatcaaaggcggttatcctacttactaccgggaatatgccgagaagcctcgtcttacttttgaacagcgggtggattcgaccatcgctcttctggaaaagccggaagcggaacgtccccgtctcgttatgctttactttgaagagccggatggcgtgacccatcatcatggcccccgcagtgtagaagctgctgccattatacaccgtatggatagtttagtcggaatgttgcggcagggaattgcatcgcttcctttcggtaaggatgtcaacctgattgtcaccgccgatcatggaatgaccgagatcagtgacgaccgcgtggtagacatgaataagtatctgcgtccggaatggtgtgaggctgtggatggacggactccgacctctatcttcacaaaaccggaatatcgcgactcggtatacaatgccttgaaagatgtaccccatattcatgtgtggaaaaaggaggagattcctgtcgaattaaactatggaagcagtgaccgtatcggtgatattgtagtggctcccgagttaggatggcaatttaccgatgtaccacgtgccttgaaaggtgctcatggatattttccgcaaagtccggatatgcaggtaatgtttcgtgcctgtgggcccgactttaaggcagggtatgaatcgaagggatttgtcaatgtggatatctacccgctgttggcccatttattgaaaattactccggagaagacagatggacagttcgaaagaataaaagacattctgaaagatgtgtctttttga

SEQ ID NO: 367 - DNA, 969 bp, B.fragilis
tacatatattttatgacaagaaacgaacagttagaaaaatggttgtcaaaccgtcagcgtaggtacgctgacggtatggaactctttaacgctttagcaaaggcaaacaccaagagcagctatgggaactatctttcccaggcaccggagaatcctcacattttcgatccccactttacacaattagtcaatatactgactaaaatagccagggaaataaaagatgctccttctgtttacccggctgcattcgaagagatcctgatcgttcaaacactgaatgatgaacaacggactcaagaaaccgatatccggacagaggcaatcgaccgactccaagaggagatcgacggactgcataaccgtatcagcgaacttgagagtgacacggaaaatcatgctgacgaactctcagctttaaatgaagagttcgaggagaaaatgaaagagctctccgctatccggggcgaactggatgccttgaacactccgggcgtcaagatcgtaacagaagaatccctcactcctgccttacgtaaagcatacgcccgtatcaaagagatcgctcccctgtacgccagtctccataatgatattgcgaatccggatatcccggcagaggaacgtcaccccctcgcagaagaactctgcaagctggacgacgaacgtcgcaaactttggaaacagattgacgattacgcagaaggcaaacaggcaaccttagagcttgatgctaaacgtcctgagtatagtgaaaatgcagtggtcagaggcttcgaaatagcccgtcagatcaaacgtctgaagcagaacattacgaacagcaaaacagccgcagagagggccgggaaagagggaaaacaggctgttctacagaacgcactcgaccggattgccaaatacgaaactgaattagccgctttaacggcagaattatcggcagaacaaggtgaaaaggtttcaggataa

SEQ ID NO: 368 - DNA, 192 bp, B.fragilis
tttgcgatagcacaagtcggaacatttatccggccgcggtacgcatcagcgtatcgcggctttgttttttggggtcgttccccctttacccccttttgcttagaagaacgttttgaacaactgtacctgagacgaagtaaagccggcaacaaggtgtctatatattatttttattttttctttcttctgtaa

SEQ ID NO: 369 - DNA, 1725 bp, B.fragilis
ggaatgacagcccaagcctctcccataccatcggcgtacgaactccggatgaaacaggccaatgtgatacggaagttcttcaacaaaatgcaacgccaggcaatggctattgccgcacatgacgaatatatcgttgcatcgcgtggtaccggtaagtcagaaggtatcgacgcccgcttcattctcagaaacgtctgggaaatgcccggttcattgggtggaatgatctctcccagctatgctaaagcctgggggaatacccttccggctatctgtaaagcactcgccgaatggggatacattcaaaatatccattatgtcgttggccataaagcaccaccttccatgggctttgccaagcctgttcgtccggtactcggagacggatggagtaatgctttccatttctggaatggcacggtcatggtcattctttcctttaatcaagggatgtccgcaaactccatgtcgcttgactgggtgataggtccggaggcaaagttcctttcctatgacaagataaagaacgaggtcaatccggccaaccggggaaaccggcaatatttcgggcactgtcctcaccatcacagcgtatgttactcaacggacatgcccggatcatccatgggacgttggattctcgacaaacaggaagagatgcagcccccacatatccaactcattcgcaacctgtataaagaacttcaggattacaaacgtaaaccgctgaccgaacacaccatgcggatgatccgggaacttcaacgtgatcttgacatagcccggaagtttcagcctgcactcaaaccgaatgataagaaaaaacgggaatacactgtattttatggtgaatatgatgtctttgataaccttgaggtcttgggagaagacttcatttggcagatgcagcgtgattctcccccgttggtatggcgtaccgccttcctgaacgaacggctgatgaaagttcccaacggcttttatagtgccctggacgaccgcatacatttctatcagccggctgataacggaaggctgaagaatcttggaagtaattggaagcaactgagttcctgcggctgcctgggagacggtgaccttgattttgacaaagaactgcatattgcattcgactccaatgcgtcaatctcgacagcggtagtggcacaattggacgggaatacgatgaaaatcatcaaatcgttctatgtcaaaaccccatccaaactcggagacctggtacaacagatagctgactattaccgtcccaagctcaatcacgatgtagtcgtctactatgatcatacttttacctgggagtcgggctccacaacagaaacctatgcggatatcattgagcgtgtattcaaagagaaccggtacactcctgcaatggtatatgtcgggcaagcacccaaacatgaatggaaacacctcaatatcgatctcgcattgaaaggtgatccgcaattcctgtggattcgtttcaatctctatcaaaacgagttcctcaagatcgccatggagcaaaccggtattaagcaaggtaaaaacggttttgagaaggacaaagctccggaaggtactgacgatactccggacaatccggatcaatacaaaacccatgttacggatgccttcgacacattatggctcggcatgaatttctacttcacacgtccgggaaccggcaccggaggaatatttttcctcaatcggaaataa

SEQ ID NO: 370 - DNA, 3057 bp, B.fragilis
actatgtattttaatgatgatgagataagacgtatcaaagatgctgccacaggacatttgcttgatgttgcacaagacttccatgaactcaaacgctccggagtgaattacaattgcgattgtccccggtgcaaagccgcaaagaaactctcaattagtccggccaaacaaatctttaaatgctttggatgcaatgaattgaaaggtggagattcggtttctttcttaatgtccgctgaaggaatgactttcaatgatgctcttgaataccttgccaaaaaattcaatgtcattctcgatcaacgtccggccatcaagaaacaaccggcaaaaaagatgaaaaaaagcagcaaggctgccaaaggtatcgatgtcgacagttattgtgccaggatgttggctgaatcaggtcttacctttgaggatgtcacagcaaaggtatataagacaggagatacacaaagtatattcgaacaacgtactttccgtcctggtaccattgatgaacgaggaatgttaaccactaagggagatgatgtcatcattgaatattatgatctggaaggaatgccggttgtcttcacccggaaagataataaaagaagggacgttggtactcctcaagaatattatcgtatcagatggcagtttccggatgcccaccttgataaagagggtaaaccttacaaatacaaatccccgcgtggcagcggtactccgatctatattccggagcgcatacgcagtctctataaatcaaagacaaagataccccgtctctatattcaggaaggtgaaaagaaagcggagaaagcatgtaagcacggcattccctcaatcgcagtcagcggtatacagaatctcggtctttacggtgcccttccggaagacctggtgaagatcatctctacctgtgaggtacaggaggttgcttttatctttgattcggactgggacgatatcagctccaatatccggatcaatgatcaggtcgaaaagcgtccccgctgttttttctatgcagcaaaaaatttcaaagaatatatgcgttctctcaagaaccggaacatcttcgttgaaatattcgtcggacacattaataagaacgaagcaggagacaaaggccttgatgatctgcttgcaaattctctgcgtggaaaagaagaagagctggccgccgatatcgagtttgcatgcaatgaaaagaaaggtttgggcaaatatattgagatgttcaaggtaactacctggacagatcataaattgcaagaattatggggactccactctcatgaagtctttgccgagcgtcatgccgacctcctgcgtaacctgccggagttcctattcggccgatatcgatggaaattcgacgaacatggaaaagtaatcttggcacaaccttttgacgatgatgaaaagttctggagagaagtcactaaatatgatcgtagccaaaatgaacgtattgaatacgagttctgctatgtcaactcacaaaacttcttgcaaaacagaggattcgggcgtctgcggagaattgataagagttatcagttcattcaccttgaaccgcctgttgttcgtgctatcgatgcctctgatgcccgtgactacctgtttcagtttgccaagcataattgcaagactgaggtaaacgaaatgttgattaaaggcgtgtctcaatatgtgggtccggacaagttatccctgcttgagttcattcagcccaatttcgttaagcccaaccgggaatcccagtatttctattttgataaaaattgctggctggtcacaaaagattctgtaagcgaactcggttacgagaatatcacacaccacatctgggaagagcaacgtaaaatgacaccggccaaatatctgggtaaaccgttggttacttttagccggcaagacaacacatttacttacgaactttcagaggccggtaagaaatcccattacctccagttcctgatcaacaccagtaactttacctggagaaaatctgctgaagaaatagagccggaagaagagaatgaaaatcgtatccatctccttagtaaactgtgtgcaatcggatatatggttatggaagcgaaagacaataatgtggccagagctgtcatcggcatggatggcaagcaatctgaagtaggagaaagtaacggccgttccgggaaatcacttgtaggggaattgatgcgtaatatcattcctacagcctatattcccggaaaacgctctgatctttttaatgatcaatttgtatggaatgacattcaggaaaacactaaactcgtttttattgacgacgtgttacaaaacttcaactttgaatttctgttccccaacattaccggggattggtcagtaaattataaaggaggtagaaggatcactttaccatttgcgcgatcacccaaaatgtatattgccaccaaccatgccatccgtggcagtggttcaagttacacggatcgccagtggctacttgcattctccgatttctataacgatacccataagccggttgacgacttcggggttctcttcttctcggagtgggattttgaacaatggaatcttacctggaacctgttggccaattgcgtccaattgtatttgacttatggcgttgtccaggctcccggcgaaaggttagagcaaagaaagctgcgtcaagaaatgggtgaaaccctaatctcctgggctgatgaatacttctccggagaagagcatctcaatgtccgtttaccccggaaagatttatatgacgcattttgccaatacgacaatcagcaacgaaagtttgtatcaccaaccgcatttaagaagaaatttataatgtattgttcttggaaaggttatgtattcaatcctcacaaatatgacagtataaccgggaaaccttttcaagtcgataaggacgggaaggcggttgtagatgataaatccggaggtgtagagtactttacggtaggaaccggagcccaacctatcccgaaagaagataatagccggttaccacaaccgacaggtaaactcgttttctaa

SEQ ID NO: 371 - DNA, 840 bp, B.fragilis
aagttgccggcaatttgcattaaaaagaagagaataatgaagattagatttataagcctggccagtggcagtagtggaaactgctattatctaggtaccgaaaaatacggcatactcattgatgcgggtattggaattcgtaccattaaaaaatcactgaaggacataaatgtgactatggactcaatacgtgcagtatttattactcacgatcatgccgatcatattaaagctgtaggacatttaggtgagaaattgaatattccggtatatactacggcacgtgtacatgcaggaatcaataaaagctattgtatgacagaaaagttgcatggttctgtacgctatttggaaaaagaagaaccgatgcaattggaagattttcgtatcgagtcttttgaagttccgcatgatggaacagataatgtaggttattgtatagaaattgacggaaaggttttttcattccttacagacttgggagagattactccaaccgctgcccgatatatttgcaaagcccactatctgatcattgaggctaattatgatgaagaaatgcttcgtatgggaccttatccgacatatctgaaagagcgtatctcaagtaaaacaggtcatatgagtaatatagataccgccaactttcttgcggaaaacataatggagcatcttcgttatatttggctttgccatctgagtaaagataataatcatccggagttagcatataagacagttgagtggaaattgaagagtaaaggtattattgtcgggaaagatgtgcaactacttgctttaaagagaaatacgccttcggagctctatgagtttgaataa

SEQ ID NO: 372 - DNA, 342 bp, B.fragilis
tgtaaggaggcatatcaatgtaaaatcattgaagccgggttcgattcccggaagcccacactaattttgatcattatgaaaacagtacattcatcaccaagcctgtctccaagtggaacaaagagacagaaagctaatctatttacaaacgaaaatccggaaactatcgcacaaatgcgcatgcagtctgcacaaaaagagcagcataaggtcatggttcgtcttgataaccgcacacatgtacttgttgctccgcaaaatgtaactcctgagtatatagaaatgctgcgaaaaaaatatcaaattacctacaatgctccagctcgaggaggaaggaggtaa

SEQ ID NO: 373 - DNA, 222 bp, B.fragilis
ataagacattttgtacatgtgcttacggaagtaactattgttattgccatgagagatatacccatgaacctaaaaatgatgaagagatgcaaaaagctatttttgattttcataagaacggaaatagctgggtatgactataaacaagatcagaaaggatctaatatgaaattaagaaaaaaggaactaaagtatggaatcagaaactataaaaacaggtaa

SEQ ID NO: 374 - DNA, 1080 bp, B.fragilis
tcagttaattttgcacacatgattgaattggcacagcatattgaagtattattattagagaatgattgtgtgatcgttcccggttttggtggatttatagctcactacgctcctgctatgagagtggctgaagagaatttattcctccctcctacccgtactattggtttcaatcctcaattgacgttgaatgatggtgtcttagtacaatcttatatggctgtgtacgatactaacttctcggatgctacgaaaatggtagaaaaagaggtggcagaacttatctccgctctgcatgaggatggaaaaactgatcttcctaatattggagaaatccgctataccattcataatacttacgagtttgttccttacgacaataaaattaccactccttacctctatgggctcgactcgtttgagatgaaggagttgtcggctttgcgacgtccggagaaagaacaaattcttccgactgttcttaagaaaaagacaagttatgaattcagagcgaactgggcctttttgagaaatgccgtagctatgattgcagcggttgcattgtttttctttatgtcaacaccggtagagaatacatatattgaaaaaggaaattatgcccggctacttccaactgatttgtttgaaaagatagagaaacaatcggtggcaatgactccggttatgctaaaatcagttgatgccatcccacaaaccaaaccggcaactgcgaagaaaaagtcgtccactgttcgtaaagcatctgtagtaaagccggttgcggtaaaagaagtgaaagttaaccaaccggaaaagacaatgaaagcaaccgaaactaaggttgtggaaaaaacttttccatatcatataattattgccagcgtagctaatacgaaagatgcggaggcgatggcaggtgaacttaaagccaagggatatacaggtgccagagtattgacgggtgacggtaagattcgcgtgagtattatgtcatgtgccgatcgtgaagatgccaaccgtcaattgttgaaattaagagagaacgaggcttataagaacgcctggatgttagctaaataa

SEQ ID NO: 375 - DNA, 2025 bp, B.fragilis
tacatcctttttatggaaaagactcttaatcttattaaaaatgatccttggctggaaccttacaaagacgctatcgttggacgttttgaacatgccatggataagaaggccgaattgaccaatgggggaaaatctacgttatcggacttcgcttccggatatctttatttcggtttgcatcacactgataaaggatggatattccgtgagtgggcaccgaatgcatcacatatttatatggtgggtacattcagtaattgggaagaaaagcctgcttataaactaaaacgcctgaaaaatggtagttgggaaatcaaattaccgatcgacgctatacaacatggtgacttatataaattacacgtctactgggaaggcggacagggagaacgaatccctgcttgggccaatcgggtagtacaagatgacaatacaaaaatattcagtgctcaggtatgggcaccggaaaagccatttaaatttaaaaagaaaacttttaagcctagtacagatccactgctaatctatgaatgtcatatcggtatggcacagcaggaagaaaaagtcggaacttataacgagtttcgtgaaaaaattctgccgcgtattgccaaagagggatataattgcattcagattatggctatacaggagcacccatattatggtagttttggctatcatgtatcgagtttttttgctgcatcgtctcgttttggaactccagaagagcttaagcagctgattgataccgcacacggattgggtattgctgtcattatggatatcgttcactcacatgcagtgaagaatgaagtagaagggttaggaaactttgcaggtgatccaaatcaatatttctatccaggcggacgaagagaacatccggcatgggattcactttgttttgactatggtaaaaatgaagtgatgcattttttactttccaattgtaaatattggttggaagaatatcattttgatggcttccgttttgacggggtgacatccatgctttattatagccacggattgggagaagcattttgcaattacggcgactactttaatggacatcaagatgataatgccatctgctatctgacattggcaaacgaattgattcatgaagtaaatcctaaggctattaccattgcagaagaggtttcgggtatgccaggacttgccgccaaggtggaagatggaggatatggatttgattatcgtatggctatgaatatccccgattattggatcaagacaattaaagagaagatagatgaagattggaaaccatccagcatgttttgggaagtaactaaccgtcggcaagacgaaaaaacaatttcgtacgctgaaagtcatgatcaggcattggtaggagataaaacgattattttccgcttgattgatgcagatatgtattggcatatgcagaaaggtgatgaaaattatatagttcatcggggcgttgctcttcacaaaatgattcgtttactaactgcaagcaccattaacggtggatatctgaactttatgggaaatgaattcggacatccggaatggatcgattttccgagggaaggtaatggatggtcatgtaagtatgctcgccgccaatgggatttagtcgataataaaaacttgacttatcattatctgggtgattttgatgcagatatgttgaaagtaattaagagcgtaaaaaacatccagcaaacccctgtacaagaaatatggcacaacgatggcgaccaagtgttagcgtaccaacgtaaagatcttgtttttgtattcaattttaatccgagtcaatcattcaccgattatggctttttagtaacaccgggaacttatgaggtggtactgaatacagataacataatttatggaggaaacggcttgtcagatgatagtgtgaagcatttcacattgcccgatcctttgtataagaaagaaaagaaagaatggttgaaactctatattcctgcacgtacagcaatggtattgagaagaaccaaataa

SEQ ID NO: 376 - DNA, 1146 bp, B.fragilis
cgaatgaatttatatttaaaacacaccttattttatctattaggtatatcttacgctttgatatcttcagcacagtctaatccggataaactacaatgtaaagtgacaggacgcatgcttctggatggcggtgtttatctcaaaaatgataataattttggtaatggagttgaattcagtgatcttcggataggtgcaaaagtcgcatatcaaaattgggatatgaaacttgaaataggctataccggcaataaagcgacaataaaagatgcttttgcaaagtacacatacaagaaccactctatacaagtcggacaattctacgaaccgtttagtttagaaatgatgtgcagcactttcgacattcgctttaatcaatctccaggagctgttcttgcattaacaaacggcaggcgaatgggaatcacttatggttaccgaaacaaacgtcattatatgtcaggaggggcattcatggataatgaagtcaacaacctaaaaaaagcgtcacatggatatgctttggatggcagggtagtatatcgtccggttttagatagcaagaaacttattcatataggttttgcggccaattaccgcacccctaacgaatccttaaatgaagaagataaaaacatatttatctataaatctcctggtgtgagtacgattgataaccgaaatattgcaatggctactattgatcatgtagcgtatcagataaaatttggcacagaattactggtttattatcaccgtttctgcctgcaaagtgaatatatacgtactcatgtggaacgagacaatgcttttaagaactatgtggcacaaggagcctaccttcagtgctcttggcttttatccggagaaacttatctgtacgatgaatctgttgcatgtgccggtcgtccggaaggaaaaagtctggaggtttgttcacgatttaactatttaacactcaacgatgaggatgcctccatttggggaggagaacaaaaagatatctccatcggactcaactattatattaataaatatataggtataaaattaaactatagctatctgatgcccggagccagtataaaagagatcagccgcaaaaactttagtgtttttcaaggacgatttcaattcattttttaa

SEQ ID NO: 377 - DNA, 516 bp, B.fragilis
cggcagaattatcggcagaacaaggtgaaaaggtttcaggataactttcctttggctttgtgtcccggttctatcgaaccgttcatgcacaaaggagactgggcaatacatgaagtgttgccctctcttttatctgaaatcggaccggcggatataaggatcgctacattcagtatctcagaggacagtttacgccctctcttcttcctggccgatgataaaaaaattacaggtctgaccctcctgctcgatacgacggtaaaacggcacaagcttgacttgttactgtttgcctccaacatcacaccacgcatacggattgactcctgtcatgcaaaagtgttattggtggaaaatgacaaatatcagttcggtattgccggttccgcgaacctaaaccagaatcaccgctgggaaaatggattctatttcacttccggaaagcatttcaattacttcttggaaatgttcgagcaggcatataatcaagcaatcagttacgaaatattagaatag

SEQ ID NO: 378 - DNA, 582 bp, B.fragilis
gaaattgattattattgggggcaattaataagtcctggcccacaggcgaatgatatgagaatacaatttgaaattaaagaaaaattacctgatattatcggggaaattctgaattccgaaaaatggatgacccttattaaggaagatatttcgggtaggaaattggttgtaatccgtgatcaggcattcgattcggaggcaactgtggagatttactctcgcgaagtgactattaagacagcatggtccagatacacttatcggctgtttgttttaggagactgtgtatggtgtgagtataatggtgcttatcgtggattattagagcaaaaactgttgccatctatcacccctaaagagagtctgttggattcggaagttctggacagctcattgtatgggcatgaaaagaagaaacttcgggaatatgctgaagataatcttaaactgaagaaattcagacgtgagaattttaatgaaaatcgtacgggggtagctccttttgatcatccaaagaaagtatatgatgaattcattaaggaagactacattgctccttcctcgaaggagaataataaatag

SEQ ID NO: 379 - DNA, 1227 bp, B.fragilis
ggtatagattatatggtacaaagtcagactcagccgattcgtagaattgcatttcctatattaattgcattaagtgtatctcactgtttaaatgatcttttgcaatctgtcatttcggctgtatatcctctttttaaagaagatctttcgttaagtttcgctcagattggattgataaccctagtttaccagatgtcagcttctgtatttcaaccactgaccggccttatttttgataaacgtcctatagcttggtcgcttcctatcggaatgagtttcactttgataggtatgctgaatctggcttttgcatccaatctgaattggctgcttgcttctgtctttatcattggaataggttcgtctgttctccatccggaagcatcccgtatcacctttttggcttcgggagggaaaaggggattggcacaatcactttttcaggtaggtggaaatctggggggatcgttaggccctttattagtcgcattattagtggctccttatggcaggcatcatattgcactatttgctatccttgctttggcggctatttgtgtaatgtttcctatttgccgctggtaccgttcttatctgaaccatcttaaaaaacgtccgatccatgcaaaagcatatatcgagcgcccgcttcctcctcaaaagactgtatttgctatcacgatactgatgattcttatattctctaaatatatttatatggcaagtctgaacagctattatacattttatctgatccataagtttaatgtaagcattcagcagtcgcaactctttttatttgtatttctggtagccactgccattggtacattgatgggaggccccattggagacaagataggccgtaaatatgttatttgggggtcgatcctgggaacagctccttttagtttattgatgccacatgccggactcgtatggactataattcttagtttctgtgtcggcttaatgctttcgtctgcttttccagctattctgttatatgcacaagagctgcttcccaacaagttaggactgatttccggactttttttcggttttgcatttggagtggcaggcattgcatctgctgttcttggcaatatggccgataagtttgggattgatgctgtatataatgtttgtgcatttatgccgttgttaggattggtgacctggtttttaccggatctgaagaaagtgagaagtgaaaaacaagaataa

SEQ ID NO: 380 - DNA, 195 bp, B.fragilis
gataccattctgtatggacgagatggcactagtaaaggagaactgctcattgacataaaactgtgcaatatggtgaaagagtttacacctgacatggcaaacagcatgcaaaagattgttcggaaatgtttccctagaaccctgcagatagtgaacaagattcatgtattcacactggtgtacgaagcgatgtga

SEQ ID NO: 381 - DNA, 2484 bp, B.fragilis
actaatttatacgaaatgaagaaagaaagatatttaagagagatggatgaccagaatgataacgcattttcattaattgccgattttgacggaaacgaagatcaagtgtttgacataaaggttggtgaaactcttccggtactccccctccgtaatatggtattgttccccggagtatttatgcctgtttctgttggcagaaaatcatctttgagattggtgagggaagccgataagaaaaaatcttatattgcagtagtttgccagaaaatggcggaaacggacgagccggcatttgaggacttgcacccgatcggaaccataggtaagattgtgcgtgtactcgaaatgcccgaccagacaacaacagtcattatccagggaatgaaacgcctggagctgaagaatatcacggagacacatccgtacctgaagggtgaagtgaacattgttgaagaagaaatcccttcaaaagatgataaggagtttcaggcattggtggaaacctgcaaggatttgacaatacgatatattaaatcatcggacactttacatcaggaatcagcgtttgccatcaaaaacctgacgaaccacatgtttctggtggactttatctgtacgaaccttccgttgaagaaggacgagaaaatcgaactgttgcgcattgattcgttgcgtgaacgtacctatcggttgcttgaaatcctgaatcgtgaagtgcagttggccgaaataaaggcatctatccagatgcgtgcccgtgaggatattgaccaacagcaacgtgagtatttcctgcagcagcagattaaaacgatccaggacgaactgggtggtagcggccaggaacaggaaatagaagagatgcgccaaaaggcagaacacatgaagtggagtaccgaagtgcgggaaactttcctgaaagagcttgccaagctggaacgtacccatcctcaatcgccggattacagtgtgcagttgaattatctgcagacaatgctcaatctgccatggggagtttatactaccgacaatttaaacctaaagaatgccgagaaaacgctgaataaggatcattatggtctggagaaagtaaaggaacgcattctggaacatttagccgtacttaaattgaagggtgacatgaagtctcctattatctgtttatacggtcctccgggagttggtaagacttcactgggaaaatcgattgccgcagccttgaagcggaaatatatccgtatgtcattgggaggtgtgcacgatgaagcggaaattcgcggacaccgtaaaacttatatcggtgcaatgccgggacgtattatcaaaaacctgattaaagcgggttcttcgaatccggtatttattctggatgaaatagataaagtgagtgccgaccgtcagggagatccttcatcggctttacttgaagtgcttgatccggaacaaaatacggctttccatgataatttcctggatgtggattacgacttgtccaaagtgatgtttattgctacggcaaacaacttgaataccattcccggaccattactcgatcgaatggaactgattgaagtgagtggttatatcacggaagaaaaagtggaaatagcacgaaagcatttagtgccgaaggagttggaagcaaacggaatgaagaagaccgacattaaaattccaaaagatacgctggaagctattatcgaatcgtacacacgtgaaagcggtgtgcgtgagttggaaaagaaaatcggtaagattcttcgtaaatcggcccgccaatatgcaacagatggtttcttcttaaaaacagaaatcaaaccgactgatttgtatgacttcctaggtgctccggaatatactcgtgataaatatcaaggcaatgattatgccggtgtggtgacaggattggcatggacagccgttggaggtgaaatcttatttgttgagaccagtctgagccgcggcaagggcggacgtctcacattaaccggaaatttgggtgaagtgatgaaagagtctgctatgctggcacttgagtatatcaaagcacatgcttcactcttaaatctggatgaagagatctttgataactggaacatccatgtccatgtccccgaaggagctattccgaaagacggtccgtcggcgggtatcacaatggctacttcgttggcttctgctttgacacaacgtaaggtgaaggctaatctggctatgaccggggaaatcacgttacgtggcaaggtacttccggtaggtggtattaaggagaagattctggcagctaagcgtgccggcatcaaagaaattattatgagtgccgagaacaaaaagaatattgacgaaatacaggatatatatctgaaaggactgactttccattatgtgaatgatgtaaaagaggtctttgccattgcactgactcaagagaaggttgccgatgccattgatttatccgtaaagaaagccagccaggaatga

SEQ ID NO: 382 - DNA, 198 bp, B.fragilis
cagattatatacataacactaaatatcggatgccggttatttttgttatccaaagatgaaaaacaatcgttaaatattgaattatctcgggaagaaatagaatatttctttaaaccttatcctgcagatgagacggaggcatacgagatatgcaatgattttataaagaaaatatcaacagataaaagtattctgtaa

SEQ ID NO: 383 - DNA, 213 bp, B.fragilis
tatataatatattatcagcgttttattttgctttgggagcagggggtcgtgggttcgaatcccgctaccccgacaggaaataagagtaatcacacatgtcaatgtggttactcttatttcattttgtgctatggtggaattccgataatacggaatgatgcaactggaacagagcgacgccttttacattttcaaataaaactcccgggttaa

SEQ ID NO: 384 - DNA, 696 bp, B.fragilis
aaatatgattttacaattaaaagaggaaaaaagatatggaaagaatcattggatggtatcagccaaatagatgccttccctgttttaaaagcacgacttggcaaaagtctgccacaatttgtttatactctaagtccggataaacagactgctactctgcaaataatgaacttatatcaattaccacaactaaaacaattttgtgactcagtcttttcggtgattaacagagaacatgtacccaatttggttatagatgtcaggaataacaaaggagggtcaagtgctggagttgacatgcttctgtcatacttatcgcatgatgcttatacattatatatcaaaactgatttaaaaatcagttcgtactcaaaacggtacaatgagcaaaaacatccggaaacctatgaagagatcaaaaatttacctgacggttctttatttgctattcgggattctttcgtagagggaaaccgggacaaagcagacatttataaaggatcagttacagtattggtaaatgaatccacttattccggagcctcgacatttgcatctgccattaaaaaatctcatgcaggaaaagttcttggcgaaaccggctgcccaactgtatattttggcaattacatgtcattcacattacccaattcccgattagaatattatatctcactcaacaaattttatgaataa

SEQ ID NO: 385 - DNA, 552 bp, B.fragilis
ctaaataaatattttataatgaaaagaattctttgtcctaaatgtgagaactatctttcttttgatgaaactaaatatagcgaaggccagtcattggtttttgtatgtgaacactgtggtaagcaattcagtattcgtctggggaagagtaagatgaaggctcctcgtaaggaagagaaattggatgaagatgtatataaagaagagtttggctgtatcgttgtcattgaaaatgtcttcggtttcaagcaagtcttacctctgcaagaaggtgataatatcattggccgccgttgtgtaggtacagatattaatactccgattgaaaccggtgatatgagtatggacagacgccactgcattattaatgtgaagcgtaacagacaaggaaaattggtttatactcttcgtgatgccccaagcctgaccggaactttcttgatgaacgagatcttgggggataaagaccgtattcgcattgatgacggagccattattactattggagccactactcttatccttcgtgctgcaaaaaaagaagaaatttga

SEQ ID NO: 386 - DNA, 210 bp, B.fragilis
gaaaggaggtacgaaatgggacgaataaaagaagaagcctgggtcgaaaagtgtaccgtacttcatgaaggaaaggccacacccaatatctattataacgtttttgccgatggtgagcagctctgcgaaatctcctatgacagattaatcgctatacgtaatcttattaaccaaattgagaaagaaaagaaaggagaatgccatgaataa

SEQ ID NO: 387 - DNA, 513 bp, B.fragilis
cctaatcatcttatggatataatcgacagaattaagcaatatcttaatcataaaggaattagtgattatagatttgagaaaacattatccctatcaaaagggtacataaataaagctaaaaatccaaccgcggatatattaatgaagatgtgtggtatatataccgacatatctactgaatggctgcttagaggtgaaggtgagatgttgagggagaaaagagaagaccttggccttcatcgggctgagtcagcatctacagatgaaaactctttaatctataagatgtataaagagaaagacgatgaaaataaaaccctaatcaagcagaatgccgttttagaggaacgcatccgccaactcgaagctgacaatgaatcattaagaagtcagtcaggagctgataggataaccgatactttttccgatctaccattagtagactacgaagaagattatccgcccgtagaacgtccttcaagttccaaacatccgttagcaggaaaagcgtga

SEQ ID NO: 388 - DNA, 579 bp, B.fragilis
atctcttttcatatgatagataataatattttctcttgtggtcctttaccatcaaatgatggatatacatggacaattgtttctcgtttaggcgatatgcttaacgaagctgaagccctatttggtgaacgagataaaagatatacaatacttggtattgagttagctaatataaaacaaccacaaatatggtatccaaacgattgtaatcatgtcataatacaggtcaccgaagattgcagcaacaatatggaaagggcaatatttcaggtggctcatgaagcgatacattgcttatgtcccaatccaaagaaaaagactactattttagaagaaggactggctacctatttttctatgtattatacacgtaaacgtaaaatttattacaatattgataatcttcagtatcaaaagccttatgaattttgttctaaattactaaactatgattctgagttgattaaaaaagcaagaataatagaacctgacatttcttttatcaacaaagagatattactaaatatatgtcctaagatagaccatactttattagatgaactaactaaaaaattttaa

SEQ ID NO: 389 - DNA, 333 bp, B.fragilis
ttaatatttcatcttgttcccgtttatgcatataaagttcatttattgcactccgatctgtacttttgtaagtgtaatcgatattatccgaatgaacaatctgtaaagaatgtactgggcgtatttgataaggtgtgtataggatctcttctatccatcgactatagactactctacactttatcatttctacattcattattggttgcaggctttccgatagatttaatggcggttcgtctggccaaaaaacagcacgcgtctggttcattcgctctgtgtgataatccaaattatacactactcctctctctatacgtatcgtttcaataa

SEQ ID NO: 390 - DNA, 246 bp, B.fragilis
tcaaaacatcatatttgcaacatgaatgacgataaaaccatcacagcagcaattgagacaagcaatgtaactgcattgcttgccgcttaccggaaatttacaagttcctccggggctacaaccgatgaatttttccgtttcatcaccacccccactccggaacgggaagagttcctggcattgtactgctcttcgacctcttctgtgtccggtaccattatacaaactaattacaatgcactatga

SEQ ID NO: 391 - DNA, 321 bp, B.fragilis
tcaagcaatcagttacgaaatattagaatagaaatggagttatcagatgaaaccttgcaacaaatcagagagatggccgcagctctgctgcctccggcagaaatcgccattctaatttcgctgcctgccggtgaacgcagctacttctgtgatatttgcagaaatcatcatcattctcctatctacgaagcataccatcagggacgcctgcaaacaaaattcgaactccgaaaaactgtgatcaagttagccaaggccggaagtccggcggccgagccacttgctgataaatacatgaaagaacaaatcatcaacgactaa

SEQ ID NO: 392 - DNA, 201 bp, B.fragilis
ttacatgatcagttctgtttcattgattcggggtcaaatgaaaccatttacaatggattggcagaggactgtttatgggagatcgtactcttcagtaacggattcgtttatcacgctctgcagaagttccggatctttatagaggaaaaggactttaaccataccgtcctttacaactcccatttccatctcaatttctaa

SEQ ID NO: 393 - DNA, 1125 bp, B.fragilis
aaagagtgtcaacaagactataaatttatgagaagcaatcggtttattaaacgcctggacttatatatcatcaagaaattcttggggacgtatgtatttgctattgcattgattatctccattgcagtagtattcgacttcaacgagaagatggataagtttatggaacggagtgcgccgtggtcggcaatcatcttcgattactacatgaactttattccatatttcgcgaatctgttcagtccgttgtttgtatttattgctgtcatattcttcacctctaaactggctgaaaactccgagattattgcaatgttttctaccggtatgagttttaaacgtatgttgcgtccttacatgatatcggccggtatcattgcgatttctacctttatattaggatcgtatgtgattccaagaggcagtgtgactcgtctggactttgaagataaatacgtgaaaaagaaaaagaccacttatgtacacaatatacagttggagatagacacaggcgtgattgcttatattgataactatcaggattacaataagacaggaaaccgtttttcgctggataaattcgtagataagaaactggtatcccatttgactgcccgtagcattacttatgatactactgcggttaataaatggaccattaaggattatatgattcgtaatctcgacggattaaaggaaactattgtccgtggagataagatggattccattataccgatggaacctgccgatttcatgattatgcgtaatcaacaggaaatgttgaccagccctcagcttagtgcatatatagataagcagaaacaaaggggtattgccaatatcaaagagtttgaaatagagtatcataaacgaatcgccatgtcatttgcatcattcatcctgactgtgatcggagtatctctttcttcaagaaaaacaaaggggggaatgggattgcatttgggaataggacttggactgagcttttcatatatcctgttccagaccgtggcatctacttttgcggtaaatggaaatatgcctccgatgatcgccatgtggattcctaatttactgtatgcgctgattgcattttacctatatagaaaggctcccaaataa

SEQ ID NO: 394 - DNA, 246 bp, B.fragilis
ggtttaagtcatcttcattcttttttatcttccattttcggatttggtcttgccggcgttctgctgaccaagtattgtccggatccaactttgtttgaatccagagaggcctgggaagttgccagtgtgaatgcacattacatctggtattactttgcggcaatcggtttggttgcagcaattgctttgcttatttttgcaaaaatcactgatttcatcgataaaaagaagaaaactaacgtctga

SEQ ID NO: 395 - DNA, 1521 bp, B.fragilis
aacaacaaccaacgtatgatgaaccaagaattattaatgagtcccaaccgtttggtgacttttctgcaaaagcctgctgctgagtttacaaaagcagacatcattaactatatccaacagaatgaaatccgcatggtcaattttatgtatcctgctgcggatggacggctaaaaactctgaattttgtgataaacaatgcttcctatctggatgccatcctgacttgcggtgaacgggtagatgggtcgagtctgtttcctttcatagaagccggaagtagcgatctgtatgtaataccacgttttcgcactgcattcgtcgatccgtttgcagaaatacctacactcgtgatgctttgctccttctttaataaagatggggaacctttggaaagctctcccgaatatactttgcataaggcttgcaaagcatttacagatgtaacaggtatggaatttcaggctatgggagaattggaatattatgtaatttccgaggatgacggtctatttccggctaccgatcagcgtggatatcacgagtcgggaccttatgcaaaattcaatgatttccgtacacaatgtatgtcttatatagcccaaacaggtggacaaataaagtacggacactcggaagtaggcaattttatgcttgacggcaaagtttatgagcaaaacgaaatagaatttttacccgtcaatgccgaaaatgcggccgatcaattaatgattgccaaatgggttatccgtaatttagcttaccaatatggatatgatattacttttgctcccaaaattacagtaggtaaagctgggtcagggctacacattcatatgcgaatgatgaaagacggacaaaaccagatgctgaaagatggtgttctctcggataccgctcgtaaagccattgccggtatgatgcaacttgctccttccattacggctttcggcaataccaatcctacttcatacttccgtcttgtaccccatcaggaagcacctaccaatgtttgttggggtgaccgaaaccgttcagtattggtacgtgttccgttaggatggtccgcacaaacggatatgtgtgcactagccaatcctttggaatcggacagtaactatgatactactcagaaacagaccgtagagatgcgttcaccggatggctcagccgatctttatcaattattggcaggtcttgcagtagcttgtcggcatgggtttgagatagagaacgctttggctattgcagagcaaacgtacgttaatgtaaatatccatcagaaagaaaatgcagacaagttgaaagctttagcccaacttcccgatagctgtgcagcatctgcagattgtttacagaaacagcgtactgtatttgaacagtacaatgtattcagtcctgctatgatcgatggtattatcagtcgattacgaagctataatgatgccactctacgcaaagatatacaggacaaaccggaagagatgctggcactggtgagcaaattcttccattgtggataa

SEQ ID NO: 396 - DNA, 570 bp, B.fragilis
aatatggaccaattgcaattaatacaaagcaaaatatatgagatacgtggacagaaggttatgctggattttgatttggcggaaatgtacggtactgaaactaaatatttaaaacgttcagtaaaaaataatattaaacgttttccatcagattttatgtttgagctaacgaaggaagaattcgacagtttgaggtgcagttttagcacctcaaaaagaggcgggacccgatatatgccttatgctttcactgaacatggagttgctcaactttcttcagttcttaacagcgatttggcaattgagattaatattcaaatcataagggcatttatagcagttcgtcagttaatctccaatcctccggttgatagagtcgataaactgaaagaagaaatcaaagcattaaaagattacatcgaagaagcatttactgactacaacgatataaatgatgatacgcgcatgcaattggaattaattaatcaaactttggcagaattgcaagcgaaaaagaaagcggaagaaaaacctcgtaacccaatagggtttatcaaacctaaacactaa

SEQ ID NO: 397 - DNA, 231 bp, B.fragilis
caaaaacgccactccggaatagaccagattgtctgctgtcaccaggtactcttctttgtgatggacaagaccgcagagggctatgatgaaagcacatcccaatacggaataggagaacatatagacggtgacatggggaataaaccaaatactttgcaaagccggcataagcgactggtcatgtatctccggtttcagcagattgattattacaaagacagtggacaataa

SEQ ID NO: 398 - DNA, 1002 bp, B.fragilis
atagtaaaacaaagaataatgcaattctatagtagaaatgaagctattaaccgtataaacaaactggctggagcaggaaaagcatttctgtttattatagattataaacaagaatgttcttttatagagaaagtggatgatattgattcatcggagctactctacaatctgaacggttttacaaactgcacgtctgttgttacacctttcagatacccaataatatggcagccccaacctatttctttaagccaatataaaagatcgtttgatattatacggaaaaatatcttgagtggaaatagcttcttaacgaatctcacttgcatgacccccgtcaacactaatctagggttaaaagatatattttatcattctcgggccttatacaaactttggttgaaagagacttttgtcgttttttctccagaaatatttattcgtatagaaaatggaagaatcagttcttatccaatgaaaggaacaatagatgcaactttaccttctgccacaagattactgatggaggatgaaaaagaagcagcagagcatgccacaatcgttgatctgatacgaaatgatttaagtatagtggcagataatgtatctgtaacccgctatcgatatgtagatacactctataccaatcatggtcccatattgcagaccagctctgaaataagtggagttttaccgaaaaactatgttgatcatctgggagaaattcttttcagacttcttccagccggttctattacaggagctcctaagtacaagacaatagaaataatagagcaagcagaagaatatgagagaggattctatacaggcatcaccggatactttgacgggagaaaactggatagtgccgttatgatccgctttattgaagagcagaatgggcaaatattttttaaaagtgggggaggaatcacctgcaaaagtgatttggaaaatgaatataacgaaatgaagcagaaagtttatgtaccaatttattga

SEQ ID NO: 399 - DNA, 537 bp, B.fragilis
acaatgaaacatcatgtacaccttatcatttattttgcttgcatttcagttggtatactgctgtgtgcttgtcgttcttcttctctacattctaatcaattcaaagagaatggaacttttcagcataattacaatgaactcaataccggtaccgggaccattgcctcacaagtcaaaaccactaaagacgaacacggttcatcctggaagatcacgtaccattttgacacggcacaaacacccgatcccacaaccggcctacccccactatcgggtatcgagattgaagggagcgaaaaacagagtaaaaccgcgcaggaaagtaatgacactgtacactcttcgaacagctcttcaaagagagaggtatccggtcaaaccatacaaagagaatccgggacagagaccaagaaagatagcaaagtagcaaccggtacggatgatggcataagaaacggcctcagtatcgggatacctttgctttttatcatcatagcactatcgtattatgccaagcgacagaatacatcaaagtaa

SEQ ID NO: 400 - DNA, 828 bp, B.fragilis
gtaattttgcacaaaattaaacagatgataaagtacattgcaacattgttactgacggtcttattcgtagcatgcaataatggcaaaggacaacagccctctgaagaaaatgaagaccccaaggccaaagagattctccaaggcatttggcttgatgatgaaactgaaactcccttgatgcgcataataggagatacgatttattattccgatgctcaaagtgctccggtttatttcaaaatcctaaaagatacgctctatacctatggcaaagacgtaacccactatcaaattgacaagcagagtgaatattctttttggttccattctctggctgataatattatcaagctccataagtcggaagatcctaatgatacattggcattctcctttaagtcggttgaaatcattccgacctatacagaagtcactaagaaggacagtgtggtaatgttcgatggcgtccgctacagagcctatgtatacatcaacccctcacaaatgaaagtagtgaaaacaacttattcggaagatggtatcagtatggacaatatttactatgacaatgtaatgcatatatgtgtgtatgaaggcaaaaaaagtttatatgccaaggacattaccaagcaaatgtttgtagatgtaattccaacagattttctgcaacaggccattctatctgatatgaattttacaggaattgaccgcaaaggctatcattatcaagcactcgtctgtattccggaaagtccggtatgcaatcttgtgaatcttaccatcagtttcgatggaaaactaaatataacggctgcaaaatataaataa

SEQ ID NO: 401 - DNA, 381 bp, B.fragilis
aatcattttaatactttaaattatttaattatgggcttagatatagcaattgcttcagctgtagttgagattattacactgatttttttcttcgttttatgtcgaaatgtttccaaaatcaaaaaagagattgttagcaatgacaatttacctggtatgtttgccatgtatatatccttgggagaaacggacaaagcaaaaaaaatattgtataaggcgattagtaaagaaccggaatttatcgcagcattctgctacaatggcaataattcagcacagcaatctacattgaaaagaaaatataaaccatacttggaaatccttggacttgagttagattttgaattggtaaataagttcatccaagaaagagaaaagtga

SEQ ID NO: 402 - DNA, 1413 bp, B.fragilis
gtaatcattaagaatagaatattaatcattccggctttctttcttcttcccaaaagaagaagaaagggcaaagcccctaaaattttaaataagatggcaacaaaagagtacttcccgggtatagggaaaattaaatttgaaggtaaagacagtaagaacccgatggcatttcgctattacgatgccgagaaaatgattaacgggcgtagtatgaaagattggttaaagtttgcaatggcatggtggcatacactttgtgccgaaggcggtgaccagtttggaggcggaaccaaacagttcccatggaacggtgaccctgatcccgtgcaggctgccaagaataaaatggatgccggtttcgagtttatgcagaaaatgggcatcgggtattattgcttccatgatgtcgatctggttacggaagccgacagcatcgaagcctatgaggccaacctgaaagagctggttgcttatgccaagcagaaacaggccgaaacaggcatcaaactgttgtggggaacggccaatgtattcagccacgcgcgttacatgaacggtgcagccaccaatcccgattttgatgttgtggcccgtgccgctgtccagataaagaatgcgattgatgccaccattgaactgggaggtacgaattatgtcttttggggtggacgcgaagggtatatgtcgttgctgaatactgatcagaaacgcgaaaaagaacatctggcacagatgctgaccattgcccgtgattatggacgtgcacgtggtttcaagggcactttcctgattgaaccgaaacccatggaaccgacaaagcatcagtatgatgtcgatacagagacagttatcggcttcctgaaggctcacggactggatcaagacttcaaagtgaatatcgaagtgaatcatgccacccttgcaggacatacgttcgaacatgaactggcggtggctgtagacaacggaatgttggggtctatcgacgcaaaccgcggcgattatcagaacggatgggatacggatcaatttccgattgacaacttcgaactgacacaagccatgatgcagattatccgtaacgacggattgggtaacggcggtacaaacttcgatgccaaaactcgccggaactctactgacccggaagatatctttatcgcacatattgccggaatggatgctatggcacgtgccttggaaagtgcagccaatctgctcaatgagtctccttaccagaaaatgttgtccgaccgttatgcctcgttcgatgctggcaagggcaaggagttcgaagaagggaaactcagcctggaggaactggttgcttatgccaaagccaacggagagccgaagcagaccagcggccaacaggaactgtatgaagcactcgttaatatctactcattataa

SEQ ID NO: 403 - DNA, 597 bp, B.fragilis
atgatctataatattaacgtaataacaaataataaatttagtatgaaaaagaacagattgactttggttgctgccatttttctcagtggtactatcctatttagttcatgtgtaggatcattcggactgtttaatcgtatttcttcctggaaccagtctattggtacgaaatttgtaaatgaacttgtttttcttgctttaaatatcgttccggtatatggcgttgcttatctggcagacgctttggttatcaattctattgagttctggagtggcaccaacccgatggctaatgtaggtgatgttaagaaagtgaaaggtgagaatggtgattatttagtaaagactcttgaaaatggctattctattactaaagaaggtgaagattcagctatggagttgatttataataaagaagcaaatacttggaatgttgttgccgatggagttagcacagagctattgaaaatgaacaatgacggtactgctgaaatgaacttaccgaatggagataaaatgaatgtaactcttgatgcacaaggtatgatggctgcacgtcaggctacaatgggcggactgctctttgctgcacgttaa

SEQ ID NO: 404 - DNA, 1533 bp, B.fragilis
actacaaataaattaataaacagtatcatgtttttattaggttatgatataggcagctcttcggtcaaggcgagcctggtagatgcagaaacaggtaaatgtgtcgcttctgcgttctttccgaaaacagaggcgggcatcattgccatacgtcccggatgggcagagcaagaaccggaaagttggtgggagagcttgaaactctccacccgatccattctatcggaatcacgggtagatgccaaagacatcaaagccatcggcatctcttatcagatgcacggtctggtgtgtgtggacaaacggcaacgcacactgcgtccggccattatctggtgcgattcacgtgcggtctcctatgggcagagggcattcgaggcaatcggtgagaagttctgtctggcacatttgcttaattctcccggaaactttactgcttcaaaactggcatgggtgaaagaaaacgaaccggatatctatgaacagatcgataaaatcatgttgccgggagattacatcgccatgaaactgagcggtgaagtatgtacgacaatagagggactctccgaaggaatgttttgggacttccgaaacaaccgcccggccgacttcctgatgcaatattacggaatcgatccttcgctgatagccgacatccggcctactttcgccgaacaggggcgactgacaggtacggctgcccgggaactcgggctacaagaaggcactccgatcacttaccgtgcaggagaccagcccaacaacgctctttccctgaatgtgttcaatccgggtgagatagcttccacagccggaacatcgggagtcgtatacggagtaaacggcgaaatcaattatgatccgcagtcacgtgtcaacacctttgcccatgtcaaccatactgctgccgatccccgcctcggcgtattgctctgtattaatggaacggggattctcaactcgtggatcaggcgcaatgttgcccccgaaggtatttcgtacgccgagatgaaccgttttgcttcatccgttcccatcggcagtgcaggtatcagcatccttcctttcggcaacggagcagaacgaatgctcgataatcgggcaaccggttgcggtatacacggcgtagacttcaacaggcatgacaaatcacatctgatccgggcggcacaggaaggaatcgtcttttcatttaaatatggcatcgacattatggaagagatgggcatccccgttaaaaagatccatgccggacacgccaatatgtttctgagttccgtttttcgcgagacactggccggtacgacgggagccaccatcgaactctatgacacagacggttccgttggtgcagccaaaggagcaggaatgggagcgggcatatataaagaccatgaagaagcattcgccactctcgataagctgacagtcgtagaaccggatgccggcaaacaacaggaatacactgatgcttacgcacggtggaaacaatgtctgactcagtccatgcagacagaaacagagaataagtaa

SEQ ID NO: 405 - DNA, 255 bp, B.fragilis
gcgatgaataaacaaatgacaatagcgaaaaaacgctattcttttaaaaaagcatatgaaagggtgccattagggcagattgaaagtttaaaaaaagaactgtatagtgtctttagtatcaataatcgaacctcttggtacaataaacttaaaggtataacttctcccagcatagaagtagttgaagctgttgagactgtatttctaaaatatggtattgaaaattgttgggaaattacagagatcaaattatga

SEQ ID NO: 406 - DNA, 237 bp, B.fragilis
tcagaggataaccaatcccatatctatttactttgcttttccagatctctgacagccggaatgcacatcatcaaaattgaggtaaatacaattgctatcccacaacagataaaaatattggctattcctaaactatcagcaataaatccggtaatgaacaacccaatgatagaaggcaataagctcacgctgtcaaaaagagaaaacacacgtcctaaatatgccggtttaaactga

SEQ ID NO: 407 - DNA, 1158 bp, B.fragilis
tttatccgtaaagaaagccagccaggaatgacattcgaattacaatatacagacgcaaaaagtaatgcccgtgccggtctgattacaacagaccacgggcaaatacaaacccctatatttatgccggtaggtacaatcggcagtgtgaaaggagtacatcagactgaattgaaagaggatattcaggcacagatcattctgggaaatacatatcatctttatttgcggccgggactggatgtactcgaaaaagccggtggattgcataagttcaatggattcgaccgtccgatgctgaccgatagtggtggttttcaggtgttttctttgtccggtatccgtaaattgcgtgaagaaggggccgaattccgttcgcatattgatggcagcaagcatatctttactcctgaaaaggttatggatatcgaacgtatcataggtgccgacatcatgatggcatttgacgaatgcccaccgggggattcggattatgcatatgccaaaaagtcattgggattgacacaccgctggctcgacagatgcattcaacgattcaatgagacggaacctaaatatggttacagccagtctctttttcctatcgtgcaaggatgtgtatatcccgacctgcgtaaacaatctgcagaatacatagcttcgaaagatgcagacggtaatgctattggcggacttgccgtaggcgaaccggtagataagatgtacgagatgattgagttggtgaacgagatacttcccaaggacaaaccacgttatctgatgggagtcggcacaccggttaatattcttgagggtattgaacgtggagtagatatgttcgactgtgtgatgcctacccgtaacggacgaaacggaatgttgtttacgaaagacggtatcatgaacatgcgtaataaaaaatgggaagcagacttctctcctattgaagctgacggtgcttcgtatgtagacacattgtacagcaaagcatacttgcgccatttattccatgcgcaggagttgctggccatgcagattgcgtctatccacaatctggcgttttatttgtggctggtaggagaagcacgcaagcacattatcgcaggagacttttcaacctggaaacctatgatggtgaaaagagtgtcaacaagactataa

SEQ ID NO: 408 - DNA, 1068 bp, B.fragilis
ctaaaaagtaaaaaacaggtaatgaaaaagtttttccgatttcaattatgttgtatttgtcttttggtactgattgtatctgcttgtaaggtgaaaaggccggacagcgtcatatcagaatcggagatggaaaatttattatacgattatcacattgccaaagcgatgggagagaacatgcctggtggtgagaactataaaaaggcattgtacgtcgaagcagtattcaaaaagtatggtacaacagaagaagttttcgactcatcaatggtatggtatacccgaaatacaaaaatattatcggaaatctatgagaaagtgaacaaaagactgaaagcgcagcaaaatgccatcaaccatctgattgcattacgtgacaataaacctaagatgtctgctccgggtgacagcatcgatgtttgggcatggcagcgaattgctcaattaacagaggctccattaaacaataaatttacgttcactctaccttctgatacgaacttcaaaaaacgcgatgtgttgctttggaaaatgcaatataacttcctgagtgaaattcctgattcaacaatggctccaataatggctatgcagattgtttatgaaaacgacacagtgacccatagttgtgtgaagcacatttttaaatctggcattcaaaatattcgtctccaatcggatacaatgaatatcaaggagataaaaggatttatcttttgtccgctatctgaggaatcaataacacttctggtcagtgatatttcattgacccgttatcatgcaaatgattcaataacacagataggtagagattctctaaaaactgattcaataaaagaaaaaagtaaagacgattctattcagaagaaaactcccaaagacactattcaagcatcatcaccccatcaacgtacgaatccgaacgatctgaatcgtcctaataatgatgtccggcctattaaaccggaacaacgtgaaaaagagatgcagatagaaaaagagaaacagcaattggaaagacaacaaaggaccaatccaaggaggccattacgtcgtcagaataattaa

SEQ ID NO: 409 - DNA, 183 bp, B.fragilis
ctcttaatcaatgggtccagggttcgagtccctgagggtgtacaaaaggagattataaataatctcctttttgtttttggtggcattttgaaatattgttttatctttgccaccgcaaaaattaatttgatgaaaacaacttatcagtttaacatactcgtcaatcatttggagctggcttag

SEQ ID NO: 410 - DNA, 402 bp, B.fragilis
  unsure (276): Identity of nucleotide sequences at the above locations are unknown.
tatattcccaataaacaagatatatcactgataattaacattaattttattattatgaactttgatttaaaagcgtttagaaaacgatttggtttaaaacaggttgaagtggctcatttattcaattgtgggcagagcaatatttcagatattgagactggaaaaagagggcttgaagagtatcaaacaagaattctcttcgataaatacggagaagaggtagttaaagagtacttaatacctgagagtgccattcatcaagggaatataaacggngataatataaacgggcacaatgtcactgtaaataaagcagactttgataaacttattagcttgttaaacaaaagggatgaacaaatagatagattattgcgtattattgaaaatttaaataaatag

SEQ ID NO: 411 - DNA, 621 bp, B.fragilis
gagaggaacaatattatgacattaaagcaagctcagaaactgtacgatgattcagtgcaggcaaaaatgactcatgccgattattgcatgactcaatcgcaacttgaatatatcggtagaactatgtggggattcaccccagacaaacaagcaaaggtgttattcaccaaagtaggaaagagggtgtcggtagttattgcgtcacgagaagcatttattaaagagataggaaaacctgttatctgcaaatgttcggtatgcgatatgtattatttagcttatagaaagtcggtcgatgctcacgatgaattaaatgcccaatgtccaaaatgtgattctcttggttgtgattcagatattgtacattttgaaacaagccgcaaattttggctaaacgagaagatcgttaaaatccttactcccaataaagaccctgaacgagtggaagctatgtacgattccgctccggaagattttcctgcacaatatgagatgttgcttcccgatggaaagaggtgtacagattgtgtgcgatgtgccacatgttgcagcgtatttggtcaaaaagaaagtgccactatttgccagtggcatccttcgagatattcagcgggagaataa

SEQ ID NO: 412 - DNA, 690 bp, B.fragilis
cattcactaaatagctttaatcaccaatgtctaattttaaaacggcaaaacatgaaaactccatctttaattctgatgacaattattttatgtaatctcagtatcccaataaatgctcagatactaacctcccgccagcaaaaggaagattttgacaccttatatagcttactacatcaggtacatccggacttatttgtgtatcaaacacaaaaagaatttgaaaagaaacatgattcaatatatagttcgttgaataaagaacgaaacctttctgatttttactttatagtctctccatttgttgcatctgttaaagatggtcatactaatttcacaattcctgctactcaagacagaattacctatttgaataatggagggctgactctgcctttacgcttaaaaatagtagagaataagatattggttgattttcctctaatatcctgttcaatacaggaaaatgatgaaataatatgtatgaataatataaatagtcaaaccatattaagccaattgtatctcttactgggagctgaaaaaggaaacgctattaaggaaaatcaattgaccagttatctttctactttgctatggtataaatataattggggtgaaaatatgattttacaattaaaagaggaaaaaagatatggaaagaatcattggatggtatcagccaaatag

SEQ ID NO: 413 - DNA, 477 bp, B.fragilis
catattgtaaatcaacagaatatgaatacaaacaatatcggaggagtcattcaggcagatttcctgttcacggatgaaataagtttattttcagtcatcaatcactcagccgttatcagccttcaccggcctaatacctggagaaacctgcctatcacctatatgggagtttctccagatgtggaagcggacgacactcaagccggtacgctatataaacagacccttaccatccgcctgaaacgcacaggactgacagattcagaacttcacatcctgcggactatcaatgtacgtggttgcgtagtaagatgcaaggatgcgaatggcaatatccgattatatggaagcaaagagtacccgcttctgggaaccgtgatagagaaaacaggaaccaaagcctccgacctctccggaattgaagccactttttccggaaaaggcgcctatcctccactacctgttacagagttataa

SEQ ID NO: 414 - DNA, 243 bp, B.fragilis
aaaggatcaaaaatgggaacaggatttacggaatacgaagaaagccttatacaagcaatttgttcgttatattatatacagacgaggacttataaacagggtgtgttcataggtatgattcctaaaaacacacgtataaccttgaatggcatatatatgatgaagttattaaataccgggaacgctgtttatattgaagtaaaagggggaattaatgtattaacaattatacatcaacaataa

SEQ ID NO: 415 - DNA, 609 bp, B.fragilis
attatgccaaaaaaagacacaacctacgaccgcatcgaacgctccctgttcaaagatcggggtgaatccgctctccagttatcaccaaaggagatggaaattaagaatcggatgatgctttgtgttagtaagaaaatggaaagcccattaattgaagaccaggagctcgttacttttctcatgcacggatgtggagggcaagcggaacctgtttcccaatcacaggcctatcgcgatatcggtatgatcaaccggttggtcggtaacatccagttggcggccaaatcctggtatcgctacatgatcgtagaaggaggaaagaaggcatttcaactcgctatcgacaacggagatgctaaaggagctgccgccgctctcgacaagataggtaaatacacccgttccgacaaagacgatgacgcattcgacttcagtcagcttattcccccatcttttgaaccttctgacgatgtgacgacacttgagggtattgaagtgatagacaatctggagcaacgccgccaggaactccgcagcttgtgcaaagatatgttgaccaaacaggcgacagatattcaaaccattgaagaggaggatattgaggaatga

SEQ ID NO: 416 - DNA, 363 bp, B.fragilis
cgtactgcaaagatggaaaatatttttgattctgcaaaaacaattcaagaaaaacgcacaatattaaaaggtttatcaaagccgcttcaaattttggtgaaagaggctgctattcctacggtaaacgatggactgaaagcgatatacgcacagtctgggcacaccgaacttaaaacgctgaaacagtggaataaggagggcaggagtattaaaaaaggttcccatgctttatgcctttggggtgcacctaagaaagtagagacgacccaagtggaagaagcacagggagaagataatgacccaatgaatttctatccgatttgttttgtattctcaaatttgcaggtatatgaaaaacagtga

SEQ ID NO: 417 - DNA, 195 bp, B.fragilis
attgcacaaaattgtattttgtacgcacaatgtatcaatcgtacaaaaacgtaccatgtttcgtacggatataaaccaattataatcaacacattatgtgataagactgcacaatttacacagttgcacaaaaaaggagtaccgtttttgcaagggggattagtttgttccggtaagtcttgtttatgtccgtaa

SEQ ID NO: 418 - DNA, 759 bp, B.fragilis
acaattaaaaacacaataaccatgaaaaaaattattttattacttgctttatgttttactgcaaataatttctttgcacaaaccacagatccgaatcagttgaagaatgaaggtaatgatgctttgaatgcaaaaaattatgccgttgcttttgaaaaatacagcgaatatctgaaattgactaataatcaggattctgtcacagcctataattgtggtgtatgtgcagataacataaagaaatataaagaagccgccgattactttgatattgcgattaaaaaaaattataatcttgcaaatgcatatataggtaagtctgctgcctatcgcgatatgaaaaataatcaagagtatattgctacattgacggaaggtatcaaagctgttccgggcaatgctactattgaaaaattatatgctatttattatttgaaagaaggacagaaattccaacaagccggcaatatcgagaaagcagaagagaactataaacatgccactgatgtgactagtaagaagtggaagactgacgctttatatagccttggagtgttattctacaataatggagccgatgttctacggaaagcaactcctttagctagttcgaacaaagaaaaatatgcttctgaaaaagcaaaggcggatgcggctttcaagaaagctgttgactatttgggagaggcagttactttatcacccaatagaactgaaatcaaacagatgcaagatcaggtaaaagcgatgattaagtaa

SEQ ID NO: 419 - DNA, 369 bp, B.fragilis
aacatgaaaaagaaaaaagaaactccaatgcatcccgttgtggaaaatatccgtaaaataattatggataaaggaattacccaagttgctgcatctgaacttgtgggtacttctgcatctcaaatgagtaaaattttgaatggagaagtacaaattagcatttggcagatttcaaattttgcaactaatcttggaatggagataatagacgtatttacatatcctaataaatatgtaaaagcagaagacaggaatgataataaagaacctattgaggcagttctccaaattaaactcagaaaagataaaaaagatcaagtactaaagttgatatttggggaacataatttagaaatattaaacaaataa

SEQ ID NO: 420 - DNA, 1077 bp, B.fragilis
acaattagaaaggagggctgcttaatggcggtatataatcgaatccctgaccggtttactaacctggatatccgcgataccctgaacgcttatggtggaagtgtgggcgataactcgcttaactatttctctgctgctgcacacattaacatgtggagcaaacgtaaaccggtgaaaagaaatatcatgtttaatacggaggacccgaactggttccgtgccgattccggaaactacggtatcaatgtcccccgtgcagcggatattgcgctactgaccggaacttacacctatgatatacctgttcagggatcgtacaacctgcgtgtcggtgattttgccggatacaatccggaagctaccgtaccattcactaccatgcttccctccggacttatccttgcttccggcagtgccactgttgtgaagttgatgctgaaatcacttgattcaacatacaatgttgtcccggccgatatattcccctctaattcatatttgggatgtgctgtcacatacggaaaccggacgcttattaaaacgctttcggttacaattttcaatggaggggtgacactgaacatatccgattgcgagctcttgaaatcagataagacgggagtcaggataaaggtattcatctgtacatcgcaggttccatcctggcagggtgaaacgacacaatcctattacagcttgaacgcagaggacggttttgatgagtcgaccgttgatattgtcaccccgcatgccgatgtttactcgttcggcatccttggacttagcattatcgaagcgagaaagatatctttaatcggtacggcgattatcaactccggaagtctctttcaagagggccgcttaataagcagactggacaataattactatttaaagtctgtaaaagtcgttgcgacccgtgcaagtgacggtgttactgttgccgagaaagcacaaagcataacatcttccactacaccgacacgcttaggaaacgactggatggcaggtgagtccgtcaacttcagaacaccggtctctaggtcttcaccgggggcgggaggcgagcacgtcgtc

SEQ ID NO: 421 - DNA, 252 bp, B.fragilis
accctcggaaataccggatttactgaaaggcagtttctaaacaattctttttttaatttatcaaactacaaattaaaagttatgagtagacgtagacaattagagcatgaagtgtctttagctcaggaaagaataaaaaaagctcccaaagatactcctaaagaaattttgaagacgtgggaacaagagttagtcgacttggaattagaactcaataatctggttgacgacgaagaagacaacaatgaatga

SEQ ID NO: 422 - DNA, 996 bp, B.fragilis
aatagactgaaaaacatattgtccattgcacaatttcaccaaatctgtgctatgatattgcaaaaatatataactttgcacccgcaaattaaattaaaaaacaaaaatatgaaagcatttgtattccccggtcaaggtgcccaatttgtaggtatgggtaaggacctgtatgaaacttcagctttagcaaaagaattgtttgaaaaagcaaatgatatcctgggatatcgcattacagatattatgttcaacggtacggacgaagatcttcgtcagaccaaggttactcagcctgctgtattcctccactctgttatttctgcactttgcatgggtgatgacttcaaacctgaaatgactgccggacactcactgggtgagttttctgcattggttgctgccggcgctctgtcttttgaagacggcttaaaattggtttatgcacgtgctatggctatgcagaaagcttgtgaggcaactccttctacaatggctgctattatagctttaccggatgagaaagtagaagaaatctgtgcttctgttaccgctgaaggagaagtttgtgtacctgccaattacaactgtccgggacagattgtaatttccggatctgtaccgggtatcgaaaaagcttgtgaactgatgaaagcagccggagctaagcgtgcgcttccgttgaaagtaggcggtgcattccattctcctctgatggatcctgccaaagtagaattggaagctgccattaacgcgactgagttccacacaccgaaatgtccagtttatcagaatgtagatgccctgccccatacagacccgcaggaaatcaagaagaatctggttgctcagttgactgcttctgtacgttggacacagaccgtaaaaaatatggttgccgatggtgctaccgacttcacagaatgtggaccgggtgccgtattgcagggattgatcaagaagatcgactctacagtttcggctcacggaatagcataa

SEQ ID NO: 423 - DNA, 474 bp, B.fragilis
tgcattatgaagaatttagaaatcctccctctctctgccgagagtaaaaagcgtattgaagagttcgcaaggcagtatcagcgatatgcccatatcgctattgagattgtgtcctattcagaaggccggctgattgtccgtgccgagcaaaaggacctggttaatgataagttcctttcaaagaaagaactgacagaacgtgtccgggacatgttcaaagatgaaattccggaagactggaaacttactgtttctgccgtaaacttcgaccgtaaggatattgatgggatcactctcgactggatcaagaaacggatggaacggcttggattaaagaataaacatttgagcaactacaccggaattgacaaatgtaccgtttcttccatcctttccggagacaaggagttgaccaaatggcacaaagtagctctatactattttttcaagtattatgaagtagccaatttttag

SEQ ID NO: 424 - DNA, 336 bp, B.fragilis
cataccatgaacctatcttcttttaaactgaccaatattaacgaattgatatccgtatacaaagagaatccggagcgctttaatcgcttttataacgcagtgtacctgctgctggatggcattccggaatgcggaagtattcgtgtaatggatcactgtgaggcgtcctcctatgacttgtttataaagtgtgcatgttggattattcaggaagagacggaacagaaagagttgacggatgcattacttgagttttcggatgattatacaattattcgccggtgcgcgaagttcgtaaaatccaaatcctgggttcatttctactcacgacgatag

SEQ ID NO: 425 - DNA, 1320 bp, B.fragilis
aagaacatgaaaattgcaattgtcggaaccggatacgtaggtttggtcacaggaacctgttttgcggaaattggcgtggatgttacttgtgttgacaccaacagcgaaaaaatagaggcgcttaaaaaggggattatccccatttatgaaaatggattggaagaaatggtcatccgcaataccaaagccggtcgactaaaatttacgacttcactggaaagttgcctggatgatgtagaagtagtgttctctgctgtcggaaccccacctgatgaagatggaagtgctgatttgagttatgtactcgctgtggcacgtaccattggacaaaacatgaagaaatacaaacttgtagtcaccaaaagtaccgtacctgtaggtacagcatgcaaagttcgtaatgctattcaggaagaattagacaaacggggtgccaaaatagaatttgatgtagcttccaatcctgagtttctgaaagagggtaatgcagtcaatgactttatgagtcctgaccgtgttgtaatcggtgtggaatcggaacgtgcagaaaaattaatgactaagctatataagccattcatgctaaataatttccgcgtgatattcatggatattccctctgccgaaatgaccaaatatgccgcaaactcaatgttggctactcgtatcagtttcatgaacgacatcgctaatctgtgtgagttagtaggagctgatgtaaatatggtgcgtagcggtatcggttcggatacccgtatcggacgtaagttcctttatccaggcattggttatggtgggtcatgtttccccaaagacgtaaaagctttgataaagacagcagaacagaatggatatcagatgcgtgtgttacaggcagtagaagaagtgaacgaaaatcagaaaagcctgttattcgacaaactggtaaaacaatataatggaaatctggaaggtaaaacagttgcattgtggggattggcattcaaaccggaaacagatgatatgcgcgaagcacctgcattggtcctaattgacaaactgttgaaagccggctgcaaagtacgggcctatgatcccgcagcagcaaatgaatgtaaaagacgaatcggcgaaaccatatactatgcacgcgacatgtatgatgcggttttggatgctgatgctttgatgctggtaaccgaatggaaagaatttcgtctgccttcgtgggccgttgtgaaaaaaacaatgtcacaacaggtagtcatggacggacgtaacatttatgataaaaaagaaatggaagaacagggttttatttaccattgtatcggcaaataa

SEQ ID NO: 426 - DNA, 501 bp, B.fragilis
aacaaaatgaaaaatgtatcgagcgcaaaaagcgcagaggctaaagccgtagtgttaagtaatgtagctaataagaagaatgaaacagcccctctaattgtgctgccatcccttccaaccgagaaagaagaaacgaaagaacaggtttcggccaaagttgaaactcccgttcaaacttccaagaaagagagttcttccgtagtagccgcacccaataagcgtctaagtattgatgaactgaccgataaggcggagcgtgtttatctgctccgtcagaaatatcaagaagtgagagaaaagcggaaacagcttgaaagctttactatctcacatgataaaaataatgcccaacttactttggtagacgcaaaagggctttccatttctacaagtaatcccgttgcaattggtaagttgttatctgattggatgttagatttaaataatcacttggcgaaaaccgaagaagaaattcgttcagaattggaacggctaaattaa

SEQ ID NO: 427 - DNA, 249 bp, B.fragilis
aaagaaatgaatagtgatggtaataaaattctggatgctattaagagaatggcagcagatgacaataaaggtttaagaatgaccactacgatagtcgatgttaaagatgatccgctcggctcaatcgttggctttgggactgaaaaagtttgcggagatgatgcatttgcccaaacaatgggtttaccaggtaagtatatggcatgtgccttttttatagatagagaagaactaaagaaatacctttaa

SEQ ID NO: 428 - DNA, 525 bp, B.fragilis
ctaaaaccgaattacatgaggcatgtaaaatggatttttgttgtattactaattagttccttgacttctttcgtagaaaaagacaaacccaccggaggtttgaatgtgggtgacgtagcccctgatttcacaatcgaatctacgtcagatgcacagtacaattttgatttgaccgacttaaaaggtaaatatgtgctgcttagtttttgggcaagttacgatgcacagtcccggatgcaaaacgcaagtttgagcaatgcgcttcgatcaacttctcaagatgtggaaatggtttccgtttcatttgacgaataccagtcggtatttcaggaaaccattcgtaaggaccaaatagttacgcccacctgtttcgcggaaactaaaggcgaaagctccggcttgtttaagaaataccgtttaaaccggggtttcactaactatttattggatggaaatggtgtgattatagccaaaaacatctctgctgcagaactttctgcttatgcaaacaaaatcaaaggttga

SEQ ID NO: 429 - DNA, 564 bp, B.fragilis
tatcatcagaaacgaatgaattatatacaaacagaaatagatggtgtgtggatcattgaaccgaagatttttttcgatccgcgcggatatttcatggaagcattcaagcaacaggaatttgatgctactatcggacagataaattttatacaagataatgaatctcaatcttcattcggcacgttacgcggactccattatcaaaaaggagcctatagccaagccaaactagtgcgtgtcatcaaaggtgaagtgctggatgtggctgtcgatttaagaaagtcatcacctacatttggaaagcatatcagcgtattgttaagcgacgaaaataaacgccagctttttattccccgtgggtttgcccatggatttttagtgaaaagcgaaatagctatctttacttataaggtagataatatatatgccccccaatctgaggcttctatcctatacaatgatccggcattggctatcgactggcctattgccgattctcaacttgtcatgtcagagaaagacaagcaggcaggagcctttcgggaagcagaatattttgaatag

SEQ ID NO: 430 - DNA, 621 bp, B.fragilis
ggagataagaatatggaatcaaagtttcatgaactgaaaaacaggctgctgaagaatattgaccagacgtccgaatctaggctttatatggatatacagctggctcaaaactgcgaaactcttatgtctattatcaaaaaggatatcggatatctggcaaaggaaggtatcctttcccccggcatagcagaagattttaaggacgtatttctatctgccggcataaaatgtaactccggaggctcatccggatatatgttaatatgggacggcactgcggttgatatttccggaactgccacggctgtaatctggaaaagtgaacgagccttcatcaaaggacgcgcatgcgctttccttcttggagaggtctctgcaataacctgtgaacgttcgatggtcattgcggcaggaagctccactatccttgccgagggagattccgttgttggagtttcaggctatcatgcctctgtaaaggcgtcagactatgctactgtcgtaaatatgaactgtcccaacattgaccttcgtgacaacacccgcctttggcttcctgcacgcggaagctttgcagcccgaaaaaattgtgatataattattaaaaacaaggaggaataa

SEQ ID NO: 431 - DNA, 225 bp, B.fragilis
ccaaaaaagaaggaaggaaaacctatgtttaaagatataatcgaattagataaacaagtcgtagaccggatcgtagataaggtccacgaaaacaatttagaaattgagatggaaatgggagttgtaaaggacggtatggttaaagtccttttcctctataaagatccggaacttctgcagagcgtgataaacgaatccgttactgaagagtacgatctcccataa

SEQ ID NO: 432 - DNA, 687 bp, B.fragilis
acagaaaagaatgacacaatgagtaatatacctgttatctttcgttttttaaaggaccttactgcgaacaacaatcgcgagtggtttaatgaacatcgggaagaatatgaaatagcccgtttagaatttgaaaatttcctttccacagtaattgcccgtatttcactttttgatgaaagtattcgtggtattcaacctaaagaatgcacttatcgcatttaccgggatacccgcttttcttccgataaaactccctataagaatcattttgggggatatattaacgcaaaagggaaaaaatcctatcacagtgggtactatatacatatacaacctgagggttgcatgctggctggaggaagtttatgcttgccttctaatattttgaaagcacttcgccagtctatctatgataacattgatgaatatcgttcgatagtggaggatcctgaatttcagcaattcttccccattgtaggtgaagatttcctgaaaacagctcccaaaggattcccgaaagattttaaatacattgattatttgaaacctaaagaattcacttgtgcttattccgtcccggacagtttctttttgactccggatattctggacaaaatagaagaagtgttccggcaatttaaacgttttgccgactttacgaatttcactatcgatgattttgagtaa

SEQ ID NO: 433 - DNA, 342 bp, B.fragilis
ttaagagagaatatgaagcgttttgctgcacattatttatttgttccgggaagtggatttttaaagcaatatgcgatagaaatagaaggaggatatatttgtcatatctttcctttcagcgaagaaatagagtctgtagaatggtttccgggtgtcatactactgactccacaagaagaatcagatataaatactttgtttaactttactaatatagaaaaacaaagtatttatattccgaaagttaccatagatatgaaatggcgggcttatttattatatcctttcaattttgttacaatgcagcctgtcgccgaaactctgcacagacaattgcagtag

SEQ ID NO: 434 - DNA, 1074 bp, B.fragilis
agagaaaggaaagatatggaaataataaaaaccggattggctgcttttggtatgtcgggacaggtgtttcacgctccatttatcagcacgaatcctcattttgaactttacaaaatagtagagcgtagtaaggaactctctaaagaacgatatccgcaagcatcaatagtacgtagttttaaggagttgacagaagatcctgaaatagatcttatagtcgttaacactccggacaatacacattatgaatatgccggaatggctcttgaagccgggaaaaatgtagtagttgagaaaccgtttacttctaccaccaaacagggtgaagaattaatagctttggctaagaaaaaaggtttgatgctaagtgtatatcagaatcgcagatgggatgcagatttcttaacggtacgtgatattcttgccaaatccttattaggacgtttggtagaatatgaatctacatttgctcgttatcgtaattttataaagcctaatacttggaaagagaccggagagtccggtggtggattaacctataatttgggttcacatctgatcgatcaggctattcagctttttgggatgcctgaagctgtttttgcagatttgggtatcctgcgtgaaggaggaaaagttgatgattattttataattcatctgttacatccttcgttggcaccaaatgtgaaaatcaccttgaaagcaagttacctgatgcgagaagccgaaccacgttttgccttacatggaacactaggttcgtatgttaaatatggagtcgataaacaggaagctgctctattagctggtgaaatacctgaacgtccgaattggggagaagaatcagagcaggaatggggattattacatacagaaataaatggaaaagaaatctgccgaaaatatccgggcatagccggaaattatggtggcttttatcagaatatttatgaacatttatgtttaggacaaccattggaaacacatgcacaagatattttgaatgtgatacgaataatcgaagcggcttatcaaagccatcgagataataaaattgtcaatcttaaatag

SEQ ID NO: 435 - DNA, 546 bp, B.fragilis
ataataaacctaaatatgacggctaaatttattattatggtattggtattagcttatatcatggttataatcgctatatcaatttatttaataaagataatatgtactcgttacaaccaaaactcagatcagatactccctcctcccaatatgcactctattcaggagagtgcatccatgcatttggtaagaataggacagttgcctcacccaggacctggatattgttattacgaattaggaggaatgagatatcaagcgctaacaggatttgacattggcgtacacgaaggatatgcaaaagcagagcttaataatcggtatgataaatatgcggttggagtctacagagaaggagatcacaaattaatgggatacgttcgaagagaacaaaatagagagctttatgaatttatgttaaataataattgtatagctaaagctaaatttcgaatatggatacaccaaggagaaatctatggagcagcttacataaaagaagaatggaaatcttcattaggctttaagtctgacattaaaatttag

SEQ ID NO: 436 - DNA, 525 bp, B.fragilis
aaactaattgaaatgttgaacgaaaaaagaactcaaagaattatgaaaagtaaattcctgatatttttgtcggcagtagccatgctgttattatttagcaattgtggaagcaaaacaacaagtaatgatcaggccactaccgaagtgaaagacactgtcacttcaaaagaagaagctgtaccggatagtgtatctatcttgggagaccaggtatatgatatagtgaacacagctcccgaatttccgggaggaatgaaagcgtgtctcgagtttctctacaagaatattacttatccggcacaagctattgaaagtaagcaggaaggtcaggttgtgatacagtttgttgttaccaaaaatggtaaaattattgatccgaaagttgtgaaaagtgtatctccatcacttgacgcagaggccatacggatcataaatttaatgcctgactggactccgggaaaacaaaaaaatggtcaggaagtgaattcacggtttacacttccagtccgttttacacttaaatga

SEQ ID NO: 437 - DNA, 438 bp, B.fragilis
accatgtatgatattgtagcgcagaggcttagactgtttttagcaaagaaagatatcacttgtaaaaaattgtcggctatgatttttatgtcagaggcgacgcttaaaggcaaattgaatggtacaagaacgctagatcttaatacaataatatccattgcaatacggcttgaggatctttctgttgaatggcttcttcgtggcgaaggtgatatgtttaaatctagttctggtgtttctattttatcttcatcagtacctatatttacaggggagacctcgtttatatacagtatgtataaagaagaaagagaagaggttaaaactttattaaagcaaaatggtatattggaagagcgtattcgtcagctcgaggatgacaatagattattaagagatcaagttgtaacagaattaaacctaaatactaaactgtag

SEQ ID NO: 438 - DNA, 369 bp, B.fragilis
aagatgcatgatattgtaacgcaaaggcttaatcaatttttagttgaaaagaatattacttataaagaattatctggtatgattcttatgtcggaaacgtcactttgtagaaagttgactggttcaaggagtcttgatttgcatacattaatatctatagtagcatgcttgccagatgtttcttccgagtggcttcttagaggcaaaggtagggtgtgtaattcttcttcgagcattagttccgatgtcttagtagaagaacttaaaatggaaaataacctattaaaacgaaaaattcaagttcttcaagaattgttggagtttaagatggaaaaaatcagagctgagaatggtaacataaaaaaatga

SEQ ID NO: 439 - DNA, 912 bp, B.fragilis
cagaaaagtgaccattatgtttcttctttgttatatagtgttttcatttatcatatggtaagaaaaagttcaataaataaatacgagttagacgtcagaaaggggttacaagaactctttgacaaatgtcgacacaatatgaagcattctggggatttattattatgtcaacaaaatggcttcattgactacaaaggtcgcccatgtgttggattaggtgatgaagggcttaattgtatgcaacaagtcaattttatttcgtttaatggaataggaaatattactgatgacaatgattattataaaaaagaaggaaataactttttttatggtaattctgagtttgaagctgatattatgagacaacatattacctatatgaatatatgggaaaattcttactttttacgggtattcactcaagtggtaaacgtgttaaatggtttaaattataattggaatttgacattcaagaatcttaagcccaatcaaaaaagcgaacaaataagagaaggtataataaaattattagatctatcccccaacttccaacgtatacttaaagatgcatatgtcggacaaatacgaaatgctgtcgctcatacacaataccattgtattcaaggaggaatcttatatgacaactactcaccatcaagtaaatattctatcctgcaaggtctttcttatgaagaatgggagaagaaatatgtctactcttttttcatatttataggtatattccaaatgttaaaacaaatcacaaacgaattttatcttccttgttcccaattaacctttgcaaagggagttccaattcaaataccactttcggacaacaaaggatatgcagagacttatttatatccgaatcaaaaaggagatatttggagatttacaagaataatttga

SEQ ID NO: 440 - DNA, 213 bp, B.fragilis
gcatatcgcctaaacgagaaacaattgtccatgtatatccatcatttgatggtaaaggaccacaagagaaaatattattatctatcatatgaaaagagattcatatttataattaatttagtttctgctaaattacaaaatagtaatggattaaaaaagaaaaagcagagtaatagctctgctttaatatgtttctacagaaatatggcctaa

SEQ ID NO: 441 - DNA, 246 bp, B.fragilis
cggtggcgagaaacttctgttaataatttctcttctttgcagtcttgttttataaatgtaaatgagatcaaggtacgttttgggggtgctcccggtttagtgatgaccaagagctggcgggatggatacaggccttgtgaagatgcgatgtctttaaaagaatcacttgcatccatcggtatgactactgtaaaagtaccatttggcgaaagtaaattcgatactcccttcagcaactcttcataa

SEQ ID NO: 442 - DNA, 210 bp, B.fragilis
agtaagctttttgcccgtttgcttactttaattcatctaaaagtcggtagctccacccctttcagcttgcttctgaaaggggtgaaactaccgactatggtttgctacgcttccggtttaccggattctcaagaagtgcatgttagccaaaaggatgtatatgctgcattcggtcggtatttacttcgatttgctttcaatgtggaatga

SEQ ID NO: 443 - DNA, 216 bp, B.fragilis
tataaaatggaattagagacaattggagaaaacgccggcaaagtatggcgcaccctgaatgaaatgaggggagaaatatctattcaggaacttagtcggaaaattaacctcagcgccgaagacgttgcacttgcggtaggttggttagccagagaaaataatatttttattcagagacacaactacctgttatacgtcagtcatgatgctttctga

SEQ ID NO: 444 - DNA, 807 bp, B.fragilis
atgaaaatggaaaatagtgtattaaccggaaaaccttataacatcggatatgccttgagcggaggctttattaaaggctttgcccatttgggagttattcaggctttattggaacatgatattaaaccggatattatctcaggagtcagtgccggggctttggccggagtattttatgccgatggcaacgaaccctatagggttttggactacttttccggacataaatttcaggacttgacaaaacttgtaattcctaaagtaggcttatttgctttgggagagtttattgattttttgaagtcaaatcttaaagctcagaagctggaggatttaaaacttcctcttatcattactgccactgatctggatcatggtcgcagcatgcattttcataaagggaatatagctgaacgggtagctgcttcatgctgtatgccggtgttatttacacctgtaaaaataggaaatacacattatgtggacggaggacttctgatgaatttacctgtatctaccatccgaaatgaatgtgaaaaagtggtagcagtgaatgtcagcccgttgatggcagaaaaatataaaatgaacatcgttagcattgccatgcgttcttatcattttatgtttcgtgccaatacgtttccggagcgagacaattgcgatttactaattgaaccctacaacctagagggttatagcaatactgaacttgaaaaggccgaagagatttttgaacaaggctataacactgcttctgaggttctggaccaactaattgaagagaaaggaaagatatggaaataa

SEQ ID NO: 445 - DNA, 1221 bp, B.fragilis
agggacgcggacagtttacaacttttttgccaacacttttgttataattggataataaacctattttatccaatgaaagtacacgaatatcaggcaaaggagattttctccacttacggaatacctgtcgagaggcatgctttatgccatacggcagatggggctgtggctgcttatcaccgaatgggggtaaaccgggtagccataaaagcccaagtgctgaccggcgggcggggaaaagccggcggagtaaagttggccaataatgatagagatgtctaccaatacgctcaaactattttggagatgactataaaaggttatcccgtcaccaagattcttcttagtgaggctgtcaacattgcagccgaatattacatcagttttacgatagaccgtaatacgcgctctgtcacgctgattatgagtgcggccggtggtatggacatcgaggaagtagcccgccaatctccggaaaagataatacgttgcagcattgatcctctaatcggagttcccgattatctggcacataagtttgctttctctctctttgaacaagctgagcaagctaaccggatggcaactattattcaagatctttacaaagcatttattgaaaaagatgcttcacttgctgaaattaatccattggtacttacccctgttgggacattattggctattgatgccaaaatggtttttgatgataatgcactttatcgtcatccggacttacagaagttatcagagcccacagaagatgagaagttggaagcgattgccaaagaaagaggattcagctatgtgcgcatggacggtgagataggctgtatggttaatggagccggtctggctatgacaactatggatatgatcaagctttatggaggaaatccggctaatttccttgatattggcggtagttcaaatcctgtcaaggtgatagaagctatgagattattgctggatgacaaaaaagtcaaagtagtctttatcaatattttcggaggtatcacccgatgtgacgatgtagccatcggactcttacaggcgtttgagcagatacaaacggatattcctattattgtgcggcttacaggcactaatggaaatatgggacgtgaattattgcgtaagaataaccgttttcaagtggcccagacaatggaagaagctactaaaatggctatagaatcattaaagaaagaatcgatatga

SEQ ID NO: 446 - DNA, 1443 bp, B.fragilis
catcaaagtttatttctaatgaagaagaaacaacctgagccccaattatttcaaaaaggatatgaaacttatgcagtcaccaaaggcggaaaaggaatcataaagttcagtgataatagcgatatcacaactgaccgggagacctctaccgttgaagtagttcccaaagggaaagaggctccaattaagtttgttcccagagggcggaataacaacatgatgtatgacattatgaagaagatcggagcaaacgtaactgtcggcagcaatgtggaattcaaaaacaaggtagtatatggagatagtgtcctcgtatatcgtaaataccgggataaggaaacccgaaaaatcatcaaagaagaagtcttgcccgaagaatacccggatatattcgattttatagaaaacaacgacataccatttatccggatggagatagcgaatgatttagtgatcttctacgatgcatacgtcgaatatatttttaatcaggacactcagcccagactggtacaagtaaaggcaaaggaagcaacctgttcacgtattagcgtaatcgatgagaggaccggcaagagtgaatatcatggttactcagccaaatggcatgaaggtatgccggatgatgtaattgcgacgccactactggaccgccaggcacctttgcgggatttaaagacacgaatgggtttgtttcccaatgaaaagggaataaaagagatcgtcaaagaccgccgcttcatccataacattcgtatagcgactcccggacgattctattacagtaaaccatattggtggagtgtattcgtttccggatggtacgactttgggaatgccattcctatctttaagaaggctttgatcaagaatcaaatggcattgcgctatatcgtctacatcaaagaggatttctggggaaaattatatgcagatgaaaaaattacgaacgaagcagaccaggctgtacggcgagagaccttccttcaggacatgaatgactttcttgccggagaagagaatgcaggtaaaggcttcgtgtcccattttcgttatgaccgagtaaaaggatttgaggataaggatatcatcataaatactttagattccttcttcaagggtggcgaatacattgaagacagcgaggaagtaagcaacaccatctgctacggcatgaatgtacatccctccatcattggtgccgctcccggcaaaggtaagagtattaacggtactgaagcccgtgagctgttcatcatcgaacaagccttaatgaaaatgtttcaggaagccacgctcactcccctttattttgccaaagccgtaaacggatggccgaaagatatctacttttccgtcaccaactgtcagcttaccacgcttgacaaagggacaggagctactaaaaatacaggtttaacctcagaaacagaagaaaaatga

SEQ ID NO: 447 - DNA, 645 bp, B.fragilis
tcaaacatactgggaggattaacgatgggatattataaaagattaagtacctatcgtgctgaagtcaaacgctataacgcctcccgccgaaaagccacacagttgactaatgccccggcatccggactgatccgccttgaaaccgtctcagaaaccgaacgcttttcaatggctcaggatgctgatagactgactgcatataacaaggccgttgaaaagtggcaagatagtgtggcccgacaattacgagccggaatagccggccgcagtatgcgaatagcccgtgaacttgagccacgggcctacaccgacaaatacggtattatcaaccgtcttggtttctccttccctcgacatggaatctacatccacaagggcgccggcgaaggtcagggtggcttcatcggttccaaatggaattacctcaaaaaaattaatggagttgagatagataccggtattgtacgtcatacaaatctcaaatcactcggacgacagaatgaaggcaaccgccgggcctacgaatggtttgaccctgtaattcgtaaccggatcaatgaattagctgatatcgtcaccgattatttcgacactatgctgattgatgctactcgaatatacatagataaacgaaacagtctctaa

SEQ ID NO: 448 - DNA, 2202 bp, B.fragilis
cacatgtcactcaagataaaaaatcaattaggaatattcgatcttcaaaacgatttcagcatcgagatcgaagacacctcccctatttacaacgaacgtggctcacaatccgtaccggccacgcttcctgcctcccgaaacaacctttcactgatcacccatgtccatcgtccggatagtacctactcccctgccccggatgcccgtgtcaccgtctccgatggtgtctacaaccgaataggtaagatgaacatcacacaggcctccaaatccggaggaatcgtatccaatataggttttgacgagtctgaactctactcggaatggaatgctgtttcactccgttccctctctgctccggttattcgtcccgaaggaggaacaaccggcgtcatcagcctgctcaattctattatgaatgaaacaatcgtagacgatgctctttccatttttcccatttgtgtatccattccatcacatgcaacgaccgtggacgatacggaaaccaccacctactaccccgaatacatcaacaagataactaaattagagaatggtacctactcccttcagggagctgccagacaggaaacattccttatcaataacgaacccgtccttacttccgttcccgaaggttatgccatcagcccatttttaaaagtatcttggatactcaattttatattcgtccggtacggttatacggtccttgaaaatccattctcaacccaccgtcaactctcccgtctggtagttctgaacaacatggccgacagcatagtcaagggcttcattgattactctgaccttctacccgattgcacgattaacgagttcctacaagccctctactgtcgctttggtatggtgtattttgttgatggtaaaaataaaaccgttaatctcaaatttatcaaagatatcatctcaactccggcctcactgaactggtccctgctcaagtcggcccggcctgctatcaactatgccgctgcacagcaactcaaactttccgcatccaccaatatctccggtccttataccaatttagtagctactcctactgccgactcactcgacaaatttcttaaaacctttggccatgtcttgtcaagtaacacagcaaaaggatatctcacctattctttatgggatggattttattatgtccggaacaatctgaccggagttcgtgaagcccgcagctctgacttcttcccctgggataaaggggcaaacatcagttatatggagatatcatctattgatgaatgcctgccgatgaaaggttcttaccccgatgaccaaccggtttgtcctgcctatctcctgggaaaagtacacaaatataccaatatttccagcgccagcgtagaactatcagaggagcaaaacacccaaactcctctatgcttttgcttttccatgccccgtgcatccactccctacccctatggatcgccaagatgttacacacccggtggtgaagctattgccatcaacggacacacatttgatatctccatgacctttactggtgataatggcctgttctcccgtttttggaagggatttgacgctattctccgacattccaatcatacggttgaagttcccgtacacttgaatccaattcaattactcaatattgatttcagtcaaacgatcaatatagatggtcaacgattactccttgatacagtgcgctatacattacccaaacttctttcacgcccggctactatccgtcttcgtacccttcgtctcctaatccctgtaggggaaactgatttggacttggatgcagagcaaggaatacaaacgattgagcaactctacaaatgggcgtttcacaataatcgtgaaaacatagtagaactcaagatacgggcacaagtcgaggagtggaagaaggctattaccccaccggcgcaatggctcggagtgctacgtaaaaacgaggtaagtgatcaggtttcggatattgagataccgtttactgtaccgactcaagaagattatgaagccaacaaagagttcttcatcaaagaaatcaattacagtttcgacctttactataaggtccgggttcccaatgggcagacatctcaaggtgatatcatctggaaagataaagaatacggaggcgtacactatgccattacttacgggctttccgttaaagcggaactgctttag

SEQ ID NO: 449 - DNA, 222 bp, B.fragilis
cagtttccactactgccactggccaggcttataaatctaatcttcattattctcttctttttaatgcaaattgccggcaacttttatggcaaattgtcggcaaatatacataaaaaaggaaacaatcagacgttagttttcttctttttatcgatgaaatcagtgatttttgcaaaaataagcaaagcaattgctgcaaccaaaccgattgccgcaaagtaa

SEQ ID NO: 450 - DNA, 450 bp, B.fragilis
aaatataaacttatgatttacaaatttttatttcctctaaaaccagacagtgccggagcatctctattcttgttgattctaagaatttcgtttggcctgttgttgatgaatcatggtatacaaaagtggagcaattttcaggaactttccatatcctttcctgatccattagggctgggttctcccctctctttaggattggctgtttttgcagagttagcatgttcaatggcctttattataggcttcttatatagattggctatgattccgatgatttttactatggtaattgcattctttgttattcatgccaatgatgtttttgcaatgaaagagctggcgttagtatatctgattatttttgttttgatgtatattagtggtcccgggaaatattcagttgattatgtgataggacgacaactcaaaaacaaacgaaaattgtaa

SEQ ID NO: 451 - DNA, 240 bp, B.fragilis
tttgagatttgtatgacgtacaataccggtatctatctcaactccattaatttttttgaggtaattccatttggaaccgatgaagccaccctgaccttcgccggcgcccttgtggatgtagattccatgtcgagggaaggagaaaccaagacggttgataataccgtatttgtcggtgtaggcccgtggctcaagttcacgggctattcgcatactgcggccggctattccggctcgtaa

SEQ ID NO: 452 - DNA, 666 bp, B.fragilis
ctcgtaacttgtataactgatagcttaacaaagatgaaaaaactactcacgaaaggacaaatcgctatactcgtcattttttctgtcttgattattgatcaggtcataaagatttggatcaaaactcatatgtattggcatgaaagtattcgcattacggactggttttatatctatttcactgaaaataatggtatggcgtttggaatggagctttttgggaaactctttttaactacattccgaatcgttgcagtaggattaataggatggtatctatacaaaatcgtaaaaagaggattaaagaccggatatattatctgtgtatcattaattctaaccggtgcattgggtaatatcatcgacagtgtattctatggagtcatcttcaacgaaagtacacattcacaaatagccagtttcatgcctgatggcggcggttattctacttggttctatggtaaagttgtcgatatgttctatttcccgatcattgataccaactggccgacatggatgccttttgtcggaggagaacattttattttcttcagtccgatctttaattttgcagatgccgccattagttgcggaattattgccttattactattctacagcaaatacctgaatgattcatatcatcattctgtgactaaaaagtaa

SEQ ID NO: 453 - DNA, 1005 bp, B.fragilis
ccgtatcattgcaacaaaataagtgcaatgagccaaaaacgcatcatcttatcagattcatcactcaaccggtacggctaccgggttcttactgctggacttcttcttgaagctttcattgacaacccggtgatgctgtatgggcatttccgtgatgaaggatcacccctatggtgtgattacaaagcaatcggatattgggacgatatcaagatagaggacgacgtgctttctgctattcctgttttcgacaaggtagacgatttatcgaagaccattgccgcaaaatacgaagcagggaccttacgggccgcaagtattggtatacgtatcctggccacatcctccgaaaaagaatatctgcttccgggacaaacacgcgaaactgttaccaaagcagaagtcatggaggcttccatcgtggatatcccggccaactcccatgccgtgcgcttatacgaccgttcctcctccgttttactggcagcgggtatggacacgaatattgtgccagcattaacaatcccaaaagaaaaggcaatgaattacaaaccatcatggaccggcttcctctctttcctgggaatttcaaaagataaagcggaaaccaccgaactgtctgctgaaaacctggactctatccatgctgaaatggaacgattaaagacagagaacgctactcttgtacaggctaagaccgatattgaagagaaacttaactctgccaacgcgaagattacagagctgaacggttctacatccggcaaggataacgagattagtactctcaagaactctatcactgagaaggattctaaaatcacccaacttgaagagcaagtgaagaatctgaagaacggtcctacaccggggcatgccggtctgactcctgaacaagagcctgaaggtagcggaacccaggaagagttatctgctttttgtgaccagaacgcaggaaactatcaagccatcaccgagaaattaaaagctgagggcctgtattaa

SEQ ID NO: 454 - DNA, 1407 bp, B.fragilis
cttaaagaatgcacaatgaagaaaagtacaaaatttatcatcgcattgcttgtgacagtcggggcactggctatcacttaccgcgttgtaaaccaagcaccgtcgaaagatcttgctgctgatgctcagatgcaggaaatcattacttcggggggatgtttacaatgtcattcgggcagtccggaccttcctttctatgccaactggcccgttgcaagcggaatggtacagaaagacgtaacgcaaggttatcgtgctttcgacatgaccgaaatggctgaagctctgaaagccggtaagcctgtcggaaaagtagcacttgctaaagtcgaaaaagtaatcatggacggaacgatgcccaaacatgcttattacatggtacattggggatcgagcgtaacagatgccaagaaggaaatggctatggcatgggttaaacaacatcgcttggcacattatgctaacggactggctgccgccgagtttgccaatgaaccgatacgtcccatcgcagattctattcctgtggatatgcgtaaagtcatcttgggagatatgctctatcatgacactcgcctttcggccgataacaccgtttcatgtgcttcgtgtcacggattgaataccggtggtgtggacaataagcaatattcggaaggtgtaggcggacagttcggaggcgtaaatgctccgacagtgtataacgccgcttacaatttcgtccagttctgggatggacgtgccggaacacttgccgagcaggctgccggacctcctttgaatccggtcgagatggcctgtcagtcatttgatgaaatcattgcgaaactggagcaggatgcaaactttaccaaagcctttttggctgtatatcccgatggttattccgaacagaatatcacgaatgcgatcgaggagtttgaaaagacactgcttactccgaattcccgtttcgacctttatctgaaaggtgaaaagactgccattaacgatatagagctggccggatacgaattgtttaagaaatacgattgtgctacatgtcatgtcggtgagacactgggcggccagtcttacgaactgatgggcgtaaagagagactacttcgcagatcgcggcattgaattgacagaagaagataacggacgtttcaaacaaacccggaacgaacgtgacaaacatcgctttaaagtgcccggtttgagaaacattgccctgacggctccttacttccatgacggcagtatgaaaacaatgaaagaggctgtagattacatggccaaatatcagatggatctgaatcttccggaagatgaactgaataaaatcgttgcttttctggagacactgaccggggagtacaaaggtaagcccctgaccaacgataatcagaccaaagcattataa

SEQ ID NO: 455 - DNA, 192 bp, B.fragilis
gtgacgacgtgctcgcctcccgcccccggtgaagacctagagaccggtgttctgaagttgacggactcacctgccatccagtcgtttcctaagcgtgtcggtgtagtggaagatgttatgctttgtgctttctcggcaacagtaacaccgtcacttgcacgggtcgcaacgacttttacagactttaaatag

SEQ ID NO: 456 - DNA, 789 bp, B.fragilis
atttctatccgatttgttttgtattctcaaatttgcaggtatatgaaaaacagtgatttaactacttatggggagtatttggaaaagctatccccaaaacacggacgggaaaaggtatttaatgactttctgcaaatagtcgtttgttgcctctcaatgggacgtaaggaagaactttatttcaaaacgataaagccctatgacaaaacagaactggatttgttttcacaggcttttgccgcacttgttatgcagatggacaggcaaccactggtagacccgttcggagactattttcaagagtttttaagcaacgcccaaaacgggcagttttttacaccgtttggggtatgtgaattaatgaaccaattgattacagctcctaaagtaaatgatcagcctaaacagggagatcggagggtattagaccctgcatgcggtagcggaagactccttttatcagcagcccaaaaggatagagcattgacttttgtcgggattgatatctcatatacctgctgtctcatgactatcattaatttgtgtctgaacagcttaaacggagaagtattacacatgaatgccttgacggatcaatgttggcatcgttggttgattatcgttgatagtgtaaccaagataccgaccgtttatgaagtggaagccggaataataaaccaaccgcctgcatgtgcggatgatttaaagcctttaccggtgacagggatcatacagccggtaaagaacatgattcccgccaattttgtacgttatacccctaaatgttag

SEQ ID NO: 457 - DNA, 366 bp, B.fragilis
aggaacttacgtccgatacgggtatccgaaccgataccgctacgcaccatatttacatcagctcctactaactcacacagattagcgatgtcgttcatgaaactgatacgagtagccaacattgagtttgcggcatatttggtcatttcggcagagggaatatccatgaatatcacgcggaaattatttagcatgaatggcttatatagcttagtcattaatttttctgcacgttccgattccacaccgattacaacacggtcaggactcataaagtcattgactgcattaccctctttcagaaactcaggattggaagctacatcaaattctattttggcaccccgtttgtctaattcttcctga

SEQ ID NO: 458 - DNA, 903 bp, B.fragilis
aatggctatagaatcattaaagaaagaatcgatatgagcatacttattgataaatctacccgacttttggtgcagggtatcacaggcagggatggactttttcatgccaaaaagatggctgaatacggaacaaatgtggtgggcggaacatcacccggcaaaggaggaacaatgatagacgatacctttccggtattcaacaccatgcatgaggctgttcgccgaacgcaagccaatacatctgttattttcgtaccggcacgctttgctgccgatgctattatggaggctgccgatgccggtatccgactgataatttgtatcacagaaggaattcctacattggatgtaataaaggcctaccggtttgtcgaactgaagggagctaaactcattgggccgaattgccccggcctgatctctcccggagaaagtctggtaggtattcttccggggcaagtgttcactccgggcaatataggagtaatcagccgtagcggtacgttgacctatgaaatcgtatcacatctgactgctaaaggtatgggacagtccactgccattggtatgggaggtgatccggttgtcggactttattttcgtgatcttttgggaatgttacaaaatgatccgcaaactgatgctattgtgatgattggtgagattgggggtaacgcagaagagttggccgcaacatacattcgtgaacatgtgactaaacctgtggtggcatttattgcagggagatctgccccgccgggtaaacagatgggacatgccggagctattatatccggaagttccggttctgcaaccgaaaagatttcagcattggaagctgcaggaatcagagttgccggtgaaccctcggaaataccggatttactgaaaggcagtttctaa

SEQ ID NO: 459 - DNA, 1761 bp, B.fragilis
tcgaagcggcttatcaaagccatcgagataataaaattgtcaatcttaaatagcatatataaaatgaagaacgaaaacaaaatgattatttatcaagtgtttacacgcttgtttggtaataataataatcactgtatctacaatggagatatttcacaaaacggttgtggaaaaatggctgattttactgctaaagctttgggagaaataaaaaaactgggagcaacacatatttggtacacgggtattatcgaacatgccagccaaactgattatagaagatacaacatccgcccggatcatccggctattgtaaaaggtaaagcgggatctccatacgccattaaagattattatgatgtagatccggatctggctactgatgtccctggaagaatgaaagaattcgaaaatctagtaagccgtacacacagagcaggattaaaagtaataattgattttgttccgaaccatgtagcgcgtcaataccattcggatgcacaacctgacggcaccactcagctgggagccaatgatgatcctaactactcttttagtccgtacaataatttctactatattccgcaatcggaattgcatggacagtttgatatgacgggaaatgccttggaaccctatcatgaatttcctgccaaagcaaccggaaataaccgttttgatgcttaccctaacattaatgactggtatgaaaccgtaaagttaaattatggtgtggattatcagaatggtggaacttgccatttctcccctactccggatacttggactaaaatgttggatatcctccttttttggtcctctaaaaatattgatggtttccgttgtgacatggccgaaatggttccggtagaattttgggaatgggctatccctcaagtgaaacaggagtatccgaatattatatttattgctgaagtatacaatccgcacgaatataagaattatttatttcgtggtaaatttgattttctctacgataaagtaggactgtatgatacattgcgcaatgtagcttgtggttatgactctgcaactgctattactcgtagttggcagtctttaggggggattgaaaagcggatgcttaacttccttgaaaaccatgacgaacaacgtattgcatctgatttttttgccggagatccacgcaaaggtgttcctgccttaattgtatctgcttgcatgaatactaaccccatgatgatctactttggtcaggaattcggagaaatgggaatggatagtgaaggtttcagtggacgtgatggacgtactactattttcgattattggagtgtagatacaattcggcgctggcgaaatgaaggaaagtttgacgggaagatgctaactgaagagcaaaaacatttatatgcaatttatcagagagttttgacgttgtgcaatgaagaacaggcaatatcaaacggcgtattctttgatttgatgtatgctaatgaaaatggatggagatttaatgagcacaagcaatatacatttatgcgtaaatacaaaaatgaattgctatttattgtcgtaaactttgataatcagccagtaaatgttgcgattaatgtgccttctcatgcctttgactttttacaaattcctcaatttgattcttataaagcggttgatttactaacagataaagtagaagaaatcagtttactgccatataaggcaacagaaatcgctttaggagcttatacgggtaaaatattgaagattaaattttaa

SEQ ID NO: 460 - DNA, 195 bp, B.fragilis
tgtaatataagacgttttcatgacgactttatgttaaatactttgagtcaatttataacctcaaacaaaagggatggaacaaggtatatgccttttgcttttattgagttgggcgtagctatgctttcctctattttaaacagtgaagttgtaattgagattaacaaaagattatatcgaagaagtgtttactga

SEQ ID NO: 461 - DNA, 777 bp, B.fragilis
tttcagtcaagatccatgtgttccgaacccgatacctttgtgcaaactttaaaaaatataaaaatgaaaaaagttattattataggagctacttccggaatcggtaaaggattagcagagcgctttctccgggaaggaaatacagttggtattacggggcgtagagaagataaactacaagagatctgttctcaaaataaaaattgtttttatagtgtttccgatgttaccaaagataccgatacagtccgacaactgagcaatcttgtgaacagagtgggaggtatggatatacttatattctgttcgggaataggggagctaaatcctgaacttgattatcttctagagaaaccgactcttttaaccaatgtaataggatttaccaatgtagtggattgggcttttcacttttttcagaagcaagaatgggggcatttgattgtaatttcatctgtaggcggaatgcgcggtgaaggaatagccccggcatacaatgcctcgaaagcctatcaaatcaactataccgaaggattaagaaaaaaaacagccaagctaccttatcctatttatatcactgatgtacgtcccggatttgtcgatacggcaatggcaaaaggagaggggttgttttggattactccgttggataaagctgtacaacagatttatcgcgccatccttcgaagaagaaaagttgcgtatgtttcgaagagatggaaatatgtagcattacttctgagaatgatacccgcctcgatttattgtaaaatgtga

SEQ ID NO: 462 - DNA, 1419 bp, B.fragilis
aagcacaaaagaatgaaaaattttatggataaaaatttcctgcttcaaaccgaaacggctcaggaattatatcataatcatgcggctaagatgcccattattgattatcattgtcatttaaatccccaaatggtagcggatgattatcggtttaagtccttaactgaaatatggctaggcggtgatcattataaatggcgtgccatgcgttccaatggtgtggatgaatgcttttgtaccggtaaagaaacgtcagattgggagaaatttgagaaatgggcagaaacggtcccatatactttccgtaatccactgtaccactggacgcatttggaactgaaaactgcatttggtattgataaagtactaaatccgaaaacagcacgtgaaatttatgatgaatgtaatgagaaactttcttctcaggaatattctgcccgcggaatgatgcggcgttatcatgtggaaaccgtatgtacaacggatgatcctatcgattcattggaatatcatattagaactcgcgaaagtggatttgaaatcaagatgcttcccacatggcgtccggataaagttatggctgtggaagttccttcagattttcgcacttatatagaaaaattgtcagaaataagtgagattactatttctgactataatgatatgatcttagctttacgtaaacgtcacgactattttgcagagcaagggtgtaagctgtctgatcacgggatcgaagaattttatgctgaggactatacggaaggtgagattaaaactattttcaataaaatatacggcggttcggaactgacaaaagaagaagttttgaagtttaaatcggcaatgttaattgtgctcggtgaaatggactgggaaaaaggatggacacaacaatttcattacggtgctattcggaacaataacagccgaatgttcaagctgttgggtcctgatacgggatttgattcaataggtgagtttgctacggctaaagccatgagtaaattcctggatcggctgaattcaaaaggtaagttgactaaaacaattctgtataatctgaatccttgtgcaaacgaagtaattgccaccatgataggtaattttcaagatgggagtatacctggtaagattcagttcgggtcgggatggtggttccttgatcagaaggatggaatggaaaggcaattaaatgctctttctcttcttggattattgagccgctttgtgggaatgttgacggattctcgttcgttcctctcctatcctcgtcatgaatattttcgtcgtactttatgtaatttattggggtgtgatgtggaaaacggtgagatacctttatcggaaatggagcgtgtctgtcagatggttgaagatatcagttattttaatgctaaaaacttttttcatttttaa

SEQ ID NO: 463 - DNA, 774 bp, B.fragilis
tccgggggaagggactcttaccttcccctacataaactaaacaattacctgattatgaaacgatttattctttgcatttcatgcctgcttatctgctgcctgttcttgcttccggaagtacaagcggccattccggataccggaaactggatcagccatcatcttctgacatcagacggtttaaccgttctggctgccggcccggcatttgccccgttaaaatggaatatcgggcaaaacaacatgggaggttataaaggacggctgctctttattccgtatgacgctccttcaaccgtaccaatgattccggcaaagcctactacgaatgaggacctgattaccgcttcaggatcattcacttttccaagcggcggaacctatactcagccgatttacttgtattccacaaaagggaaagtaggttataaagcggaaattcaaggcgaaacggacggaaaatcttttaagcagactttagagtttttcttccccggcaatactccgggaatgcatgctttcagtacacttgtcaagaacactccggggtacttcgtcttcgaagattccgacggccaacaattcctgatgggtaaaccgggcatgtatgccgatgtatcaccctcctttgatggtggtaagctcgccgccgatcagcggggaactgcctatacagccacttgtgacgcaaatgaatcggctgttgttttagggacaccaatcgacatggaagtcattgcaggcctaaaaccggctccaagtcccggaggttaa

SEQ ID NO: 464 - DNA, 393 bp, B.fragilis
attattatgagtttaaatgatcgtttacgaattgttgtaaatgaattttttcatgggaataaagcggcttttgctcgagccgcaaaaatatcggaccaaagagcttatagttgtttgtctgttcggagtaatacagaacctccggctagagttttggagaatttagctaagtatctaccgaatttaaacgcgacttggcttttaaccggagagggagaaatgattcaagataaatccactcctgagatgccgataactcttgtttcggtaaatgaatataaaagtcgattgcagcaaatggaggtaagattggaagctctaagggctcaggtggtattaaaagataaactactagccggactactccgaaaagtagagaacaagactaaatag

SEQ ID NO: 465 - DNA, 597 bp, B.fragilis
aacaatatgagtccacgtaaattaatgttttggttgtttgcctgtatctttttagtttgtgccctgcgggccgggttattgacaagtgctgatcaatatatctatcatttacgtaatatgcatgcttctacttttgcatatcggtatgatgattttttgccataccttccgattgttgctatgttcgtgttaaaacttacaggagtaaagagccgtagtaactggaaacgaatgctcgtctctactgcattttcttatatattaatgggggccatagtgcttacaatgaaatcactggcgggggttcttcgtcccgacggttccgatttcctttcattcccttcggggcatacagctacggcttttacggctgccacactactgtataaagaatatggtttcaagacccccctagcgggtattgctaccttcttgccggcagttgtcaccggattcacaaggcagttgaataatcgccattggctgagcgacgttttggcaggtgccattatcggtatcatgatggtagagttagcctattttcttaccgataggctcttaatgaaaaccggtgcacagacttgttccaaatcataa

SEQ ID NO: 466 - DNA, 1599 bp, B.fragilis
aagctgtccggttataaagataaagcttacctttgcaatgtttttttaatacaagttactatggattatcctcataaaatcaataaggtacagatccgtaacctccagattgaagattacgctcaattatcccaatcgtttacacgtgtatattcggacggaagcgatgtgttctggacacacgagcagattgagaaactaattaaaattttccccgaaggacaaattgttactgtggtcgacgaaaagatagtcggctgtgcactctctatcattgtagaatatgataaagtgaaaaacgatcatacctatgcccaggtcacggggaaggagactttcaatacccattctccccaagggaatatcttatatggcatcgaggtctttatccatcccgaatatcgcgggttacgactagctcggcgcatgtacgaatatcgcaaagaactttgcgaaacgctgaatctgaaagcgattatgtttggcggtcgcatcccgaattaccataagtatgccgacaagatgcgtcccaaagagtacatcgaccgtgttcgtcagcgcgaaatctatgatccggtgctcacttttcaactctccaatgattttcacgtacgcaaggtgatgaccaattatttgccgaacgatgaagaatcaaaacactacgcctgtctcttgcagtgggacaacatttactatcagccgcctacgcaagaatatctggcccccaaaacaacggttcgtgtaggattggtgcagtggcagatgcgtagttataagaccttggacgatctcttcgaacaggtagaattttttgtagatgcggtatccgactataagagtgattttgtgcttttccccgaatactttaatgcaccgttgatgtcaaagtacaatgacaaaggcgaatcacaggccatccgcgggctggcccaatataccgaagaaatccgcgatcgcttcattaatctggcaatcagctacaacatcaatatcatcacaggaagtatgccgttgatcaaagaagacggattgctgtacaatgccggatttctttgccgacgcgacggaacttacgaaatgtacgaaaagctccatgtcaccccggacgagataaagagttggggactgagcggcggcaaacagcttaaaacattcgatacggactgtgcaaagataggcatactgatctgttatgatgtggaatttccggaactctcccgtctgatggccgaccaaggaatgcagattctgtttgtaccgtttctcaccgatacacaaaatgcttattcgcgtgttcgggtctgcgcacaggcacgtgccattgagaacgaatgctttgtggtaatagccggcagtgtaggcaatcttccccgtgtgcacaatatggatattcaatatgctcagtcgggagtattcacaccttgcgatttcgcttttccgacagacggaaagcgtgccgaagcaactccgaatacagaaatgatcctggtttcggatgtagatctcgacttattgaacgaactacacacttacggcagcgttcgcaacctgaaggacaggcgaaatgatgtatatgaagtgcgcttcaagaagccttaa

SEQ ID NO: 467 - DNA, 420 bp, B.fragilis
aaattgttgggaaattacagagatcaaattatgaatcgtaatgccattctaagtaaacgtcaaaaacagttcatcgaacgtattgcctggggagcttcttataaagaagtagctgatttcttccatgtgagttggagcactgttgacaatactctccgaaatgcaaaaacaaaattaggtttaagtaaagtgactgagttgggggcatggtggttctgcactaattacggaattagttttgatctatctcctattgccaggcaatgtacagcaggagttatcttactcttgttttcccttggagaagtgacaacagtaacaaatatatcatataccatgcaaagagtaagaagaccacgtacagagtatcgcatccgtcgacacgaaacttctatatatcaaccatatattattaactaa

SEQ ID NO: 468 - DNA, 1293 bp, B.fragilis
gtttttcagggaggtatcctattctttcttcttctgtatagatgcaacagggaaataatttcattctttatcaaacttattatgaataattggaagaaaaagtttatcattatatggacagggcaactattctctatactaagtagttctattgcccagttttctattgttttgtggattagtcttaaaacgggatctgcggaggtattgtcatttgcaactatcgctgctttattaccacaagctttattaggcccttttgccggcgtctttgtcgatcgttggaatcgcaaatggactatgattggtgctgacagctttgtcgctctctgttccggagtgatcgctttactgttctatttggatataatcgaattatggcatatatatcttttacttatgttgcgttcggttggcggtgcatttcatacgcctgccatgaaatcctctgtaccattgttggcaccggaaaaagagcttatgcgcattgcgggtatcaatcaagctatccagtcgatttgtaacattggtggtccggctcttggagccatattgcttcttgcgtttgacatgagtcttgtcatgcttctagatgtattgggagctataatagcttgtacagctttactttttgtgtatattcccaatcctaaacaagaaaatacctcagctaaaaatgtactttatgatatgcgagatggatttaatgtaattatgcgtaataaaggagtcagttgggtaatggtaactgaagttctggttacattttttgttatgccaatggtggcattgatgccgttgatgactttgaaaaatttctcgggaacagcatatcaagtaagtttgatagaaactcttttcggtgctggcatgttggccggtggtgccttattgggtgtatggaatccaaagatacgtaaaaccttgctgattgctatttcctattttttgcttggtgcggcattggcattttgtggaatacttccggctgatggttttgtactttttgcagcattaactgtggcacaaggtatagttgtcccatttttttccgggccttttacttcattactgcaaactcagtttaaaccggcatatttaggacgtgtgttttctctttttgacagcgtgagcttattgccttctatcattgggttgttcattaccggatttattgctgatagtttaggaatagccaatatttttatctgttgtgggatagcaattgtatttacctcaattttgatgatgtgcattccggctgtcagagatctggaaaagcaaagtaaatag

SEQ ID NO: 469 - DNA, 396 bp, B.fragilis
gagtatattatcccaatttattaccctataaagatacgtcttttatttgatatacacaacattataatgataaaaaaagagaataaaatattcgtagtcatatctcctgatcccgtcgagcgtgagcagttgatcgcacgcctggccgttcgtttaggttttgccaagattccgtccgatgcactcaagatcataagcaaggacatttattcctttgacctggcaactgcatattttgtgctttgcagtaactatcatttccggggttctatcgtcacaacacaacggctgtatgagcttgcagcaagaggtatatgtgtttgtgtaggtgtgaagtcactgccccgtgagtacgagttgttatctcaggtgttttatccgaatgatttgcgatag

SEQ ID NO: 470 - DNA, 1296 bp, B.fragilis
actttaactattaaaaagtctattcaaatggctgcaaataaactaattgatgtctctaaactgaacgaagcactggtcatttatgaccaggcacttcgtgcgctgccgtttgccaccctcaccgaagtggcaaacctactgaagctgaatgttatggacctgcaaggcaaacacgcacgtatcaacgagcgtcgtcgtgccggtggtacgcaatcgtataaaatcggaaagaacttcggactggtcgataaactcttaggttacgaaccctcagtcatcgagccgaaagatgttgtctgcatcaccaaagaaaactcccagaagtacgatgataacgaactgctgatcatcggtggcactccggtaagcaacactacaaaaaaacatccgatggaaaccaaggttgcatttaccctggtacgttcgcatctggaagatatcgtatatagcctgttctctgccgaacgggatgaagattccaactcacccggcggggctttcgatggtatttataccaagatggacatgctgatcactcgtggcgatgtaaatgcggcccgtggtaatttctctatttccggagagtttgccgcgccaacatcagatacagattatacagcttacgagaatctggtggaatggatcggaggcgcaaacacctaccttcgttcttcaataggcggtgtaccacagcttttgtgtgctgaaaccgttttgaaagctgcccgttcagcattacgtaataagttacgcatgcaggaatatccttccatgcaacgcatgcttgaactcttgcgggaagacgccatgtgtccgaacctgattgtctcctcccacgaagctttaggccaaggttccaggctgacccttcagaaagttggtaacatagacgtggcgttcaatactcaagcggcttctaaattctgccagatacgtgatatttacgaggacccgaacgaatggcagttctggttgcaggcaggatacgatacacgtatcaatgactggcatgagaaagtcttccgctgtaacgagcagaagaacgaatctctcgacctggccggcgactattgtaaaaccggtggagtacaggtagccatcaccggcaccgacaaaggccaatggagtatccagggaaaagttgccaaacgcggtaacggccaatgcatcattggacttcctccgggaaaatacaccatcgagttcactgatgccgatggcaagaccaaaccggcaaatacacaggttacagttgttgccggtgaagtagccaccgctaccggagcctatacttaa

SEQ ID NO: 471 - DNA, 348 bp, B.fragilis
gttctttatattatggaacaattgttcgaagctatcctcgcgatagcaaagcagaaccccgatgggttcacggttgacctcacaaccttaaaaaaggtcacaaagggtatttcagtcgcctatctcgagactcaagacagtttcggagaagaaggactgaaaagagttcttaaccatgctgagatgcacgaaaagaaggtcggtggatggctgaatgaagagaaccaagagttctattttgattccgtccggattttcaccaaccttgaagaagccaagcgattcgggtgtgaaaataaacagatcgctattttcgacatctctcatatgagactcatcaaattgtga

SEQ ID NO: 472 - DNA, 768 bp, B.fragilis
tatctctatatttgcagcaatcaaagactcaatattatgcatgacatacccaaacaaatcccattggcaaacaatcacatctcagtggactgtgtagtgatcggttttgacggagaacagctcaaggttctgctgattaatcggataggagaggaaaacggaaaagtttatcgtgacatgaaacttcccggaagtctgatctatatggatgaagacctggacgaagcagcccagcgggtcttattcgaactgaccggtatccgaaacgtcaacctgatgcaatttaaggcattcggttccaaaaaccggacgagcaatcccaaagatgtacattggttggaacgggctatgcaatcgaaagtggaacgcatagtcaccatagcttatctgtcgatggtaaagatagaccgggcactggacaagaatctggatgaatttcaagcctgttgggtagcgttgaaagacataaagacattggctttcgaccataacttgataatcagagaggcgctgacttatatccggcaattcgtagagtttaatccttcgatgctattcgacttgttgccgcgtaagttcaccgcatctcagttacgaatcctgttcgaactggtatatgacaaagcagtggatgtgcgtaacttccataaaaagatagctctgatggactacgttgtaccgctggaagagaaacaaaccggagtagcccatcgggcagcccgttattataagttcgacaggaagatatataataagacaagacgataa

SEQ ID NO: 473 - DNA, 2322 bp, B.fragilis
aaaccgtatatgaagaaagggattctttacacgattcttctttatcttgctttgtcactggcttcgtgctctgccactaagtttgtaccggatggctcttatctattggatgaggtaaaaatacatactgacaacaaagaaataaaaccttcggacatgcgactttatgttcgccagaatcctaattctaaatggttcagtaccatcaaaacccagctatatgtatataattggtccggacgggattctacaaaatggttcaatcgattcctgcgtaaaataggagatgctccggtaatatacaatgaatccgacgctatacgctcgcaagaagaaattgctaaagcagtgcaaaatttaggatatatgggagctagcgtaaaaagaactacaaaaacgaaaaagaaaaagctaaaattattttatgaaatcacttcaggcaaaccttatattgtacgtacactgaaatatgatatttctgataagaaaatagcagaatatcttcggaatgattctacccaatcaatgttaagagaaggaatgcttttcgatgtaaatgtacttgatgcggaacgacagcgcattacagactatctattatgtaacggttattataaatttaataaggattacattacttatacagctgacactgcccgcaatacccatcaggtggatctcactttacacttattaccttataaaacttatgtcggagatactcctaaagagcattttcagtataagattaacaaaatcaatttcattaccgattatgatgttctgcaatcgtcagctttgagtagcattgagatcaacgattccttgcattataacggatttccgatctactataaagacaagctatatttacgtcccaaagtgttagtggataacctgagatttgcatccggagatttatatgacgaacgtaatgtacagaagacttatacttactttggacgactatcggcgctcaaatatactaatattcgttttttcgaaactcaaaatggcgatagcacccaattaaattgttatgtcatgctaactaaaagcaagcataaatctatctcttttgaactggaaggcactaattctgcaggagatttgggagctgccgcatctgtttcttttcaacatagaaatttattccgcggctcggaaaccttcatggtaaagtttcgtggagcatacgaggctatttcgggattacaaccgggttataaaaaccataactatactgaatacggagtcgaaacaagcattaatttccccaatttcttgtttccttttctcacgtctgactttaaacgacgaataaaagcaactacagaattcggcttgcaatataattatcaattacgtccggagttctcacgtaccattgcctcggcttcgtggagctataaatggatacaaaaacagaaaatacagcatcgcatcgatttgttggatatcagttatctctatctgccttggatttcgtctcaattccaggaagattatattaataaggataaagataattatattctcaaatataattatgaaaatcgtttgattgtacgtatgggatacaattatagctataatagtgcgggtggaactcttgtcaataatacaattacaactaattcttattctatacgggcaggcttcgaatcagcaggtaatattctttacggaatttcgaaaatgattaatatgagaaaaaataaagatggcgaatatgctattttaggtataccatatgcacaatatttaaaaggagattttgattttgccaaaaatattattattgaccatcgtaattctcttgcatttcatgccggaataggaatcgctgttccttatggaaatgccaaagtagttccttttgaaaaaagatatttttcaggaggagcaaacagtgttagaggatggtccgtacgcaatttaggaccgggttcctttgccggagatgggaatttcatgaatcaatccggagatattaaactggatgcaagtatcgaataccgtactcgtctattctggaagtttcgtggagcagcatttatcgatgcaggaaatatatggactattcgcgaatatgaaaatcagccgggtggtgtttttgaatttgataagttttataagcagattgccgttgcttatggattagggctcagacttgacttagacttttttgtacttcgctttgatggggggatgaaagctataaatcctaaatataaaaaagcaaaagagcgctatcctattattcatcctagattcagccgcgatttcgcattccattttgcagtaggctatccattctag

SEQ ID NO: 474 - DNA, 267 bp, B.fragilis
cactatcgtattatgccaagcgacagaatacatcaaagtaaagtctgggaacttatggagcaacggaaagagggtaaacccattgagttctccattgaattctgcaaaaaaagtaccggtgaactcattacctacgagcgtgcggtacttagttcatttcatagtagcggaagcactgtcaacatacttcaaataggtgagtatgctcccaggaaaatccggagatgtctaattacacgatttaataacatcaaagtttatttctaa

SEQ ID NO: 475 - DNA, 1530 bp, B.fragilis
tatctactcattataagtccgtatttcacggtctgcaggctcttgttgcctgcagaccgtaattcaaaaaaagctaatgccatgaatcataccaacgagggtagcaagctctacctgtattccattacatcggtagccatcctgggcggattgctgttcggctatgataccgctgtaatttcaggagctgagaaagggctcgaagccttcttcctcacagccacagattttcaatacgacaaagtgatgcacggcatcacctcctcgagtgcactgatcggttgcgtcttgggtggtgcattgtccggcatcttcgcttcacggctgggacgccgcaactcactacggctggccgccgtacttttcttcctttcggcactggggtcttattatcctgaattcctgttctttgaatatgggaaggctaatatgaacctgcttatcacctttaatctctaccgcattctgggaggcatcggagtgggactggcgtccgctgtttgtcccatgtatattgccgagatagctccctccaacattcgcggtacactggtgtcatgcaatcagtttgccataatcttcggcatgcttgtggtttactttgtaaactacctgatcttgggcgaccaccagaatcctgttatcctgaaagatgctgccggcacactttctgtaagtagcgagtcggatatgtggaccgttaccgaagggtggcgctatatgttcggttccgaagcctttccggcagctttcttcggcatgttactcttcttcgtacccaaaactccccgttatctggtgatgattgatcaggatcagaaggcttattccattctcaaaaaagtgaatggagccacaaaagcacaagagattcttgccgaaataaaagccacttcgcaggaaaagacagagaagctgttcacctacggtgcggcggtgattgttatcggtattctgctttctgtcttccagcaagccatcggcatcaacgccgtgctctattatgcgccgcgaatattcgaaaatgccggtgccgaaggcggaggaatgatgcaaaccgtcatcatgggcattgtcaatatcgtctttacactgatagctattttcaccgtcgaccgtttcggacggaaaccgttgcttatcatcggttccgtcggtatggctgtcggagcctttgcagtcgccttgtgtgacagtatgggtatcaaggggatacttcccgtactgtcggtcattgtatatgcagctttcttcatgatgtcatggggacccatctgttgggtactgatatccgaaatctttcccaacaccatccgtggcaaagcggtggccattgctgtggcatttcaatggatattcaactacattgtttcatctacgttccccgcactctatgatttcagtccgatgtttgcctacagtctttacggaatcatttgtgtgattgccgccctcttcgtatggcgttgggtgccggaaaccaaaggaaaaacattggaggatatgagcaaactttggaagaggcgttaa

SEQ ID NO: 476 - DNA, 591 bp, B.fragilis
aattatgtcatggatgaagaagtgaaaggttttaatagatatatgtcaaaggttgactttcaacctgtcacagaatttatatttcaaaatggacagttgacagattataaaaagggagagttttttagccgtcaaaatgaatcttgcaaaatggtaggctacgtgacggaaggctcctttcgttattgctgtaccgacagccgtggaggaagtaagattgtcggttatacgtttgatcactcttttgtgggaaattatcctgcttttcgtctgggagacaattctaatgtcgatatacaagctatttgtaattgttcggtttatgtaatcaataacaggcaattggaggagttttacagtcgaaatgaagcaaatcaaaagttaggtaggcaaatagcagagatattgctttgggaagtatatgagcggatgatctctttatatagtatgactcctgaagaacgctatacggaaatcttaaaacgctgtcccgaattgttgaacttgatctcgctaaaagaattggcatcctatctgatgatctgtccggaaacgctgagtcgtcttcgaagaaaattagtacaaaagtaa

SEQ ID NO: 477 - DNA, 204 bp, B.fragilis
gacctacgcatggcctaccgatggcaaataatgaaaaatgaaactgctttttcaatggctggtatttatgatattggggtagataaggaatcaggcaagcagcatgctacgttttccatcataacaattgttacggatccactgacagattatatacataacactaaatatcggatgccggttatttttgttatccaaagatga

SEQ ID NO: 478 - DNA, 960 bp, B.fragilis
tacaaattaatagcccttttatacgtttattggcatatttttacttactttgcaccatataaaggcacaactatgcacaaaaaactattagtgactgcatattttgtaatagcagcattgttgcaaactctggcaggcaatttccccttatctttttttgcattccctctgaatgtgattgtagcagttatatggatttattcgttatggcgtctctataaagaagggaataagttgccattaacccgttttctgttatcttcccgaacaagtgttctatcgatcctattattaataggtggcagtctggttatcggtttgtttcctcagttatcggaagcagaagcagattccatgccaggggttttagcttcgttgggatgctataatttcatgacttcctggatattcattgccattcttttccttttattgagtaatttggcaatggtgattattcatgctttttatcattgtgtgccggcaaagaagcgttttatcctgaaccatttgggattatggctcgctttatttgccggatttttcggtagcagtgatgttcagactttacgcatcccgctttataccggacaaccgggacgcgaagcttatagtatggatgggaaagcctattatctggattatgaactggaactctattctttcaatacagaatattatccgaacgggatgccttcgcgttttgctgcagatgtgcgtattggaaaccggagaactacacttgaagtaaatcacccccactgttaccgtttgggagaagacatttacctgaccggatatgatacacgcaacatgggaaatacccggtattgtatccttcaaatagttcgtcaaccttggaaatatgttatggtagttggcattttgatgatgttgacaggagctgttttgttatttattaatggtcctaaaaagctgaaacatgataacctgggataa

SEQ ID NO: 479 - DNA, 360 bp, B.fragilis
ttcaaatcaataaaagaaatgaataaatcatattttgaaacaagaaagacggaaattcaatcagagattgatagctggaaacaagggttaagagacttggaggatgaatatatttcctctaatcaaaaatttcctattggaagcaaagtttgtattactacccctgcacatgaaggatgggcattgagtacccgcgaaaaaataacgttcccagaaagaaaaagatattcttatgtaactgggtatgaaatatgtcataatgaggtagtgcccattctgatgaaagctaagaaggatggtactatttcaaaaattcgggattatataacattagaaagagtgatagttgaactggcgtaa

SEQ ID NO: 480 - DNA, 216 bp, B.fragilis
ttcccgccaattttgtacgttatacccctaaatgttagtaatatggagaaagttttgcaatgtgtcagacttccgcaaaatggtaaaggaacaatcgggtttaatttgaaaggagagtatttaaaaaaatacggtttccagttaggagataaagtaaaggtagaaatcagcaaaaataagattgttttatttaagacgggtaatgtgctggaatga

SEQ ID NO: 481 - DNA, 3450 bp, B.fragilis
tatagtaaaattgtaaatatagccatgagcaagaaatttgccgaatattcgcagttcgacctttcgaaggtgaataaggacgtgttgaaaaaatgggacgaaaaccaagttttcgccaagagtatgacagaacgtgaaggctgtccttcgtttgtattttttgaaggacctccatcagctaacggtatgccgggtattcaccacgtaatggctcgttctatcaaagatattttctgtcgttacaaaacgatgaagggctatcaggtgaaacgtaaagccggttgggacacacacggacttcctgttgagttgggggttgaaaagtctttgggaatcacaaaagaggatataggaaaaacaatttcagtagccgaatacaatgctcactgtcgtcaggatgtgatgaagtttacaaaggaatgggaagacctgactcacaaaatgggctattgggtggatatgaagcatccatacattacatatgataatcgttacatcgaaaccttgtggtggttgctaaaacaattgtataaaaaaggattactgtataaaggatacaccatccaaccctattctccggcagcaggaaccggattaagttcacacgaactgaatcaaccgggatgttatcgggacgtgaaagatacaacagtagtggcacaattcaaaatgaagaaccccaaaccggaaatggcacaatggggcactccttatttcctggcatggaccactactccatggacattaccttcaaataccgcactctgtgtcggccctaaaattgattatgtagcagttcaatcatataacgcatatacaggacaacccatcacggtggtattggcaaaggcgttattgaatgcacattttaatccgaaagcagccgaactgaagctggaagattataaggcaggtgataagttggttcctttcaaagtgatagctgaatataaaggtcctgatttagtaggcatggaatacgagcaattaattccgtgggtaaatccgggcgaaggtgctttcagagtaattttgggcgattatgtaacgacggaagacggtacaggtatcgtacatattgcacctacatttggtgctgatgacgcccaagtagcaaaagctgccggcatacctccgctacagttggttaataaaaagggagaacttcgtccgatggtagatttgaccggtaaattctatactttagatgaattggatgaagactttataaaacagcgcgttaacgtagatttatataaagagtatgctggccgatttgtgaagaatgcatatgacccaaacctgtccgatcaggatgagtcattggatgtaagtatctgtatgatgatgaaggttaataatcaagctttcaaaatagagaagcatgtgcataattatccccattgctggcgtacagataaaccggtactatattatccgctggacagctggtttattcgttctacagcttgcaaagaacgaatgatagaattgaataagactattaactggaaaccggagtctaccggaaccggtcgttttggaaaatggctggaaaacctgaatgactggaacttaagccgttctcgttattggggtactccattaccgatttggcgaacagaagataacagtgacgaaaaatgtatcgagtcggttgaagagctatataatgaaatagaaaaatcagtcgctgcaggatatatgcagtcgaatccttataaagataaaggtttcgtaccgggtgaatataatgaagagaattataataagatagatcttcatcgcccttatgtagacgatattatccttgtctcaaaggacgggaagccgatgaaacgtgaagcagacttgatcgacgtatggtttgattcgggcgcaatgccgtatgcccagattcattatccatttgaaaataaagaattgttggatagtcatcaggtatacccggccgattttatagcggaaggagtagaccagactcgcggatggttctttactttacatgccattgcaacaatggtattcgatagcgtctcttataaggctgttatttccaatggattagtattagataaaaatggcaacaagatgtctaaacgtttaggtaatgctgttgacccattctctactattgaacaatatggctctgatccgttacgctggtatatgatcactaactcttctccatgggacaacctgaagtttgatgttgatggcattgaagaggtacgtcgtaaattcttcggaacgttatacaatacttattctttttttgccctgtatgccaatgtagacggttttgaatacaaagaagccgatcttccgatgaatgagcgtccggaaattgaccgatggattctatccgtcttgaatacattagtaaaagaggtagatacttgctacaatgaatatgaaccgactaaagccggacgtttaatttcagattttgtaaatgataatctgtctaactggtatgttcgcctgaaccgtaaacgtttctggggtggtggattcactcaagataagctctctgcatatcagactctgtatacatgtttggagactgtagccaaactgatggcacctatcgctccattctatgcagaccgcttgtacagtgatttgatcggagtaacaggtcgtgataacgttgtatctgtccatcttgccaaattcccggaatacaatgagaaaatggttgataaagaactggaagcacaaatgcaaatggcacaagatgtcacttccatggtgctggcattacgccgtaaagtaaacattaaggttcgccagccattgcagtgtattatgattcccgtggtagatgaagttcaaaaagcgcatatcgaagccgtgaaagtattaatcatgagcgaagtgaacgtaaaagagatcaagtttgtggatggtgcggcaggtgttctggtgaaaaaagtgaagtgtgacttcaaaaaactaggaccaaaatttggaaaacaaatgaaagctgtagcagctgctgtagcagaaatgtcacaagaagctattgcagaacttgaaaagaatggtaagtacacctttgatttgggcggagcagaggctgtgatagaatcggcggatgtggaaatcttcagtgaagatattccgggatggttggttgccaatgaagggaaactgactgttgcacttgaggttaccgtgacagacgaactccgtcgtgaaggaattgctcgtgaattggtaaatcgcattcaaaatatccgtaaatcaagcggtttcgagattacagacaaaataaaattaacattatctaaaaatccgcagactgatgatgcggtaaatgaatataatagttatatttgtaaccaagttttgggtacatcccttactttagcagatgaagtaaaagacggaacagaattgaatttcgacgacttctctttgtttgtgaatgtagtgaaagaataa

SEQ ID NO: 482 - DNA, 546 bp, B.fragilis
aggggaaaaatttcccctttatccgtcggaagaccacgcaccgccctcggaaaaagtttcgcctcaaacttttttttctctcttatatgctgcccccctcctcaaaaatcatcgcacatgcgataccgctccggcacattgtgccgtttttctgtcctttacgtaagcgcttgtacacaatacatttgcaataaaaaagcgatgaatgagattctaaattatatcatggtctttctcttcggcggcggtttagtcggaaccgccacagcatttgtcactatcaaatacaccaagaaacgtgcagaagctgatgcaatgaaagcgatgcaggatgtctaccaggaaatgatcaccgatcaaagaagttacatcaactcactcaaacaggataaagaagatagtgaggcacgctgggaaaataaagttgaaacattatccaaacgtattgagactatggatttgaaaatcaacgaaaacaatcgtttgataacagagctaaaaaccatgaaatgtaccgatttaatttgccaaaaccgtaaacaatga

SEQ ID NO: 483 - DNA, 1275 bp, B.fragilis
atactgggaattttcccctacttttgcaggatacttaatgaacattcagctatgcaaccatcaaaaacagaattaattctgattcgtattaccggtgaagatcgtccgggacttacagcctccgtaacagagatattggcaaaatacgatgccactatcctggatattggtcaggcagatattcataacaccctttcactgggcattctctgtatgactgaggaacaactctcgggatttatgatgaaagagttgctttttaaggcatcttccttgggagtaaccattcgtttctatccgattaccgaagaagagtatgaaagctgggtgaatatgcaaggtaagaaccgctatatccttacattgctgggacgtaaacttacggctcgccagattgcagcggttacccgtattttagctgaacaggacatgaatattgatgccatcaaacgtctgaccggacgtattccattggatgagcgtaaaatgcatacccgagcctgtattgaattctcggttcgcggtactccccgggataaagaagctatgcagggacagttgatgaaattggccagtgaacttgaaatggacttctctttccagttggataatatgtatcgccgtatgcgtcgcctgatctgtttcgatatggactctacattaatagaaaccgaagtaattgacgaacttgctatacgtgccggtgtaggtgctgaagtaaaagcaattacggaacgtgccatgaggggagaaattgactttacggaaagttttcgtgagcgggttgcactgctgaaaggactggacgaatctgtaatgcaggaaattgccgagagtctgccaataactgaaggggtggatcgcttgatgtatgttctgaagaagtatggttataagattgctatcctttcgggaggtttcacctactttggacagtatttgcagaagaaatacggtgttgattatgtatatgccaatgaacttgagattgtagacggcaagctgacggggcgttatttgggagatgtggtagatggaaagcgtaaagcggaactgctgcgattgatcgctcaggtagaaaaagtagatatcgctcaaaccattgctgttggggatggagctaatgatcttcctatgttgggagttgccggtcttggcattgcctttcatgcaaaacccaaagttgtggccaatgccaaacaatctattaatacgattgggcttgatggcgtactttacttcctgggatttaaggactcttatttgaatatgtaa

SEQ ID NO: 484 - DNA, 237 bp, B.fragilis
atgaatcacttctctttaatcacagaaaagcccgtacataaaaactgtacgggctttttcaaaggaaatagaatattctcccggctaccttcgggaatggctacgcataaagggtatacggctccctcaatttatcagttgtgtaacatttataataagacggaattggaggtactttgttccgcttcggctcatgttttaactgtttattttcatatttacctaattatccaatga

SEQ ID NO: 485 - DNA, 1062 bp, B.fragilis
aacctatatgttatgaattacggtataagtgtattgttcagagcaattcccttggcaatggctctgttttgttttggctacggggcgtttatcagtgcatatggcgatgactctaaccgactagtagcaggtccggtagttttttcattaggtatgatttgcattgcattatttgcaacagccgctactattatccggcaaatcatacatacatacgggcgaggttctttatatgcattgcctattatcggttatctggctgctgttgtcacaattattggcggaatttgcatgtttacccgatctacctctacctcctctttcgtagctggacatgtagttgccggagtgggactgataactacttgtatagcaaccgcagcaacatcttctacccgtttttcattgattcctgccaactcaaaaatgattggtaacggtattcctgaaggagcgtttaccaagggccaagagcgtatattaaaaacaatagctatcactatatcgttgattgcctggatctgggctttcgttttattagccaagagtgatgtacatcctgcttatttcgtagcagggcatgtgatggtaggtttagcttgcatttgcacaagcctgattgctttggttgctactattgcccgtcaaatcagaaatgtgtatacggatagagaacgtaaaagatggccaaaactcgtattgttgatgggaaccgtttcgcttctttggggactgtttgttattttttccgattcaagcactactaacggagtaatcggatacatcatgattgggcttgggctggtttgttacagcatttcaagtaaagtaattctgctggcgaaaatttggggaagagaatttgctttggccaaccgcatccctttgattccggtattgacggcgttggcctgtttgtttctggcttctttcgtttttgaattgggtacgacgcatgatgattattttatccctgcacgcgtattagccggtttgggtgccatttgcttcactctcttttcaattgtcagtattcttgagagtggaacatcttcaaaataa

SEQ ID NO: 486 - DNA, 4932 bp, B.fragilis
gaaatccccgtatacataccgaacagttcacacctcaatttaattgatatggccgatcagcaacaaattatagatgaactcattgactacattgacaaagcagtactcaagcacagtgtctctaaccggcatgtggcagaagtgctatactggttgaatgaaggattaaagaaagtttctactgatggtttaaaagatatctttatcagtaaaaagcagatagacgaaaccaattttttacttcgtcttctgggaggtgtcgaatttagcagcggggatgatccctacagaatcacgcaaaaaggcgaagctttcctaaaaaagttaactttaaatggtggtctgatagaatatgatccgaccgaaagagtttggaaactgaacggtaatatgctgatctcaggtaacattactttcggttgggacaatggaacatacaccgcaccaactcttctcgacctgctcccttacgacccgactaccctgtcaaaagagggcggccgactgtctgtgatcaatgccggttctgactttgatgaattggccatgtggggcgtcctcagtaaagaaggtgttcagcagatcgacaagtcacatttgtccggtgctcttgccggatatgcgacagagaaatttgtcacagataaaggctatatcacttcctccgctcttaccggctacgctacggagaccttcgtcagagagaactttgtaacccttgccggtgcccaggagattaccggtgaaaaagatttcaccggcggactgaaagtgaacggtggcctgctcgattacgatccgaccgaaagagtttggaaactgaacggtaatatgctgatctcaggtaatatcactttcggctgggacaatggaacatacacagctccgacccttcttgatctgttgccttatgatccgactaccctgtcaaaagagggtggccggctgtcagtaatcggcagtgccggttcaagcttcgacgaatcctccatgtggaccgcgctcttgaaaagtggttctcaacagatcgacaagtcacatctggatacagctcttgccggatatgcaacagagaactttgtacatacgaaccttaatgccctgaaaggaaccggtcttccaactacggaaggatatcgcaatgttacagagatagccaataccctgcttacctttctcaccggatcagataccgactcgacaatcaacaaatggaaggaacttgaagcgttcctggccggattctccgaaacggatacccttgctactgctctatctgtcaaagcggataaaacccgtagcattattaccggcaccggtctttccgggggtggtgatttgtctgcggatcgtaccttgtccctttctccttccggaataaaggccggtacatacactaagctcaccgttgacgcttatggtcgtgcaacgtccgcatcagggttgatagcctctgatatccccactttagagattagcaaaatcaatggtttacaggatcgtttgaataccttcgtcacccttgccggtgctcaggagattaccggtgaaaagaatttcaccggcggtctgaaggtaaacggtggcctgctcgattacgatccgacacataaagtctggaaactggatggtaacctgttgatcacaggtagcacaacctggaatgcggtgggcgattatactgctccgacccttctcgacctgctaccttatgacccggccactctgtcgaaagaaggtggcaaactttccgttatcggtggcggtggaagtggcggtggtggaaacataatgttgaatggcacactctatgaagcggctaacggagtcatcacactgcctgatttatatcagaaaacacctaatggaaccgcatcacaatttctcaaagctgatggtagtctggattccaacctttatgcattagcgtatggtggtgaccaaaacagtattcagtattcaagtaaatctaattacttaagagttattgatagaagaaatgacacaatacttccaacctcttatgataattataatattagtggcttatttcatatgtctggcatgccatcctctaactggtggtcaggtattcatgtgaaaggttggggagaaggttatgctacctgggaacttgttgggccttcttcaacagataacactaataatagattatattatagggatggcaaaggttcttcttgggctactgattggaaaggtatagcttttcttgaagattgtaataaagttgcaactccttactttgagggacaaaatatatattcagactatgggtggtgggtagttgctttatgtaaacttagtcctgctgattctgaatataattatgcaagcggtactatgttttacagaagaggaaatggcatttatcccaatggttctgtacaatttaatgttatcaaaaggtacaatcaaacaaatgttaactttggcgtattatacaatggctatggtataaatgaaggtgaagatgctccaaagccttgtacatttacttataatggagttaaatatgccggtcttaaatgggcgtctgctgcaagtttagatagtatcaaaacccttatatatgatataagtactacaggattaccgttttatgttaagtatttcaattctcagagtggagaggtatttaacaccgaaataaaaaattctatcgttgaacttggaagtgatatatctggaactggacttggtacaataggaactattagaatattaaatagaaaggccattgatattaaaggagaagactggggatatattcaacaagcaagtgctgatagaatgttccatgttgcagtagctaaaagcactcaatctggccttggaggaggacttggcaactatgaaatcagatgtaacggaaccagtgaggaaggtatatttgtgagatacagtggttcatcttatggcaaattaggggtcgttaatagaaatggtcaagaatcaagtattagctattacaataataatacagctgtaggtgcagataaacctttatggactgtaggtgccggtatcagaaatgcttatagtttcgattggtggtttggaactaatggatatagaatgactcttgattcagatggaaaactatttattaatagaacaaataacaatgaaggtggtctttctgttagtttggctattggagacagcgatactggtttacattggcaagctgatggaattatagaatttaggtctaatgctaagcaagttggttattggggatatactaatggaagattatttaattgttactttagagagccaagtggagtcacttatgaaaaagcatctctaatgattaatggcaatggttctactatatctccttctatcggatttcatcaaccaggagttgtaggatgtcacttagaattagacaatgggggtaattttagatttaaagatagttctggatatagaaatgtctatgcaggtaaccttattgctgatgcgggtttcctttattccaggtataatggtattgaaatcaaaataggctctgaaaatgattcatatgtacatttcattactaaacctgcgagaagtttatattttgctaatagcttgtttgtgaatggaagtgtattaccttatagtagttctacctatagcttgggagatgccgggcacttatggaactatgtgtatggtaaccattttatgggtaattctgcatctgccacatttatacttccgaactatgtcggcggacaacaggcgaatcctcaaacctatttcaataatagtatgggggtcaaagtagctatgacaggcgttaatcctgattcatattggggcgatactttatggattaatggatatggtggtactgatgttccggatatgtgtgctttgcatttttcaaggggtggtgctcctcttatttatataagcagtcaaaaatatcacgctacaagttatggcacaatgtaccatatatggaccggttataactcaaaccattcttctgctgcctggacttgcagtaccttaaatgcaaacggaaggattagcactacatcagacatatattctgccggttgggtcagggccggtggaagtaatggattctattgtgaatcctatggcggtggtatccacatgacagattcgacctgggtacgtgtctataacggtaagcagttctatgtcagcagtacttcttccgatgccatccataccgccggaggtattaacgcaagtggcaggatttatgccggtggtcacctgagtactaatggcggtcttgctgtaagtggtatctatggcggctcaggcgcatcaggttttaatgtgtatgctgtattccagggcaggtcagaccatggaggaatagaagtgagggcttctgacaatacctttggtatcggtgtacactccaatgatcacatgtactggtggtggggaacatcaacctcaaccaattccagttctggaaaatcctatatcatggactatggcggcggtaattggagttttaccggtaaccactatgtctccggttattcaacctggggctccgactcacgttataaaacctatctgggtgaagtaaccctgcaattggatcagatcgcagactcacccactatctactaccgctggaacagtaagaagagagatcgtgacgggcttctccatgtgggtggttatgctcagtacaccgagcagatccttccggaactgactcatgatacgagtaactttaaaacgatggactatgctgtctgcgcttatgtatacgcagtgcatgcagcccggttcctccgggatcatctcctttcagactataaatggaagtcagacacggagttgagaatgtatgctttggaaaaggaaaatatcaaattgagaaacagaattgaacaattagaaaggagggctgcttaa

SEQ ID NO: 487 - DNA, 393 bp, B.fragilis
acagtaaaagttatggcagaaaagacaagatattcggatgcggaactggaagaattccgcgccatcattaatgaaaaactggaattagcacaacgtgactatgaacagttaaaactaagtctaatgggactggacggaaacgatacagatgacacgtctcctacatataaggttttggaagaaggagcgaatacgttgtcaaaagaagaaaccacacgtttggcacaacgccagttgaagtttattcaaggcttgcaagctgctttggtacgtatcgagaataagacgtatggcatctgccgcgaaactggaaagttaattcctgcagagcgtctgcgtgctgtgcctcatgctacactgagcatcgaagcaaagaacagtggaaagaaataa

SEQ ID NO: 488 - DNA, 762 bp, B.fragilis
atgagcatattaagtaaaaatagaataaaatatattcgttcgctggaattaaagaaaatcaggaaagaggaaaaagtttttttagcagaaggtccgaagcttgttggtgatgtattaggatatttcccttgtaaactattgatagcaacatctgattggcttgaggaacatcctgcagttcaagcagcagaagtcattgaagtaacttcagaggagctttcccgtaccagtctgttgaagacaccacaacaggtattagcattgtttgaacaacctgaatatgaaatcgatatggaagctatccgcaattctttgtgtttggctttggacaatatacaagatcctggaaatcttggtacgatcattcgtcttgccgattggttcggaattgagcacattttttgttcgcccaacacagttgatgtgttcaatcccaagacaatacaagccacaatgggaggaattgccagagtaaaagtgtattatacagctttaccggacttgatgcattcgttagggaatgtacctgtatatggtactcttttagatggggaaaatatgtatgaacaacccttgtcgaagaatggaattataataatgggcaacgaaggaaatggtatcagccctgagatagagaagctggtaaaccgtaagttatatatccctaactatcctgcagaacgagagacttcagaatcactaaatgttgctattgctactgcaattgtctgtgcagagtttcggcgacaggctgcattgtaa

SEQ ID NO: 489 - DNA, 1032 bp, B.fragilis
caatatgtatttctaccctcggtgaacgatagtaattgtagaaagtacagaaagccggggagtctttataatcagttctttcggtcgtcgcataccctcaagcgatacgagggacttattgtattttatagggtatgtcattttgtatcttctttgtttttatcctatctttgccaccaaactattaaaaaaactaaaatgaaaacttatccggtcgttctttccattgccggctccgactgttcgggcggggcaggcattcaggcagatataaaaacgatttctgctttgggagcatatgcggcatcggtaattactgctgttaccgtgcagaatacaagaggagtaaaagctgtgcatacagttcccgctgagatagtgcagggacagattgaagcggttatggaagatttgcgtccggatgccctgaaaataggtatggtgagtgaaccggcgcttgtgaagattattgccgggtgcctgctaaagtatcctcattgtccgatagtttatgatcccgtcatggtttcaaccagtggacggaagttgatggcaaaagatgcaatacagttgatcaaagaagaactttttccacttacaagcctgatcactcccaatctggatgaaacggaggtactgaccggaaagaaaatcacaacagcagaagagatgaaagaagctgcccggcaactttcagaagagtatcatacagcggtattggtgaaaggaggacatctggagggaaacgaaatgcaggatgtgctgtttaccgatgggaacgcctatatatataaggagaaaaagatagagagccggaatttgcatgggacgggatgcaccctttcttcttcgatcgccacctatctggcattaggacttcctatggaccaggcagttggcaaggcaaagagttatgtaagcaaagctattgatgccggcaaggaaataattatcggacatggcaacggaccgttatgtcacttctggggccctgagaaagcccggatatgggacgataataaggtagaatag

SEQ ID NO: 490 - DNA, 207 bp, B.fragilis
aatatatcttttaaccctagattagtgttgacgggggtcatgcaagtgagattcgttaagaagctatttccactcaagatatttttccgtataatatcaaacgatcttttatattggcttaaagaaataggttggggctgccatattattgggtatctgaaaggtgtaacaacagacgtgcagtttgtaaaaccgttcagattgtag

SEQ ID NO: 491 - DNA, 201 bp, B.fragilis
atattgacttcaaagaaaatgcattgcttcaaaaaggcaatgcattttttatcggtattgcaaaaaaaatataatgtgagcatctttttaatatctgatctgttatatcaacaatataaaaaaagtaactatggactatctatttttctatctattctttttgttcattatatggacatttatcgtaaaaagtatacatga

SEQ ID NO: 492 - DNA, 1242 bp, B.fragilis
atgaacaattcccctcagcctgctgccaaagggttcacaagagccttttatgtcagcaacacagtcgaactgtttgaacgcatggcttactatgctgtgtttatcgttctcactatttacttatctactattttaggttttaatgatttcgaagcaagtatgatttccggtcttttttccggtggattatacttgcttcctatttttaccggagcatatgccgataagattggttttcgtaaatcaatgcttgttgccttttcgttattaactgccggatactttggtttaggagtattgcctacattgcttgaaagtaccgggttggtgagctatggggcaagtacccattttagtggattgacagatagcgttttccgttggttgatagtgccggttttatttataatcatgataggcggctcatttattaagtctgttatttcggcttctgttgccaaggaaacaaccgaggctacccgtgcacgtggatattctattttctacatgatggttaacatcggtgcttttaccggaaaaacagttatcgatcctctccgaaatatgattggtgatcaggcatatatttacataaactatttctccggatttatgactctcattgctttgttggctgttttctttttgtataaatcaactcacaccgtaggagaaggaaaaagtatgcgtgagatcggacaaggtttcttgcgtattgtcaccaattggcgtttattgattctaatacttattatcacgggattttggatggtgcagcaccaactttatgctacgatgccaaagtatgtaattcgtatggcaggtgaaacagccaaacctggctggattgctaatgtaaatccttttgttgtagtatgttgcgttagttttgtaactcgttggatggcaaaacgaagtgccattacctcaatgaatattggtatgtttctgattccggtctctgctctattgatggcatgcggcaatcttttggataatgaagttgtttctggaatgagcaacattacattgatgatgattgtcggtattgtagttcaaggtttggcagaatgttttatatctccccgttatctggaatatttttctctccaggctcccaaaggtgaggaaggtatgtatttagggtttaagtcatcttcattcttttttatcttccattttcggatttggtcttgccggcgttctgctgaccaagtattgtccggatccaactttgtttga

SEQ ID NO: 493 - DNA, 987 bp, B.fragilis
aaaaaatactcttcaatgattagtgatacaaccatacgaaaacttgttgattatatctcactgaatgcctgctctgtcaactcttccggtctttacaacggaaaatcaggaatctctttagcgttatttgaaactgctaaatgtttgcaagatactgaaattgaagataaagctttcagcctattccaagaatctttaataagaaaaacaaatgattatggctttgaaaatggtatgtccggaataggatatgtccttatctatctaataacaaataaattaattgatgccgattttgaagatttgtttggagaccaacgcgaagcaataatcaaacattttgaaaacattgacaagcagccggataagctgttagtttcatataaaattatttattttttatttgtcttggataaattacaaaagcaagatgagagaatatattcaattattgagaaaatatttcaaggactggaactttatttatcacttcagtttttcgattggaaaaatatttattacataaatagtaaagattatgtattacaaatgtatgaggcttatttaaagttggtcgatttttgcaattataaatatttttcaaaatcattgatggatagttacgttacattatatagtgagggaagaattgcgagttcacttgttaggggatattacttaggtagtatcattactaaaaataatatggttggttttaatgatgtaataagagatcatatcagatatggacaaaagaatattaatccggctattctctttttggaccaaaagataaatttaacgggaatcatagaaaacgctgatgaaaatcgtgtaaaaattcagcgtatagaaatggatttgtttgaagaaagtttagaaaggataaaaagaatggttcgtcccaattgtatacatgttggatatcaatatggattggcccgttatcttggcttttgcgcgaataaaaaatttcctttactttaa

SEQ ID NO: 494 - DNA, 312 bp, B.fragilis
atgatggcatcggtttcccgaatattggccaggaacttgtttcccagtccttcacctttgctggcacctttcacaagtccggcgatatctacgatttctactgttgtggggacgatgcggttggggtgtaccagttcagccagtttatttaaacgttcgtcgggcacggtaattacgcctacgttcggttcgattgtacagaaagggaagtttgccgcctgtgctttcgcattggacagacaattaaaaagtgttgacttacctacatttggaagtccgacaataccacattgcaatgccataatattatag

SEQ ID NO: 495 - DNA, 615 bp, B.fragilis
agagttggatcgtattgtggctcttctcacgaaagaaggactttcggcaactgcttcttattgagaattattcttaaacgtatcatttataaaaaagatttggatatgatgaaaccaattgctgtcaaccaacttagtgataatttctttgaaaccatcagtaaagaatggatgttggtaactgccggtaataaagatgcttttaataccatgactgccaactggggtggtatcggatttctgtggaataaaccggttgtttatgttttcattcgtccggaaagatatacgttcggctttatggagaaaaatgattatttcactctttcttttttaggggaggagaataaaagtattcataaaatatgtggttctaagtcgggacgtgaggtggataagatcaaggagaccggattgaaaccgatgattaccgataaaggcaacgttctgttcgaacaaggaaggttgagtctggaatgccggaaattatatactgatgtgttgcggaaagaaaactttctggatccgtctgtgtatgaacaatggtatactacacatggaggtttgcatcatgtgtatgtggcggagattacgagtgcatggataaaagattaa

SEQ ID NO: 496 - DNA, 195 bp, B.fragilis
aatataaatacaaagaaaaacaatacatggagttttgttattgaattcatatttaatattatttataaagattatcaatacttagtttcctctggctcctcgtcctttcgtcaaaccatctctcagccctttagaataccatatcatatcactattgacacccccgatttcactaccggcagaaatgacagctaa

SEQ ID NO: 497 - DNA, 951 bp, B.fragilis
aaagaatggttcgtcccaattgtatacatgttggatatcaatatggattggcccgttatcttggcttttgcgcgaataaaaaatttcctttactttaataacttgataacaatgtgtgagatatctgttgtaatgcctgtctataatgccgaaatgcatataaaagatgcgatagaaagcgtcttagagcaatcttttgtggattttgagtttatcctcatagacgatggttctactgaccgcacgtcttctattattcagtcatataatgataaaagagtacgtcttattcagaacagtcataattttatagagtcattgaaccttggaatagagaattctttaggaaagtatatggctcgtatggatggagatgatataatgcatatcgatagactaaaaattcaatatgcgattatgcaagaatatccggatgtaactgtttgtggaacttggatgaacagtattggaacatattcacaaacgaatggtttattgagtaccttgagtgggttggttgaacaaccactgttaaaatttacaaagggaaatttcttatttcatcccactactatgataaggatggattttttgaaaaagaatgcattaaaatatgagaactgcccttatgccgaagattttaaattttgggtggagatagcaaagtcaggagggagattttatattgacagtcaaccattactctattaccggatatcagacagtcaggtcagtagccaaaaaagtagtgagcaaagagcaacaacagagtctataattaatgaggttttggaatatctgatggaactcaataaaaatgaatatccggaattggcagcagcttatggtgatttatgtaagttgtacgaaaaacaattacttactaaatgtgaagtattaactttatttcaaactttattttcaaagaatgaaaagaagttgaacctataa

SEQ ID NO: 498 - DNA, 627 bp, B.fragilis
cggcatataaccgacaaacgtaattaccaatctaaaataaatcagattatgactaaaagtattaaaggcactcagacagaaaagaatttgctgacatcatttgctggagaatcacaggcaagaatgcgttacacttattttgcaagtgtagctaaaaaagaaggttacgaacagattgcagctatctttacagagactgccgatcaggaaaaagagcatgcaaaacgtatgtttaagttccttgaaggaggtatggttgaaatcactgcaagctatcctgccggtgttatcggtaatactcttcagaatttgcaggctgcagcggcaggcgaacatgaagaatggtctttggattatccgcattttgcagatgttgcagaacaggaaggtttcccaatgatcgctgctatgtatcgcaatatctctattgcagaaaaagggcatgaagaaagataccttgctttcgtaaaaaatatagaagttgcatctgtattcgctaaagaaggcgaagttgtatggcagtgccgtaactgtggttatatcgaagtgggtaaagaagctcctgaggtatgtccggcatgtctgcatccacaagcatacttcgaaatcaagaaagaaaattattaa

SEQ ID NO: 499 - DNA, 2049 bp, B.fragilis
aacacaataaccactctcgatatgaacgaaagcatatctatattgagtatattcctacttgttaatatgacgttgataacttctacttgccatgctcagaatcgttcggattatccttgggaagaggtgatggaaaacttgtctatatccgatgaagaaggagatatacgtaattgggagaatgaattggaggaattaaccgatcttgttaacaaccctgttaatataaactctgccaccaaagagcagttacagcggtttccttttcttaatgatgttcagattgagaatttacttgcgtacatttatattcacggatcgatgcagactgtctatgaacttcagttagtggaggagttggatcggcagactattcaatatctgcttccttttgtctgtgtagagcctgttgataagaaagagtctgttacgttaaagcagattttaaaatatggaaaacatgaagcggtgactcgtatggatgtgcctttgtataagcgtaagggatacgagaaaaattacttgggtcctgctgtttataactcggtgaaatatggatttcactatcgggaaaaggtttatgcaggtatagttgccgagaaagatagtggcgaacctttcggagctttacataataagcagggatacgattactactctttctatctacttcttcatgatataggaatactgaaaactggaattgtaggaaactatcggttgaatttcggtcagggactggtactcggacaaggttctatgtttggaaaaacagcttattcttcgtctttcactttcaggagtacaggtatacgcagacatacttctaccgacgaatataattatttccgtgggagtggcatagctctaaaatggaaacaatggacactttccgtattttattcacatcgttcgttggatggagtgataaaaggcggtgaaattacctcgatttataaaacaggtttacaccgaagcgaaaaggaagctgataaaatgaatcaattgactatgcagatgagcggaggaaatatcagttataccggaaatagttatcaactgggtataaccggtgtttactactgttttaacaggtcttatgaaccggaacttaaagactattcaaaatacaacctacatggtcgttctttttataatctgggtatggattataaatatcgttttcatcgtttttctatacaaggagaagcagctttggggatcagtggtatggcttttatgaatcaggtgctttattctcctttacaagatatccggttgatgttggttcaccgttattattcccatgattattgggctatgtttgctcattcatttagtgaaggaagtagtgttcagaatgaaaacggatggtatctggctgcttctgtaaatcctttcaaccgttggacattttttgtttctgccgatctgttttcttttccctggtggaggtaccggataagtaaggcctcgaaaggagtggatctgctctttcaggcaaattacgttccgtcgaaaacggttgatatgtatgtgaattaccgttataaacaaaaagaacgtgatgtgaccggtacgcagggaaaagtgattctgcccacctatcatcaccggctgcgttatcgattgaactatttacgatgctcttcgttatttctccggacaacagtcgattataatcattttcattcatccggaaaaacggctggacaaggttatcaactgacgcagacggctggatggaaacttccctggttgcctctgacagcagaattgcaaggtagctattttcatacagacgattatgattcacgcatttatatctacgagaaagggttgctgtattctttttatactccatcttttcagggagaaggtattcgcttggctatttattttcgctatgatatgaacaagcattggacagcaattgccaagctcggacaaaccacatattttgatcgtgatgaaataggttccggcaacgacctgatcaggggaaataaaaaaacggatgtacaaatgcagctgcgtctaaagttttag

SEQ ID NO: 500 - DNA, 477 bp, B.fragilis
aattcaacaacaatgaaaaaactgacaagaaaaagtttaaatgaactggcgaaaacaatgccgataattgaagagtcattgcaaatgagctatgtggggggaggaaatggaacatcagccaatccttatacccaagaggaatatgaaagcatggttagtagtggcatatggaatggaggatatgtagaaaattggggatatacttttcctgagatggcagtttcgagttatgatcccaataacttgcctaaaacgggggtggatagctatgatctaatgtatcaaggcgggtttgctatagggtataaggccgggttatcgggatctacattggatgacatagggattggtgcatggagtgctttagctgtcatttctgccggtagtgaaatcgggggtgtcaatagtgatatgatatggtattctaaagggctgagagatggtttgacgaaaggacgaggagccagaggaaactaa

SEQ ID NO: 501 - DNA, 360 bp, B.fragilis
ctttggcggactgtagaaaataaaagtactatggatgatattgtaaaagtcctcgtcattatggctgctttcgcattacctcttatcagacagatcaaaaagagcaaaacagaaagatctgcccaaaaacctttcgtacccattccggatactgaagaaccggaagtcctgaaagtcacgcgaaaataccaaccgttacactcccaatccacttctcagaaagtggaagtaaaaaagaacaaaacagtttctcagaaaatagaaacgactccggccaacgacccggaatttaccattcattcggctgaagaagcccgaaaagccattatctggtccgaaattctaaatagaaaatattga

SEQ ID NO: 502 - DNA, 660 bp, B.fragilis
gttaatgctgcaaggaaaaccattaatataaatttaatcctttatttttgcaaaatgaatatgaggcttaccataggacttttgatgttatctatcgccttattgttttcttccgaatcactggcacaggaaaaaacaaatctcggtggatacctggtacctatgtgtgtgtataatggtgatacaatcccggctttccagattccgaccattcatatattcaagcctttaaaattcagaaacagaaaagagcagatggaatattataaattggtgagaaatgtgaagaaagtgtatcctattgccagagaaattaaccgcaccatcattgaaacttacgaatacttacagaccctgcccaacgaaaaagcccgccaacgtcatatcaaacgggtggaaaaaggattgaaggagcaatatactccacgaatgaaaaagctctcttttgcacaaggcaaactgttgataaagctgatagaccggcaaagccatcaaagttcttatgaactggtaaaagcatttatgggaccttttaaagcaggattctatcaaacatttgccgctcttttcggagccagtttaaaaaaacaatatgaccccgaaggagaagataagttaaccgaacgagtgatactgttggtagaaagcggacaattgtaa

SEQ ID NO: 503 - DNA, 927 bp, B.fragilis
cattgttatttaatacctacacacaaaatgattagtaaacccacaaaatccgatgtaatgcgagagttgagagattatattttcatcactctcggactgataagttatgcattaggctggacagcttttctgattccttatcagatcactacaggtggaacaaccggtatcggtgccatcatctattatgcaacaggtttccccattcaatggtcctacttcatcatcaacgctgtcctgatgacatttgctattaagatactcggtccgaaattcagtataaagacgacatacgccatctttatgctcactttcttcttatggttcttccaactgatcattgtggacgataaaggagctccgcttcagttggtaggagaagggcaggactttatggcttgcatcatcggagccatcatgtgtggtctcggattaggggtggtatttaataataacggcagcacaggtggtaccgatatcattgcagccattgttaataaatataaggacgttactctcggacgaatgatcatgttctgtgatatcattatcatcagttcatgctatttcatctttaacgactggcgcagagtgatattcggtttcgttaccttgtttatcatcggtttcgttctggactatgtagtcaacagcgcccgtcaatcggtacagttctttatcttttcgaaagattatgcaaagattgccgaccgcattacgaaagaaacccatcggggagtgaccgtacttgacggattgggctggtacagccagaataatgtaaaagtattagttgtacttgcctacaaacgtcagtcactcgatattttccgtttagtgaaagatatcgatccgaatgcttttatctcgcagagttcggtaatcggtgtatatggtgaaggattcgaccgcctgaaaataaaataa

SEQ ID NO: 504 - DNA, 228 bp, B.fragilis
gagctgatcgcgctgtctatttttgattgccaggaaaaattagtgtttgcaacccagtcgtacgatcgggcggattcacgcatggagggcgcaaccgaacaagattgcgctaaaaaaagaaccgatgccaataatataaagtatttcataaccggtgtttttataaattttctatccgcttctgtatctcctttattttttcctgtctttgttttattttcattataa

SEQ ID NO: 505 - DNA, 438 bp, B.fragilis
ttcataaatttactaactttccgccaaaaatctgacaaaatgaaccgtatctttcatgctcgcattgtctggtaccaatatttcctgctggttgtattgggtgttaatgcttttggtttcttatggtgtaagaatattatattagctactctgatgatgttgtttctgattgttgttatcgaacagatcatacatactgtttataccgttacggcagacggtctgctgttacttaatcatggccgttttatccgtaagaaaaccattcctattgcagaaattacttctatccggaaagtccattctatgaaattcggaagtttctctgtaaccaactatctattgatagaatatggaaaagggaaatatgcttctgtacttccggtgaaagaaaaggaatttatggaactgattgaaaaaacaagaaacttaatttag

SEQ ID NO: 506 - DNA, 636 bp, B.fragilis
ttttcaaaatatatgctgattcttttgacaggttttaaaccgttatcaacacctatgttaacaagaaaagaattacttttgcaacatactaacagaaacgacatcatcatgcgaaaattgaaaataaccgagctgaaccggataagtatagaagagtttaaagaagctgataaattgcctttagttgtagtgttggacgatatacggagtttgcataatatcggttctgtgtttcgtacggcagatgctttccggattgaatgtatttatctgtgtggaattacggctactcctccccatcccgagatgcataagacagctttgggagccgagtttacagtggattggaagtatgttaataacgcagttgaaacggttgataacctccggagtgaaggatatgtggtatactctgtcgaacaggcggaagggagtatcatgttggatgagttaacactggaccgttcgaagaaatatgctgtagttatgggaaatgaagtaaaaggagtgcagcaggaggttattgaccattcggatggttgtattgagattccccaatatggcacaaaacattcattgaatgtatcggtaacagcaggaattgtgatctgggatttatttaaaaagttgaaatag

SEQ ID NO: 507 - DNA, 1347 bp, B.fragilis
actatgaaataccaggttattattatcggtggagggcctgccggctatacggctgctgaggctgccgggaaagcaggactgagtgtgttgctttttgagaaacaaaatttaggaggtgtttgtctgaacgaagggtgtatcccgacaaaaacgttactctattcggctaaaacctatgatggtgctaaacatgcgtcaaaatatgctgtaacggttccagaggtcttttttgatcttcctaagatcattgctcgtaaatcgaaggtggtacgtaaactggttttaggggtaaaatcgaagttaacgtccaataatgttactattataagtggagaggcaaccattttggacaagaatacggttcgttgcggtgaagaaacttatgaatgtgataacttaattctttgtacaggttccgaaacttttattcctcctatttccgggatcgatagtgtaaactattggacacatcgtgaagcattagacaataaggagttgccggcttcacttgccattgtgggcggtggagtgatcggtatggagtttgcgtcctttttcaatagtctgggtgtgaaggtgaccgttattgagatgatggatgaaattctgggaggcatggataaagagctttccgccctgttgcgtgccgactatgcaaagcggggcattcagttcctgttaagtaccaaagtcgtttcattggcacagacggaagaaggtgctgtggtttcttatgaaaacgccgaaggggcaggaagcgtgattgccgaaaagttattaatgagtgtgggacgtcgtccggtgacaaaaggctttgggcttgagaaccttaacctgcaacggacagaacgtggaagtattgtagtgaacgggcaaatggaaagctcgttacccggagtctatgtttgcggtgatttaaccggattctccttattggcacatactgctgtccgtgaagcagaagtagccgtacatgcaattcttggaaaagaagataggatgagttatgccgctatccccggggtagtttatactaatcctgaaatagccggtgtcgggcagacagaagaatctctgactgcaaaaggcattgcttaccgtgccgtaaaacttcccatggcatattccggacgttttgttgctgagaatgaaggagtgaatggagtatgtaaggtgctgcttggcgaggatgatactattttgggagcacatgttttgggtaatcctgcttctgagattatcacgttggcagggatggctgtagaaatgaaactgaaggcagccgagtggaagaagattgttttcccacatcctacggttgccgagattttccgtgaagcattataa

SEQ ID NO: 508 - DNA, 252 bp, B.fragilis
ggtcaggggtatttccaacaagacgagcctgcattttccgtgttcgatcctgttcttgattatttcaacacccatgtcattcatcgttccggtgccatgcacgctctccccgatggcgagtatccttttaccggaaaagggcagggacttaagatcgccgccgttagcgggcatcacatccgattcccggacggaagccgccgtgccgttattcaaggatgggagttcaaccgcatattttccatcaattaa

SEQ ID NO: 509 - DNA, 249 bp, B.fragilis
tattatagtcttttttatattatcaatcagttgtgtatttctatcaaatggaagagtaatcctgtaaagttgaaaaagagcaattactctgataatattccgttttggggtgcaaagataatcaattttaggctaatgcagtcatctgctttctctttttgtccaaaacggggttgccttttattacctggatcacagacaatgagagagaatttgtgtcactctgccgtcttgaaagaaatttcgtag

SEQ ID NO: 510 - DNA, 957 bp, B.fragilis
caagcaacacataaaatatcaataaatatggaaagtaccaacagacttcgttatcttatcgcaggaaccggaggcgtaggcggaagtatagccggctttctgtcacttgccggaaaagacatcacttgcattgcccgtggagcacatctgcaagcaatacaacaagacgggctcaaattgaaatcagatttgaaaggtgaacatgctctacggataaatgcctgcacggcagaagaatataacggaaaagctgatgtgatatttgtatgtgtcaaagggtattccgtagactctatcacagagcttatcaagcgggcagcccacgaccgaacgattgtaattcccatattgaatgtatacggcacaggaccgcgcatccaacgtctcgtaccgggagtcaccgtactggacggatgtatctacattgtaggctttgtttccggaccgggcgaaatcactcagatgggaaccatctttcgtctggtatatggtgcacaccggggaatccttgttccggcagggctgatggaggccgtacagagggacttgcaggaaagcggcatcaaagtagaaatctctcccgacatcaatcgggataccttcattaaatggtcgtttatttcagccatggcagtcaccggagcttatttcgatgtcccgatgggagaagttcagaaacccggcaaagtgcgcgatacttttatcggactctctaccgagagcgctgctctgggaaagaaactcggaattgaatttaaagaagacatagtcacatacaatctgaaagtaattgataaactggctcccgaaagcacagcatccatgcaaaaagatatagcacgcggacacgaatcagaggtacaaggtctgctctttgacatgataacagcagccgaagagcaaggtatcgatgtgcctacttatcgggaagttgctaaaaaattcatcaaacaataa

SEQ ID NO: 511 - DNA, 600 bp, B.fragilis
aataaactgcatacaatgaaacgtaaacttgttttcgcaaccaataatgcacataagctggaagaagtatctgctatcttaggggataaagtcgagctactcagcctgaatgacatcaattgtcatacagatattccggagacagcagagactcttgaaggcaatgcatacctcaaatcatcttttatttaccggaactacggattaaactgctttgccgatgacacgggactggaagttgaatcactgggaggtgctccgggtatctattcggcccgttatgccggtggagaaggacacaatgcggaagccaacatgttgaaactcctccacgaactggaaggaaaagacaaccgtagagcacagttccgtacagctatttcgctcattctggatgaaaaggagtatctcttcgaaggaatcataaaaggcgaaataatcaaagaaaaaagaggtgattccggattcggatacgatccggtattcgttcctgaaggatacgaccggacctttgccgaattaggtaatgaaattaaaaatcaaatcagtcatcgtgctttggctgtgaacaaactatgtgaatttcttcgttcgatctga

SEQ ID NO: 512 - DNA, 1482 bp, B.fragilis
agatattctaaaacattgaaaacattattatatatattggtattttctttgtgctatacgaatgcatattgtcaaagtataccaagggaagtgacattagatgaagtgataaacagactatctctggaatcatcatcggctaaaatagaattacttaacttccaaaatgacttattgcgatacgagaattataagaaaagctttctccctgcatttgtgctgaattttaatcctatcaattttaacaggtcactgcgattattgcaacaaccgatcgatggaagttattcttatgtagaggacaattcaaataatactaattttggtactactgtacgacagaaaataagcataacaggaggggaactgagtattggaagtaatataaattatttgaatgagttttcacgtaaacaaaacagttttagtacaaatccgttttttataagctattcgcagcagttgtggggaggaggaaaattacaaaggttggaaaacaaaattgaacgtgccaaaaacgaagtggccgtgaaacaatattgttcaaacattgcccagatccagcaacaagcattgacgctttatttatccgccatactgagtaagatggatagtgaacttgctatagatatcaaacagagcaacgacactctgttacatattgcagagataaaattgaggaatggaagtatcactgaatatgattacaagcagatggaattgcagtccttaaacttgcaatacatgtatgaaaatgcggtcaaacactatgcggaatcaatacaaaaactttttacttttttaggaatagaaaataatgccgaaattacaataccggattttgacttacccttaactatcgatgctcggcttgtaatctactatgtgaaaaaaaataatccaatttcaaatcagcaagagattcaacagttggaagaggagaaaaacctgttctctatcaaattgaagaataggttcaatggaaatataagtttaaactatggaataaatcagtatgctgaaacattggccgatgcttaccggcatggaaatacaagacagtccgtgatcattgaatttcaaatacctatttttcagtggggcatcaacaaaaataatatccggatcgcaaagaataattatgatgcaagtcggttgcgaatagaaaaaaaaatgtttgaatttgagaacgaagtaaaagaaaagataaatgcttatgatcatagtgtaaagctttggctgacagcatcaagagcctatgcgttatcgaaagaacagtataagatgttgacgaaaaagttttcattgggaaaagtgtcggtatatgaacttgccaccgcacaaaaagagcggaatgatgctatgcagcgttactactctgccatcaaagattcttacgaaagcttctttacattacgtaatttggctttatatgattttaaaaaaaatgtcgaattagaaaaaatactcttcaatgattag

SEQ ID NO: 513 - DNA, 579 bp, B.fragilis
tttatttataaaccattaataataactgcaatgaaaaaattaacaaagaaaaatttaagcgaactggcgaaaacaatgccggtaattgaagagtccttgcaaatgagctatgttgggggaggaaatggaacatcagccaacccttataccaaagtggaattcgatagtatgcttagtaatgacaactggaacggtggttatgtagagggaatgggatatgtggctcccaatacgtatatttatgggaattcagtatactggggatcggtatcacaagattattatacatttccagattatgtcacttctctttcttcggatggactaaatcaaatggcggaatcattggcaggtgcaataccaggagtgggttcttataccgcttatttatctcaagagttaggtgatatgagtagagagattcaatctgaactgttaaaaaaaggatataatggttcttcttcattcacaattgttcgtacgtatatgggaagttctgttaaattttctgtatataacgcgaataatggagaacttataacttccaaaacgattaatatgttcggattttggcagtaa

SEQ ID NO: 514 - DNA, 1521 bp, B.fragilis
cacgaaaataatactataattatggcattcaaatccatttctgcagcagaagctgccagccttgtcaaacatggctacaacatcggcctcagcggtttcacacccgcaggaacggccaaagcggtcacttccgaaatagcaaaaatagcggaagcggaacacgcaaaaggaaatcctttccaaatcggcatctttaccggagcctctaccggagattcatgtgacggtatattatcacgtgtaaaagccatccgctatcgtgccccttacactaccaaccccgatttccgtaaagctgtgaacaacggtgagattgcctataatgacattcacctttcacaaatggcacaagaggtacgctacggattcatgggaaaagtgaatgtagccattatcgaagcctgcgaagtaactccggacggaaaaatttatctgacggctgccggcggaattgctccgaccgtctgccgcctggccgaccagatcattgtcgaactgaacagtgcacacagcaaaaacatgatgggaatgcatgacgtatacgaaccactcgatccgccttatcgccgtgaaattccgatctataaaccaagtgaccgcatcggactaccttacatacaggtcgatccgaaaaaaattgtaggtatagtagagacaaactggcccgacgaagcccgctcatttgcagcagccgatcctatcaccgataaaatcggtcagaacgtagccgacttcctggctgccgatatgaaacgcggtatcattccttctacattccttccgttacaatcgggagtaggcaacatcgccaatgcagttttgggtgcattgggacgtgaccaaacaattcctgccttcgaaatgtatactgaggttatccagaactctgtgatcggtttgattcgcgaaggacgtgtaaaattcggcagtgcctgttcgctgaccgtaaccaacgattgtctgcagggtatatatgacgatatggactttttccgtgataaactgatcctccgtccgtcagaaatctctaacagccccgaagtagttcgccgtttaggcatcatctctatcaatacagccattgaagcggatatctatggtaatgtaaactctacccacattggcggaaccaaaatgatgaacggtatcggcggttcgggcgactttacacgtaatgcgtacatctctatcttcacttgtccgtcagtggctaaggaaggtaagatcagttctatcgttccgatggtttctcacctggatcatagcgaacactctgtcaacatcgttattaccgaacagggagtagccgatctgcgcggtaagagtccgaaagagagagcacaagcaatcatcgagaattgtgcacacccggattacaaacagattttatgggattacctgaaactggcaggtaataagtcacagactcctcatgccattcaagccgctttaggaatgcacgccgaactggctaaaagcggagacatgaaaaacgtgaactgggcagaatatgaacgatga

SEQ ID NO: 515 - DNA, 447 bp, B.fragilis
agttgttacaatgaggttttatataaaagcattagaaaaactaactcaaaaaaaaatagatctcaatatatgaatattgcatttttaacaacattaaatccggctgatataaataattggtcgggaacgacatttcatttgtttcacgctctaagcagaaagcatcatgtaaaagtgattggacagaatacccttcctcaggcagcgtattttaccaaagataattgtattaaaaaaaatccattagagaactatgtttctgttttcgggaaattatgtaccgaacaattgacgaattatgatcttgtgttttttggagatttatatttagctccttttttggatgtaaatgttccggtcgtgcatcttagtgatgtgacataccactcattccaaagctacttaaaccccctaaagaatgaagaacggtataggaaattggaatga

SEQ ID NO: 516 - DNA, 1374 bp, B.fragilis
agaacaggcaaaaagatgaattcaagaatacaaaagcaggaacaacctatatgttcaccaaaaattattttgcctaatcctaacaaaaaatctgatgtgattgccagatctgaggaagtacaagccattattgaccgtatgcccacctactggacaaaatgggtgatactatgtgtaggggtactgatgggaatgatcatattacttggttttttgatacagtatcccgatacggtagacggacaaatatcagtaaccgcaaatgcagcaccggtacgtttggttgctaacagtaacggacggattacgttgtttcaacccaataaagcattactgcataaaaatgatgtgattagttgtatcgaaagtggtgcggattacaaacatattttatggattgattcttttttgaagacacttaatgacaaaagcacaattcgtgttgcattgcccgatacgctgttgcttggggaagtcagttccgcatacaattcctttttactttcctttttacaatatgagcggttacttacttctgacatttattcaaccatgcgacaaaaattgcaacaacaaattatttctgacgaagcagtcattgccaattttaataatgagctgcgattaaaaaaacaaatattggataactcccaaaaccaattgagtaaggacagtatattgctgtcgatgaaaggaataagcgaacaagaataccagcaaaagttctcgacacatctttctttaaaagaatcacaattaaatttgcaaagtaaccgacagatgaaacaatcggaaataagtcgtaatcaattggaaatacagcgtatctgtttggaagaaactgaggctaaagagaaagcctattccgattatatcactcggaagaatgaactttcaaatgccattaaactctggaaagagcattatttgcaatatgcgcctgtagaaggggagttagaatatcttggtttctggcggaacaatcgttttgtacagtccgggcaggagctattctccatcattcccgataaaactaacatcttgggtgaagtagtgataccttctttcggtgcaggaaaagtagaagttgggcaaacagtaaacgtaaaaatggacaactatccatatgatgaatatggattactgaagggagtggtgaaatctgtttcacgcattaccaacaagataaaaactcaaaatggagacatggatacttatctggtaatcatatcttttcccgatggtacattaactaactttgggaaaatattacccctcgattttgaaacaaaaggtacagttgagattatcaccaaacgaaaacgtttgattgaaagactatttgataatttaaaatcaaaaggagaaaaataa

SEQ ID NO: 517 - DNA, 1824 bp, B.fragilis
ataatattaaatatgaattcaataacaaaactccatgtattgtttttctttgtatttatattctataccgtatcatgtaccgctaaattagagaaacagacatatacgaatgtatatgatttacattttgctatgcggtctgattctgcggtggtttatccgtggcgtgaaaatggagcatatagcaattatactatccctgcttatatacaagattcaaatcgaaatttgttcgctaaaaaatattttaaaggatttcctttttctaagcggttaagatcagagtacgaacagagaattttgcttcccaataataacataaaagaagctgtaatcggatttgaaggtaaaggtgataatataaaacttgtctctatcatcttggatgcgataggtaaacaggaaaacattcttttttctgacaccttaagattcaggcctgacagtatattaagcttggttacccaaaacattaatttgactaatgcggagatgttaaacgtacggattaatgtggaaggagaaattgataagaatgcttatattgctttctctcgattggacatactgattgacggtaaacctatcgacgaatttcctgttcgaaccctttccccgttgatagtagataaaaaaattaactatacgggtataaatgttgatagaaaaataggattggagcaaatcaatgaaatcaatgataaaaagattatcggcttaggggagtcagtccacgggaatgacggtataaaaaatttagcgtatcaattgattatccaggcagtggaaaggttaaattgcaaattagtactgcaggaaatgcccctcgaacaatcatttgcctacaataggtttatacaagatgacaattatgaacttgattcttccttggttatcaaccatgctacaattaattttttaaaaagattgcggagctttaattctggtaaaacgaaagattctaaagttaaattatatggcatggattacaattcaatcctttcttccactcaaagttccgctatggatatttttgattttattaccgggcttaacaaaaaatcgcagattccggaagttgatcaattatccctgctgttaatgaaaaaagatcgtaactgtgcgataaactttcttgatattcatcgagataagataaaaaaacttcttactgctgaagaaatagaatgtatcttgcatattctgagggtttcaaagcaagccggagatggcggaatagaaagattcatacggcgggattccattatgttcgtaaatgcaagattcttaattgacaagttcgccaaagacgaaaacgtaaaaacggtaatctacgggcatgcgggacatattaatcctatttcgagttatcctgccgtaccttgtattcctttcgggaggtatatgcgcaaagcgtatggtgaaagttactctcctttgctatttctgataggaagtggagaagccatggcatatgatgagcattataacaggaaagataattggttgagtagtcctcctgaaaacagtatggaatattttttaagtcttattgatgacaatgttttttacacccccttaactgtcgattttaatgaattaacactgtctcgacttcaggggagtcaccatatcccacaagaattttatccatttaacttatatcaaagatttaaaggtgtgtttttcataaaaagtacggattgtacccataaggatgaaaaagaaatctcttttgagaaagcttctgataggcttataatgaaaataaaacaaagacaggaaaaaataaaggagatacagaagcggatagaaaatttataa

SEQ ID NO: 518 - DNA, 255 bp, B.fragilis
atgaagataaaaaaatattgccgttacattcacttatggctttcactaccggcagggatcctgatcagcatcatttgttttacaggcgccatccttgtattcaaagaagagcttctgacaataatgggatatgattccatccgggaaagtcctttgatgatcgtgatgaagctccaccggtgggttaaggatgataaccgtccgccaggtaaaatgattgtaagtatttttacctttttttcatctttatcctga

SEQ ID NO: 519 - DNA, 315 bp, B.fragilis
aacatcaaaaaaggcagaagaaggttaatgttcgattaccactctgtactgggattatatgcagcacttatcttattagtatgtgcactcaccggattgatgtggtcatttcaatggtacagagacatcgtaagttttatctttgatgcggaagtaaaacgcggagcacctatctggaaaatagtacgtgctttacattttggcacctatgcgggaatgttttcaaagatcgtcacttttatcgctgccctgataggaacttcattacctgtcacaggatattggatgtatctgaaaagaaaaaaattactatag

SEQ ID NO: 520 - DNA, 1617 bp, B.fragilis
tttatgaaaaacaattgtctgatatgttccttattgtttgcttcgggaattcagaatgcttggggaactcaaataacagaccgtaaagcgaatcctgatcaagcgaaacccaatataattctgattatgtgtgatgatatggggttttctgatttatcgtgttatggcggagaagtacacacaccacatattgattttctggcggaaaacgggatacgtttcagtcaatttaaaaatacgggacgcagttgccccagccgggcggctttgctgacaggtagatatcaacacgaagtaggtatgggctggatgactgctgtggatgaacatcgtccgggatacagaggacagatatcggaccggtatcctacaatcgcagaggtatttcgtgaaaatgggtaccacacttatatgagcggtaaatggcatgttaccgttgaaggagcatttacccaacctaatggaagctatccggttgaacggggatttgagaaatattacggttgcctttcgggagggggcaactattatactcccaaaccggtattttcgggtttgcagcgcattacggagtttccgaaagactattattataccacagccataaccgattctgccgttagttttatccgtcaacatccggttgatgaacctatgtttatgtatttggctcactatgctcctcatctgccccttcaggctccaaaagagagagtagaggcttgtcgggaaaagtataaagcgggatatgacgtattgcgtaaacaacgcttcgaacgcatccgtcgcaatggcttaatcgacattgaaagagaacttccggtatttgaaaaagagtttggaggaaaacgtcccgcatggaatagtcttactccgcagcagcaggaacgatggattacggaaatggctacttatgctgccatgattgaaattatggacgatggtatcggagaagtaataaaagccactaaggaaaaaggtatatttgataataccatatttttattcttaagtgataacggtgctaccaatgaaggcgatatgatcacgcaattgcgtgcagatttgagtaatactccatttcgcagttataagcaatggtgttttcagggaggtacgagtgctcctctgattatcatgtacggaggcggacaacctgatggaaaaaaggaagcggttcgtcacgaatttacacatattatcgatctttttcccacttgcctggatatggcttctattgaatatccccgggaatttcgaaatcatgccattgatgctcctggaggcagaacgattcttccggcgttgaaaggaaagaaattatcgaaaagagatttgttttttgaacatcaaacctcctgtggcattatatctggagactggaagttggttcgggctaatggtaagcagccgtgggagctgtttaacctgttacaagatccgtttgaacagaacgatttatctgcccgttacccggatagagtgaaaacattggaaaaaaagtggaatcaatgggcagaaaaacaacaggtatttccttttgaatacagaccatggactaagcgtatcaattattataaatccctgtatcccgatcaatccggaaaggatttatga

SEQ ID NO: 521 - DNA, 1017 bp, B.fragilis
aagaagagaaaaaataagaatataatgaatcgagaagaatgggtgaataagggattcgttgacgagcccgtagacaaaagcattgatctgaaagcagccatcaatgaactgaaaaaagaaaagaatgcagtaatcttgggacactattaccagaaaggcgaaatacaggatattgccgactacattggggacagtctggctttggctcaaattgcagccaaaaccgatgcggatattcttgtgatgtgtggcgttcattttatgggagaaaccgcaaaggtgctttgtccggacaagaaggtgctggtgcccgacttgaatgcaggatgttcgttggcagacagctgtccggcagataagtttgctgagtttgtgaaagcacatccgggatatacggtgatctcgtatgtgaatacaacggcagctgtgaaagcggtgacagatgtagtagtgacttcgactaatgcaaaacagatcgttgaaagtttcccgaaagatgaaaagattattttcggcccggatcgtaacctgggaaattatatcaattcgattacaggacgtgaaatgctgttgtgggacggagcttgccatgtgcatgaacagttttcggtggagaagattgtagaactgaaagcacaatatcccgatgcggtagtattggcgcatcccgaatgtaagagtgtggtattaaagttggccgatatggtgggatctacagcggctttattaaaatatgcagtgaacagtgacaagcaacggttcattgtggccacggaggcaggtatcttacacgagatgcagaaaaaatgccctcaaaaaacattcattccggctcctcctaacgatagtacctgtggatgcaatgaatgtaacttcatgcggctgaacacgctggaaaagctctataattgccttaaatacgaattcccggaagtaactgttgacccggaagttgccagagaggcggtaaagccgattaaacggatgctggagatttcagctaagttaggcttataa

SEQ ID NO: 522 - DNA, 1425 bp, B.fragilis
aacactatgaagaacaaattatttattttatttgcattttgtatttcagtccatgtttatgctcaacagccctccagggagatacctttaaaatatggagctaccaatattggcaaacgtcaggatgatgctatgaagcggtttcgcaacaatcgcttgggagagtttattcattggggactgtatgctattcccggtggcgaatggaaaggtaaagtatataatggggctgccgaatggctgaaatcatgggctaaagtccctgctgccgattggctggaattgatgaaacaatggaatcctgttaagttcgatgccagacaatgggcccggatggccaaagagatgggagtgaaatacgttaagattacgacaaaacatcatgaaggtttctgtctctggcccagtcaatacagtcagtataccgtagcgcagacgccttatagaaaagatatcttaggtgaattggtgaaagcctacaatgatgaaggtatcgatgtacatttctatttttcggtgatggattggagtcatccggattatcgttatgagattacatcgaaagaagacagcattgctttcagccgttttctgacttttaccgaccatcagttgaaggaactggctacccgttatccgacagtcaaagatttctggtttgacggaacttgggatgcaagtatcaagaagaacggttggtggacagctcatgccgaacaaatgctgaaagaacttgtaccgggagttaccgttaatagccggcttcgtgccgatgattatggtaagaggcactttgacagtaatggccgtcttatgggagattatgagtcgggatatgaacggcgtcttcccgatccggtaaaagacttacaagtgactaagtgggactgggaggcttgtatgactgttcctgaaaatcagtggggatatcacaaagattggtcgttgagctatgttaaaaccccgatagaggtgatcgatcgcattgtccatgcggtgtcgatgggaggaaatatggtagtgaatttcggtcctcagcccgatggagatttccgttcggaagagaaagagttggcgatggcattggggtgctggatgaagaggtatggtgaatgtatatatggatgcgactatgccggatgggataagcaggactggggatactatacccgtaaggggcaagaggtatacatggttgtatttaatcgcccctattcggggcttcttaaagtaaagatccccaaaggtaccgaaatagaaagagccgttttgccggatggacaggtggtaaaggtaactgaaactgcccggaatgaatataatgtggccatgccttcgcaagatccgggtgagccgtttataatcaaactacaagttaaggaggcttccggagcagcagacggatatcgggacgcattaacgtaa

SEQ ID NO: 523 - DNA, 915 bp, B.fragilis
cagcagccgaagagcaaggtatcgatgtgcctacttatcgggaagttgctaaaaaattcatcaaacaataaagaaatcaatatgaacaaccttcttttatctatcaactggaacccaaatccggaattatttaatcttttcggcatctcaatccgttattacggactattgtgggctatcggaatattctttgcttacatagtggtacactatcaatatcgtgataagaagatagacgaaaagaagttcgaaccgcttttcttttactgttttttcggcatcctgatcggggcacgactgggacattgcctgttctatgatccgggatattacctaaatcatttttgggaaatgatacttccggttaaatttcttccgggaggtggatggaagttcacgggttatgaaggactggccagtcatggaggtaccctcgggctgatcatttctctctggctctattgccgcaaaacgaaaatgaattatatggatgtggtagatatgattgccgtagccactcctattacggcatgtttcattcgccttgccaatctgatgaattccgaaatcataggtaaggtaaccgatgtatcctgggcattcgttttcgaacgggtagacatgcaaccacggcatccggcacaactttatgaagcaatcgcctattttatcctcttcctggtaatgatgttcctctataagaactatagcaaaaaactacatcgggggttcttcttcggactttgcctgacagctatcttcactttccgcttctttgtagaattcctgaaagaaaatcaggtggatttcgaaaatagcatggcactgaacatgggtcaatggttaagcatcccgttcgtaattatcggcatttactttatgtttttctacggaaagaaaaagagtgtaaaatga

SEQ ID NO: 524 - DNA, 735 bp, B.fragilis
catggcactgaacatgggtcaatggttaagcatcccgttcgtaattatcggcatttactttatgtttttctacggaaagaaaaagagtgtaaaatgaaacatataattgatattaaaacctgggaaagaaaagaaaattatgaatttttccttggtttccagaatcccactatctccattacttcagaagtagaatgttcgggtgctagaacacgtgccaaaaccgccggagaatccttcttcctgcactacctttatgccgtgttgcgtgctgtcaatgaaatcaaagagttccgattccgcattgattctgaaggacgggtagtttatttcgatacagtggatatgctgactcccattaaagtggcagataacggacgtttttttacagtacgacttccctggtatcctgattttaagactttctacacagaagccaaagccatcattagcggaatagatccggataaagatccttatgaagcagaaaagacaggaggtagtgatttactggatgtagtgctcctcagcgctactcccgatttatatttcacctcactgacttgtacgcaggaacatcgtcacggtggtaattacccgttaatgaatgcgggtaaagccgttataagaggtggtgtattagtgatgcccatcgctatgaccattcatcatggatttatagacggacatcacttatctctgttttataaaaaggtggaagagtttcttaaataa

SEQ ID NO: 525 - DNA, 1884 bp, B.fragilis
gcttataatgaaaataaaacaaagacaggaaaaaataaaggagatacagaagcggatagaaaatttataaaaacaccggttatgaaatactttatattattggcatcggttctttttttagcgcaatcttgttcggttgcgccctccatgcgtgaatccgcccgatcgtacgactgggttgcaaacactaatttttcctggcaatcaaaaatagacagcgcgatcagctcttatccgcttttattgcatccgtcatatgaagctaaagggagcgtggggttcacggtaccggttttttatcgtatggataaaaagcgggtgggtgttgaagtgaggataaagtataaaacggaaaactgcaatgatctgtgtttgaagctgagcggcattggtgaatgcgggaaggtcatttccgcggacacgtttcgattgtctgccgccgaggcgtggacggtagcccgccggagcgtggatatggcttctcccctgttgctgggggtggctcttgaagcccgcggggagaagcccgggaaaaaggattttccggccgatcctttaggatgggagaataattcctttaagcccggggaatactctaaaatatggattgactccttggatatcttaattgatggaaaatatgcggttgaactcccatccttgaataacggcacggcggcttccgtccgggaatcggatgtgatgcccgctaacggcggcgatcttaagtccctgcccttttccggtaaaaggatactcgccatcggggagagcgtgcatggcaccggaacgatgaatgacatgggtgttgaaataatcaagaacaggatcgaacacggaaaatgcaggctcgtcttgttggaaatacccctgaccttatctttccatatcaaccggtatttggagggggacgagcggttcaagccggacagcatcgcttcctattttgacaaggtcttattttcttcttcatccttcgtgtctcttatgcggtgggtcaaagaatacaaccggcatttggaagaaaaggtgagcttctttggcattgaccggaatatttaccgcttacaaagcagtatcgacctgttttacttcttttacacgctccgcagaggtaaaggcgacgaaggcttgaaagcgatatgcgagtctcttctgttgtcggacgagaagttcccttttaaaggggcggactctgtgttgcatgccaatcatggcttcaagggcatacttacccggcgggaagcggaaataatgagctactgcctgaattcggaggaggaagcgaccgctgatgaactgaatcgttttcggggcagggattccggcatgtacgagaatgcgaagttcttaatgaaaacaatgcttaaaaaagatgaaacgactaccgtatattgtcatttggggcatgcgaattatacaagtatcgctggatggctgagaccggacatgcgacctttcggagaatacatgaagggttcatacggtgatgactactccgccgtgggactgcttgccggagggggaagttatctgacatgggtatttcccggtaaaatgggaataaggcgattgcagtcttcgtcgtctgctggattagaatactgtatcgaacgttcgggtatcagtccgtgttatttgccgatggataaactgtccgatgcggatgttttgaaaatgagatatataggaaatacagaatcgaaaattggacaattccagtgggtttttccaaaatgtatgatggacggagtgctgttcacaaaaaacgcgtccgccacaaataagagggaagagttttttaaaatgaacttagactatcatgtccaaactttatttgctcttatgtatttgtatgaaaagaaaagaaaatggattccatga

SEQ ID NO: 526 - DNA, 1125 bp, B.fragilis
tataaaaaagactataatattatggcattgcaatgtggtattgtcggacttccaaatgtaggtaagtcaacactttttaattgtctgtccaatgcgaaagcacaggcggcaaacttccctttctgtacaatcgaaccgaacgtaggcgtaattaccgtgcccgacgaacgtttaaataaactggctgaactggtacaccccaaccgcatcgtccccacaacagtagaaatcgtagatatcgccggacttgtgaaaggtgccagcaaaggtgaaggactgggaaacaagttcctggccaatattcgggaaaccgatgccatcattcacgtactccgttgcttcgacgatgacaatgtaacccatgtggacggaagtgtaaatccggttcgcgacaaggaaatcatcgattacgaattacagttaaaagacctggaaaccatcgagagccgtatccagaaagtacaaaaacaagctcagaccggaggagataaagccgccaaacaagcttatgatgtacttgttcaattcaaggatgcgttggaacagggcaaatcggcgcgtacggtaacgttcgaaacaaaagacgaacagaaaatagcgaaagaattgttcttactcaccagtaaacccgtaatgtatgtttgcaatgtggacgaagcaagtgcggtaaatggaaacaaatacgtagacatggtacgtgaggcagtaaaggacgaagacgccgaaatcctggtagtagccggaaaaacagaagctgacatcgccgaactggaaacctacgaagaccgtcagatgtttcttgccgaaatcggcctggaagaatcgggtgtggcacgtctcattaaatcggcctacaaactgttgaacctggagacttatttcactgccggtgtacaggaagtacgtgcctggacctacgaaaaaggatggaaagctccacaatgtgccggagtgatccataccgactttgagaaaggttttatccgtgccgaagttatcaaatacgaagacttccttcaatatggctcggaggctgctgtcaaagaagccggaaaattgggtgttgaaggaaaagaatacgtagtacaggatggagatatcatgcatttccgtttcaatgtataa

SEQ ID NO: 527 - DNA, 2208 bp, B.fragilis
aatcaaaaggagaaaaataagaatatgctactccaccgttttcccgtagaataccaaatggattcgcaagactgcggacctgcatcccttaaaattattgctaagcattttggtaagttttactcattgcagttcatgcgtgaccgttgcggcattaccaaagaaggtgtatcgttacttgatctaagtaccggggcagaaagcatcgggctgcgaacgcttgccataaaatgtaccattgatgatgtggtgaacagcattccgtttcctgcaattgtgttttggaatgacagtcatttcatcgtggtatatcattctgataggaaatacatatgggtctcggatccagcaaaaggacgcataaaatacacgcatgaagaatttcgaaagggttggtatcaaagggatgaaagccaaggtgtattacttgccgtggaaccaactactgattttaagaatagtaaagctgaacaagaacagaagagaaacagcttttcgagcattcttaaatatttttttccatataaaaagagcttcgggttaatatttattattatgctcgttgttactgtcttacaaggtatgttaccatttatctctaaagcggtgattgatgtcggcattaaaacttcggacaggaactttattaatatggtactgatagggaacatctgtatcttgttgagtgtaatgattttcaatgtgttgagggattggatcttattgcatatcacggcgcgagtaaatattgctttgatttctgactacttgataaaattgatgaaactacctgttactttctttgagaataagctgctgggcgatattttgcaacgggcacaagatcatgaacgtatacgcagtttcattatgaataattctttggcattgatattttcaacgcttacatttgccgtctttagtattattttattgatttacaatactataattttctatatatttttatcaggatcggttctgtacgcttgttgggtgttactgtttttgagcatacgtaaaaaactggattgggaatattttgaacttttgtccaaaaaccaaagctattgggtggaaaccgtttcgactatacaggatatcaaaatctacaattatgacaagtaccggcggtggaaatgggaagaaattcaggcacggctttatcatgtcaataagcgtgttcttgccataaccaatgctcaaaatctgggtgcccaatttatagaaaatatcaaaaatatggctatcgtgtttttctgtgctatggcggttatcaagggtgaaataacatttggaataatgatttctacacaatttattattggtatgctcaatggtccgcttgtgcaatttattaattttgtggtatcagcgcaatatgccaaaatcagtttcttacgcatcaacgagattcgtcagttggaaaatgaggatgaattactttctattggcagtacaaccatccttccggaaagaaaaacgattctattagagaatatacattttcaatacacgcctaactctcctttggttctgcgtaatatttacttacaaataccggaaaataaaatcacggcaattgtgggaggaagtggtagtggtaagtcaactcttctgaaactattggttcggctttataagcccagccatggagaaataaaaatggacaagatgaatgtaagtgccattaatctacgccaatggagaaacatgtgtggggtggtaatgcaagatggaaaaatattcagtgataccatcttgaataatattgtattagatgatgaacaaattaattatacgcgtttgagggaagtttgtcgtatcgctcagattgaggatgagataaacgcgatgcctaagggttttgaaacgaccattggagaaaccggacgcgggttgagtggaggacaaaagcagcgtttgttgattgctcgtgcgctgtatcgggatccgaaatttctctttatggacgaagccacaaactctttggattcaataaatgaacgaaaaattgtgaatgccttgaacaatgcatttgaacagcgtactgttgttgttattgctcacaggcttagtaccattcgtaatgctgatcaaattgtggtgttggacaaaggttttatcgttgagaccggaactcatgaaatattgatggagaaaaaggggcattattttgagttggtttcttcacagatacaagattaa

SEQ ID NO: 528 - DNA, 1194 bp, B.fragilis
  unsure (130): Identity of nucleotide sequences at the above locations are unknown.
ctaccattactgcgcttggcccggccggacgcagatgaaccttttcgtactgaagtgtggtataaaggtacaatagaacatgatacacttcgaggagatatctatgtggttggcggattcgatccggagnttgatgatgaaagaatgaatgcattggtagaagaggtgattactttccctttctcggtattgaaagggaatatctacggagatatatcgatgaaagattctctctattggggaagcggttgggcatgggatgatactccctcctcttttcaaccttatctatcaccattaatgtatcataaaggcatggtgaaagtgacagctgttccgggggcgacacgaggtgactcggcacgtttaagctttgagccgtcatcgtcttattatactatgaccaatgaaactaaaacacgtacatcctctgccggtaagttttctgtgtcaagaggttggttggaaaataaaaataatcttattgtcagtggaaatgtagagaatagaagaataggtgatgtaaatgtatattcttcgcaggactttttcatgcatacttttgtcgaacgtttacgtaataaaggtatagagatttccaatcattatgctttcgacagtttccggtctgacagtctttctatctgtatggcacgttgggagtgcccggttcaggatgtgatagaccagattatgaaagagagtgataatttgagtgcggaagcactgctttgccgtttaggtgcccgggccacaggtaagaagcaggtttcggctaaggacggaattgaggaaatatatcggttgattcaggatttgggacatgatccggataactataagatagctgatggttgtggattgtccaactacgactacctctctcctgccctactggttgattttctgaagtttgcttattcgcggacagatattttccggaaattatataaggcccttccggttgcaggcatcgatggaacattaaaaaatcggatgaaacaaggggcggcgtttaagaatgtacatgccaagaccggttcttatactgctatcaatacattagccggttatcttaagatggctaatggacaccaagtggcttttgccataatgaaccagaatatactttcagccgctaaagcaaggaattttcaaaataaagtatgtgagatactggcaaaccatcaatga

SEQ ID NO: 529 - DNA, 1584 bp, B.fragilis
acactaaaacttatggttaaaaagttcgatttcctcgtaatcggttctggtatcgccggaatgagttttgccctaaaagtggcacataaaggaaaagttgcccttgtttgcaaaagcgggctggaagaagcaaacacttattttgcccaaggaggagtggcctcagtgaccaatctgctggtagacaattttgaaaaacatattgaagatacaatgattgccggtgactggatcagtgaccgtaccgctgtagaaaaagtcgtacgtgaagctcccgcacagatacaagaactgatcagttggggtgtaaacttcgataaaaacgaaaaaggagagttcgatcttcaccgggaaggaggtcattcggagtttcgtatcctgcaccataaagataataccggcgccgaaattcaggatagcctgattcgagccgtacaacaacatccgaatataacggttattgaaaatcattttgccatcgaaatcctgacacaacaccatttaggagtaaccgtcacccgtcagacaccggacatcaaatgttatggagcctacatactcgatccgaaaacagggaaagtggatacttatctggccaaagtgacattaatggcaacaggtggagtaggggctgtctaccagactacaaccaacccgcttgtagcaaccggcgacggcattgccatggtatatcgggcaaaaggaaccgtaaaagatatggaattcgtacaattccacccgacagcgctttaccatccgggcgatcgtccttctttcctcattaccgaggcgatgaggggatacggtggtgtacttcgtaccatggacgggaaagagttcatgcagaaatatgatccccgtttgtctctggcaccgcgcgatatcgtagcgcgtgctatcgataatgaaatgaaaaaccgtggagacgaccacgtctacctcgacgtaactcataaagatccggaagagactaaaaaacacttccccaatatatacgagaagtgcctgagcctgggaatcgatattaccagagaatatatccctgtagcaccatcggctcattacctttgcggaggtattaaagtggatttgaatggccaatcttctatcgagcggctatacgctgccggcgaatgttcgtgtacaggtttgcatggtggcaaccggttggcttcaaactcactgatagaagcagtggtttatgcagatgctgctgccagacattgtttatcggttatcgaccaatatacttataacgaagaaattccggaatggaatgacgaaggtacccgctcaccggaagaaatggtacttattactcaaagcatgaaagaagtcaatcagatcatgagtacctatgtaggtatcgtccgcagcgatctccggttgaaacgtgcatgggatcgtctggatatcttatatgaagagaccgaaagccttttcaagcgtagcgtagcatctaaagaaatatgtgagctgcgtaatatgatcaatgtaggttatctgattatgcgtatggccatggaacgtaaagagagccgcggtcttcactacacggtcgattatccgcatgccggtaaatag

SEQ ID NO: 530 - DNA, 786 bp, B.fragilis
acagaattaagtatgactattatttttccttctcctatattcggaccggttcattcacgtcggttaggggtctcacttggaataaatttgcttccttcggacggaaaagtatgttctttcgattgcatttattgtgaatgtggttacaatggtgaacatcgtcctaaatcttcattaccgacccgtgaagaagtccgtatggctctggaagagaaattaaaagagatgaaaagcaacggacctgctcccgacgtactgactttcgccggaaacggtgagccgactgctcatcctcactttccggagattatcgaggatacacttgctttgcgtgatgcttactttccggatgcaaaggtgagtgtgctcagtaatgctacttttattaaccgtccggctgtattcgatgcgttgaacagggtggataataacattttaaagttggacacggtggatgaagagtatatccggactgtagatcgtccgaacggacgatacgatctgaatggaacagtcggacttttaaaagcttttaaaggtaattgcatcgtgcagactatgtttatgaaaggaaaatataaggggaaagatgtggataatacttctgacaagtatgtacttccctggttgaaagttgtaaaggatattgccccaagacaggtgatgatttatacgatcgatcgggaaactcccgatcaggacttgcaaaaagctactcatgaagagttggatcgtattgtggctcttctcacgaaagaaggactttcggcaactgcttcttattga

SEQ ID NO: 531 - DNA, 2679 bp, B.fragilis
gtagatttgagggaaaccgctatctttgccttgttatttatgaacttaaaaagaagactatccgtgagcaatgatattgaattaaccccgatgatgaaacagtttcttgacctgaaggctaagcatccggatgcagtgatgctgttccggtgcggagacttctatgaaacttattctaccgatgcgattattgcagctgaaatattaggaattactctcacaaaacgtgccaatggaaaaggtaaaaccgttgagatggcgggatttccgcatcatgcgttagatacatacctgccgaaattgatccgtgcaggtaagcgggtggccatatgtgaccagcttgaagatcctaagacaacgaagaaattggtgaagcgtggcattacggagttagttactccgggtgtttcgatcaatgataatgtcttaaattataaggaaaataactttctggcagctgttcattttggaaaatcggcttgtggtattgcatttctggatatttctaccggagagttcctgacggctgaaggaccttttgactatgtagataagctgctgaataattttgctccgaaagagattcttttcgaacgtgggaaacgcggaatgtttgagggaaatttcggaagtaagttctttacttttgaactggatgattgggtatttaccgaatccagttcccgggagaagttgctgaagcattttgaaacaaagaatctgaaaggattcggggttgagcatctcaagaatggtattatagcttccggagctatcctgcaatatctggatatgacggaacatacacaggtaggacatatcacttcgctggcacgtatcgaggaagacaaatatgtgcgtcttgataaatttacagtgcgtagcctggagttgatcggtagcatgaacgatggtggcagcagtttgcttcatgttattgacaagactatcagtcctatgggagcccgtctgttgaagcgttggatggtatttcctttaaaagatgagaaacccattaatgaccggctgaatgtagtagaatacttctttcgtaaaccggatttcagggagttgattgaagacgaactgcatcggatcggagatttggaacgtatcatttcaaaagtagccgtcgggcgtgtttctcctcgtgaggtagtacagttaaaagttgctttacaagcaattgaacctattaaagaggcttgtcaacaggccgataatccgagtttgaaccgaatcggtgagcagttgaatctttgtatttctattcgtgaccggattgaaaaagagattaataatgatcctcctctgttgataaataaggggggagtcataaaagatggtgtagatacggaattggatgagcttcggcagattgcttattctggcaaagattatctgcttaagatacagcaacgtgaaagtgaactgacaggaatacctagtttgaagattgcttataacagtgttttcggatactatattgaagtgcggaatgtgcataaagataaagtgccgcaagagtggatacgtaagcagacgttggtaaatgcggagcgttatatcactcaggaactgaaagaatatgaagagaaaattctgggtgccgaagacaagatcctggtattggagactcgcctgtatacagaacttgtacaggcattgagtgaatttatacctgccatccagatcaatgctaaccagatagcccgcattgactgcctgctttcatttgccaatgtagccaaagagaacaattatatccgcccggtgattgaagataatgatgtattggatattcgtcaggggcggcatccggtaattgaaaagcaactgcctatcggagaaaaatatatagctaacgatgtgttgttggataacgctacccagcaggttatcattattaccggtccgaatatggccggtaagtcggccctgttaaggcagactgcattgatcaccctgcttgcccagattggttcgttcgttccggccgaaagcgctcatatcggattggtagataagatttttactcgggtcggtgccagtgacaatatctctgtaggagaatctacttttatggtcgagatgaatgaagcgtctgatattctgaataatatttcttcccgaagccttgtcctgttcgatgaattgggacgcggaacttctacttacgacggaatatccatagcttgggctattgtagagtatatccacgagcatccgaaggcaaaggcacgtacactttttgctactcactaccatgaactgaacgaaatggagaaatcctttaagcgtattaagaattataacgtatcggttaaggaggtggataataaagttattttcctccggaaacttgaaaggggcggaagtgagcactcgttcggtatccatgtggccaagatggcaggcatgcctaaaagtattgtgaaacgtgccaatgaaattctgaagcaactcgaatctgacaaccgccagcagggaatttcgggtaagccgctggcagaagtcagtgagaatcgcggaggtatgcagttgagtttctttcagcttgatgacccgatcttgtgtcagatccgggatgaaatacttcatctggatgtgaataatcttactccgattgaggcattaaacaaactgaatgatatcaaaaagatagtcaggggaaaataa

SEQ ID NO: 532 - DNA, 1800 bp, B.fragilis
gttgttaatattgacaataaccttgtttattttatgaaaacaaaattgccgttattactattatttttcgtattgtttttattcaaatgtgatttaaaagctgatcccggccataaaagccctttagaatataggtgggttaatcatccgctggatttctatctgaatgtgaccgtagacagtaccactactccccattcattgttatttgaaacaatgtatgaaaaaaaaggaattgcaagctttttactacctatctatcaactggagaagaatagccttacttttgagattaagatcagatataaaacggaaaattgcgagaatctattcttggcaattacctctgtcggcgattgtgagaacataaattccattgataccattcaactgaacgcaacccaagattggaaggagtgtacgcggattttgaaaacaaagaaagcatattttttaaatatatctgttggggctgtcggctacggccaacgcaagggcaagatatggatttctgatttagaggtgctgggtgatggaaaagcaatcggggacaacccccaacaggaatataaaaaagaagatattcatttgaaagcaaccgatctgattcattggaataacaaagagtatgacaaccttcctttcttaaataagaaaatacttgggcttggagaaacggcgcatggcacagaaacgatgaacgacatcggcattgaaatttcaaaggaacggattctgaaacaccaatgtcggtttattttgctcgaaattccgttggaattttccctttacatcaatagatacgtgcaaaatgacaaaaattttaaatttgaatatatttcagaacgttttgaaccatacctgttttccgactccatcttatcctttatccggtggattaaagaatataattcggcgcataatcaaaaaatctctattttgggatttgatttaaataccacaccactattgagcagagcagatttatttaattttttctataacctgaagtcgggcgggcatgtcgaagaaattgataccatttgtgaatctttactggacagcaaaacctcttttgagaaaattatttctaagttcgacaaaagcatccgtttagcagattgtttggataaaggcgaattgaaattgatacaccgatgcctggagataacaggacggagttcaagcagctatttccgatttgttgaaagggatagatatatgaatgatatcgtaacattcattattgaccattttctcaataccaatgaaaccgtcactctctttggacatttggggcatctcaactacaaaggcaatagagtagagctaatggattatttttccttaggatattacctgaagagcagatatgcaaagaattattcatgtattggattgatcactaaccgaggcactgcaatgcttccggtatctgctacaaacggtggagtaacaaagttggaacaggcaccgcagggaagtttggaatttcaagtaaacaaattgaaaatggactcggtttatttgtcaatgagcaagtttacttgttcggatgtattcctattaagagagttaggttccggtttttcccaaaataagaaaatcattccgaatcaattccagtatatgatcccgaagtcaagaatggaaggcgttatttttacaaaagaatcagtcaatttcatgaaagggaaagaatttttcaaaaaaaatatgaacgttgaagttgttacaatgaggttttatataaaagcattagaaaaactaactcaaaaaaaaatagatctcaatatatga

SEQ ID NO: 533 - DNA, 1413 bp, B.fragilis
agcagtatctttgcggacgcaaatttaaattctgaatttatgaacgaattgacgggagcggactttaaatccgcaactgctgatgacaacaagaagttgtttatcgagacttatggctgccaaatgaatgtggcagatagtgaagtaatcgcctctgtgatgcaaatggcgggttattcggttgccgaaacgctggaagaggctgatgcggtgtttatgaatacctgttctatccgtgacaatgccgaacagaagattttgaatcgtctggagttctttcattcgatgaagaagaaaaagaagcaccttattgtaggtgtattggggtgtatggccgagcgggtaaaagatgatctgatagaacaccatcatgtggaccttgtagtaggaccggatgcttatctgactcttcctgagttgattgcttcggtagaggccggtgagaaggcaatgaatgtagaactttcgactactgaaacctaccgggatgtgattccttcgcgtatctgtggtaaccatatctccggatttgtatccatcatgcgcggatgcaataacttttgtacctattgtattgtgccttatacccgtggacgtgaacgtagccgggatgtggagagtatattgaatgaagtggccgatttggtatcaaaaggttacaaagagatcactctgctggggcagaatgtaaactcttatcgttttgagaaggaggggggggaagtagttactttcccaatgttacttcgtctggtggctgaggctgcaccgggaatacgtgtccgtttcaccacttcgcatcccaaagatatgagtgatgaaaccttggaggtgattgcacaggttcctaacgtatgcaaacacattcaccttcccgtacaaagcggaagttcgcgtatcctgaaattgatgaatcgcaaatatacgcgtgaatggtatctggaccgggtagcggcgatcaaacgtattgtgcccgattgcggacttactaccgatatattttccggcttccattccgaaacggaagaagaccatcgggaatcactttcgttgatggaagcttgtggttatgatgcagcatttatgtttaaatattcggagcgtcccggtacttatgcttccaagcatctggaagacaacgtttccgaagagataaaagtccgtcggctgaatgaaatcattgctttgcagaatcgtttgtcggccgaatccaataatcgttgcatcggtaaaacgtacgaagtgttggttgaaggtgtttcgaagcgttcacgcgaccagctgttcggccggaccgaacagaatagggtagtggtattcgaccgcggtacccatcggataggtgatttcgtgaatgtgagaatcacggaggccagttctgccacattgaagggtgaagaagtcttcagctaa

SEQ ID NO: 534 - DNA, 687 bp, B.fragilis
aagaacatcataagaataatgggaacaaacaacagtgatttttatctgcctgtatatgtcattaaccttaaagagcgcacggaacggcggcagcatatagaggaacagtttcaagggaaggtagagtttgctctccattggatagaggcaatcgaacattccattggagcagtaggattatggcaaagcatgctaaaggctgtacaaacagctatcgacaaaagggatgatatcatgatcatttgcgaagacgaccatatatttacccccgcatataacaaagattatttgtttgccaatataataggagcaaacgctcaaggttccgagttgctttcgggaggtgtcggaggatttggcacagcggtaccagtggacacaaatcgctattggatggattggttttggtctacgcaatttatcattatttttaagccgctatttcaaaagatattagactatgacttcaaagacactgatacggcagatggagttttatctgtccttgctaaagataagatgactatctatccgttcatctccgttcaaaaagattttggctattcggacgtaaccgtctacaatgggactccggggatgataagcaactatttttctcaggcaaactaccgcttgagaatgatacatcatgttagtcataaatttaaagaacaggcaaaaagatga

SEQ ID NO: 535 - DNA, 717 bp, B.fragilis
aatactgccatcaattatagttccgaatgggcaaagcaaagcacaataaattattatgatatagagccgggtaaaattcatgtagtggaatttggggcaaatatccctactccttcagactataaaatagatatacagacagatatttgtaatttagtctttatcggaaaaaattggcagaaaaaaggtggagataaagttttaggggcatatagaaagcttaaatccgatggatttcgatgtacgcttacgattattggttctattattcgggaaccttatgatgaagatgagaatttagttataattccttatttagataaatcccaaccggaacatttggaaagattttgtaatatcttgcaggaagctcattttttagtacttcctacagagttcgacgcatttggaattgtgttttgtgaagcatcggcttatgctgtacccagcattgccgccaatgtgggtggagtgagtcaaccggtacgtgaagggaaaaacgggtatttgctcatgccggatgctacagctgaagattatgctgagaaaataaagtcggttttcgctgacaaagaaaactatctgaaactccggatgtcatcgcggcaagaatttgaaacccgtcttaattgggaggtatggagcgagaaagtaaataaaatattggaagaaattgtagaagaacatcataagaataatgggaacaaacaacagtga

SEQ ID NO: 536 - DNA, 285 bp, B.fragilis
gaacttcgcattctcgtacatgccggaatccctgccccgaaaacgattcagttcatcagcggtcgcttcctcctccgaattcaggcagtagctcattatttccgcttcccgccgggtaagtatgcccttgaagccatgattggcatgcaacacagagtccgcccctttaaaagggaacttctcgtccgacaacagaagagactcgcatatcgctttcaagccttcgtcgcctttacctctgcggagcgtgtaaaagaagtaaaacaggtcgatactgctttgtaa

SEQ ID NO: 537 - DNA, 267 bp, B.fragilis
cttgtaagcattatgaagaaactgaacttatttattttattctctttttgtttttcgattatcacttggggacaagccaattttgcagcgattgattcacttattaaaaaagaactgcctcaaggttcggaggttggtatttccgtgtatgacctgactgcccgaaagacactttacacctatcgtgataccaaactttcgcgtccggcatctaccatgaaacttttgactaccattactgcgcttggcccggccggacgcagatga

SEQ ID NO: 538 - DNA, 1689 bp, B.fragilis
aagaaggaaatgaaagtgttggatttcaaaccaaggttattctctaccttgaagaactactctaaggaaacgtttatgtcagatctgatggcaggtatcatagtaggtatcgtagccttacctctggccatcgcattcggtatcgcatcaggtgtatcacccgagaaaggaattattacagctatcattgcaggattcatcatctctctgctcggaggaagcaaggtacaaatcggaggaccgaccggagcattcatcgtcatcatttatggcatcatccagcaatatggagaagcgggattaatcgtagctacactgatggccggcatactcctgatcctattaggagtatttaaattgggagcgattattaaatttattccctatccgatcattgtaggctttaccagcggtatagccgtcactatttttacaacccagattgctgacatattcggattgaatttcggtggagagaaagttccgggagactttatcggaaaatggatgatctatttccggcatttcgacacagtcaactggtggaacgctgtcgtaagtattctcagcatcatcattattgccattactccgcggttttcgaaaaagataccgggttctcttattgctattattgtggtaacgataggagtatatgtattaaagacatatgccggcattgattccatcgataccattggcgatcgttttaccatcaaatcagaattgcccgaagcagccatacccaccctcaactgggaagccatcaaggatttattcccggtggccattacaatcgctgtattgggagctatcgaatcattactatcggcaaccgtagccgacggtgtgacaggagataaacacgattcaaataccgaactgatcgcacaaggaacagccaatctgatcacaccgttatttggtggcatccccgcaaccggagccattgcccgcacaatgactaatatcaataatggcggtaaaacaccggtagccggtatcattcatgctatagttttattgctgatcctcctgtttctgatgcctctggcgcaatacatcccaatggcctgcctggcaggcgtattagtcatcgtatcatataatatgagtgagtggcgtacattcaaagcattgctgaagaatcccaaatcggatgtgaccgtattgctgatcaccttcttcctcaccattatattcgatctgactattgccatcgaagtaggtttggtgatcgcctgtatcctgtttatgcgacgtgtgatggaaacaaccgagatatctgtcatcaaagatgaaatcgatccgaatgacgaactggacattgccgtatgcgaagagcatctgataatccctgccggcgtggaggtatatgaaattaatggtccgtacttttttggtattgccaccaaatttgaagaaacaatggcacaattgggtgaccgtcctaaagtacgcatcatccgcatgcgtaaagttccattcatcgattcgaccggtattcacaacctgaccagcctttgtaaaatgtctcaaaaggaaaagatcactatcgtactctcgggagtaaacgagaaagtacacaaaccccttgagaagtcgggcttctatgaattactgggaaaacaaaacatctgcccgaatataaatgtagcgttggacagagccaaagaaattataaattaa

SEQ ID NO: 539 - DNA, 2433 bp, B.fragilis
tttaatgctgttaaatgtatgaagcaaatttatagtaccctgcttttattagttttactaatattcccatcgttactttttgccacagaaccagagtctgtcgatagagtccctgccatccgtggagtagtctatgacgaaactgatacgccattggcttcggccactgtccaaatagaaggtaccaccatcggaacaacaaccaatagtgaaggccgatttattctgcgtaatctggcacgtaaagtttacaagataaatgtcagctttgtaggatatgccactcaaacccgtacagtcgatctcacctcgagaagtgtagcgcaactctcgtttacgctcttaccggacgataatttactatcgactgtagaagtgttcggagaacgatataaacaaccgaaaaaactggatgccatcacccgcatgcctttacgtcccagtgaacagatacagagtatttctgtaatctcagaaaaatcgattaccgaacagggggcacttaccgtaaccgatgtcgcaagaaatgtacccggagttactcttttcggatcgtatggcggagtaagagaaagcatgtccatccgcggataccggggagtacctattttaaagaatggagtccggatagattccgatttccgtaccggctctgctttatccgaaatgcagggagtagaaagcatacaggtcatcaaaggttccgcagccgtcacacaaggtatcggaaacgacctcggaagtgcaggcggagtaatcaacgtagtaaccaaaacacccaagttcaccaatgaaggagaagtatctttgcgggcaggcagctggggattgttccgccccacatttgacgtacagtccgttctggataaaaatcagacgatcgctttccgtatgaacggtgccttcgaacgttcggataattatcgtccggtcatccattccaatcgcgtatacatcaacccttcattagaatggcgtccggatgacaaaacaagcgttaccatagaaatggattatctgaatgataaccgtactccttataccagttcagtcaatctatcgaaagatacggaagagaatctgtacgacatgccacacaacaaattcctgggattcaaaaacgataatgtaaacaacaagacgctgacttatgccgcacgcatcacccgccagctgacagataatatcagtgtgcgggcagcatatttcggctcttcatataaagtggataatacaagtacttccgtaaaaaccgtagtcaataaagaatataacatgcgtagaagaacgatttcacgttcattacgcgatgaccgcaactcaactttccagcttgactttatcggcagagatattttcaccggccctgttaaacatacattccaattaggattcgactacaaaaacaccgatctgtcgatcaccaattatacccctgtcaacatagacactatcaacgtactggccccgagcatctcgaatgtgctacctgtcgcggttaaatttgttcccgaaatcccggtagaatccaattcttcaagttatggaataatggcacaggaagtaatgacttttaataagtatataaaggctatcctgggactgagatacagttatatcagcagtcaggacggcacaagtgcaggtcccactaccggagatgcctggaatccgatgttgggcatcatgctgactccggtaaagaacattaatttgttcggttcatatacaactactaccagccttctccatgcagccagacgaatggagaacggagatgaaataggtccgtcgaagacccgccagtttgaagtgggcatcaagtccgattggctgaataaccgcctgcgctttaacctgacatatttcgatatccttactaaaaacctctcttatagtacttatcatccgggaactactcaacctaccggttattttgataaagcgggaagtctgaaaagaaaaggtattgaaaccgaattaagcggaagtatacttgaaaacctccaagtaatgatgggttacgcttatctggatgcaaaatacgaaaacagcccggcctttaaaaatggttcagccccgatgaataccccgaaacatactgctaacggatggattcaatatcgattcgacaaaggagtattaaaaagactatcagccggtataggagtctatttcgtaggtaaacgtcctgttaatgattttgcaatcaagccggacggacacggctccatgaccaacgaaaagccttttgacatgcccggttatactacaataaacgcccagctggcctatagtatccacaagtttactgcccgtgtatacctgaacaacctgttcgatgcattaggatacaattcgtattatcgcggaggttatatcaatcagatcgatccacgtaatttctcagcagtaatctcttaccatttttaa

SEQ ID NO: 540 - DNA, 1119 bp, B.fragilis
acacatgcagtgatgagtatggccatcaatctcgataaccagttcaatctgcccgcagattatggttcactggactctcgctggaatcggaatcaagtaggcccattcataaaactgctaaagaagtttgtcaaagacagtcgtttcgatgccttttatcactcgaacgagaacttatatcaagaggctgtaagtcgttttatgcctatttacaaaagcatagatacccaatggtataatgatttctacgggcagaagtccaacgaccggtttcacattatactttcaatgtccaatggcccgggaaattacggaccgagtgtcaccgacaaggaaaacatacataatgtcttttcagtcatgggagcatgggttaccgattccgtaggaatggttgtttatccgcctgaattaatcttgccgatcttaatccacgaattcaaccattcattcataaacttcgacccggaaatgttccgcacaagcggagaacagatttatgctgcggttggcgaacagatggcgcgccaagcctatggacaatggtctattgtccttaccgaagcaatggtacgtgcggcagtcataaaatacatgaaagaccataacttcccggctgtcgaaatcaccaaagaaaccgtcatacaaaaaacacgtggctttgtctggataagcaagctggtcgatgaactcgagaagtattcctctgaccgcacgacatacccgaccctcaacagctatatgccgcggctggcagaagcttatacaggctttgcccaatataccgcaaactatgattctatccgtcccaaagtagtttcgatcgacgaatttaccaacggcgatacaaccgttcggagcgacatcaaaactattactgtccacttcgaccgtcctttggtgggccgcggacactctttcaattatggtcacctcggaatggaagcaatgcctaaaattataaatgtcaactacgccaatgacaaccgtaccgtgattatcggagtagaattgttacccgggaaagagtatggaatcactcttttaggactctctttccgcactccggaaggagatgccataaaaccctacgaaatttctttcaagacggcagagtga

SEQ ID NO: 541 - DNA, 1122 bp, B.fragilis
atacctatattagatcccataattaatccgttacacaatacaattatgaaaaacaaatccgcctgtttctttgtactctccctgtttgtctgctccatgtttacttcatgtaacaaagaatctactaccgaatgtcagactatcgacttctctaccctttttgacggccaaccggaaaagatccctttgaaagaatgggcaaaatccatacactttgtccaattagaaaccaatgattccatactgataggtaatatccgcgcaacaatcctacataaagacaaaatactggtacatcacaataatttatcccttttcgatctgtcgggcaaatttatttgtaacataggtagcaaaggaggaggtcccaccgaatatagcggcattaataatgcttggacagatgatgaaggcattcacattttcgacatagccaacaaaattaaaacatataactggaacggaaaatggataaagaccgaaccgatcccggaaagcaatatcaaagaagtatttccccttgcatcaggtaataatataaaagccggttatatacagaatattaccggaaatgaacctcacaaaatttacctattcaaagacagcaccatcctggctaaaataccctatggcaaatcctttcaaaaaggagagatgacaatggtattctacaatgaatgctatccattccatgcaaatggccggactttctttaaagagatgttcaacgataccattttttccatcgataatcaatatcaacccgttccacgttggtacattgaattaggaaaatacaaaatagcagaagatgcccgctacacattaaccgatcccagaaaaagtgtctttgacaatgcagcgactttaactcccatcggaaaatgggataataaacttttcttttctgcaagggccaataaacagaattatcttttttactatgacctgaaagaaaagaaatccaatagcattcaaatttcttacccggaaaattcattcgccataccggaagaacattcattcatacctaagtgtatgtctgacgacggaaaatatctgatttcgtatgaaatacaggagaatgatgaaaacccggtgatcatattagcggaaaaataa

SEQ ID NO: 542 - DNA, 2898 bp, B.fragilis
tcatgtaaatttgctccctcatataaagcatatattataaatcactataaacaaaaggttatcgctatggaatataatttcagggagatcgaaaagaaatggcagaaaatttgggtagacaaccatacctaccaggtaaatgaagatgcatccaaacaaaaattctatgtactcaatatgttcccctatccttcgggtgccggactgcacgtaggtcatcccttgggatatattgcctcagacatttatgcgcgctataaacgcctgcaaggatttaacgtattgaacccgatgggatatgatgcttacggactgccggccgaacaatatgctattcaaaccggacagcaccctgcaattaccactgttaataacatcaaccgctatcgtgaacaattagataagattggtttctctttcgactggaatcgtgaaattcgcacttgcgatccggaatattatcattggacccaatgggcatttatcaaaatgttcaacagctattattgcaatgatgaaaaacaggcacgtcccatcgaagagttaatagaagcttttagtaccaacggaacacaaggtatgaacgtagcctgtggcgaagaaatggacttcactgccgacgaatggaatgctaaaagcgaaaaagaacaacaggaaatcctcatgaactaccgtatagcctatttgggcaatacaatggtaaactggtgtccggcattgggtaccgtacttgccaatgatgaagtagttgacggtgtttccgaaagaggcggttatcccgttattcaaaaagtgatgcgtcagtggtgcctgcgcgtatccgcttatgcacagcgtttgctcgacggacttgaaaccgtagaatggaccgactcgctgaaagagactcaacgcaactggataggccgcagcgaaggtgctgaaatgaactttaaagtgaaagattcggatattgaatttactatctttacaacccgtgccgacacggtatttggagttactttcatggtgcttgccccggaaagtgaattggtagccaagttgaccactccggaacaaaaagccgaagtagatgcttatctggaccgtaccaaaaaacgtaccgaacgcgaacgtattgccgaccgtagcgtaagcggcgtattctccggaagctatgccattaacccattgaccaacgaacccataccggtatggattagcgattatgtattagcaggttacggtacaggtgccatcatggctgttcctgcacacgatagccgtgactatgcttttgccaaacatttcaatctggaaatccgtccgctgatcgaaggttgcgacgtcagtgaagaaagcttcgacgccaaagaaggcatcatgatgaattctccccgtccgggagctcccgaaggcggactcgtattgaacggattgaccgtaaaagaagcaatcgccaaaactaaagaatatatcaaggcaaccggattaggccgtgtgaaagtcaatttccgtctgcgtgatgcaattttctcacgtcagcgctattggggcgaaccattcccggtttactacaaagacggaatgccttacatgattgatgaaagttgcctcccgctggaattgccggaagtagccaaattccttcctaccgaaaccggtgaaccaccattgggacatgccactaaatgggcatgggacactgtcaacaaatgcgtgacagacaatgaaaacattgataatataaccattttcccactggaactgaatacgatgccgggatttgccggttcatccgcctattatctgcgctatatggatccgcgcaatcacgaagctctcgtttctcccgccgtggatcagtactggaaaaatgtagacttatatgtaggaggtacggaacatgctaccggacacttgatttattcacgtttctggaataagttcctgcacgattggggtatctccgtagccgaagagcctttccagaaacttgtaaatcagggaatgatacaaggacgaagtaactttgtctaccgtatcaaggataccaatactttcgtatctctcaatctgaaagatcaatatgaagttactcctatccacgtagatgtcaacatcgtatccaacgatatcctcgacctggaagctttcaaggcttggagacccgaatacgaaactgccgaatttattctggaagacggcaagtatatctgtggatgggctgttgaaaagatgagtaaatctatgttcaatgtggtaaatccggatatgattgttgaaaaatacggtgccgatacactccgtatgtacgaaatgttcctcggaccggttgaacagtccaaaccttgggatacgaacggaatagatggcgtacatcgtttcatcaaaaaattctggtcattgttctatgacagaaacggcgaatatctggtaaaagacgaaccggctaccaaagaagaactaaaagcactccataagttgattaagaaagtaaccggtgatatcgaacagttctcttacaacacttcagtaagtgctttcatgatctgtgtcaatgaactttcaagtctgaaatgcaataaaaaagaggtattggagcaactcatcgtagttcttgcaccttttgctccgcatgtatgcgaagagttatgggatacattaggaaacatcacctctgtatgtgatgcacaatggccggctttcaacgagcaatacctggtagaagatacggttaattacaccatttctttcaatggtaaagcacgtttcaatatggaatttccggctgatgccgccagcgatgcgattcaagccactgtacttgccgacgaacgctcgttaaaatggacagaaggcaaaacaccgaagaaagttatcgtagtcccgaagaagattgttaacattgttatttaa

SEQ ID NO: 543 - DNA, 753 bp, B.fragilis
atgagtttctctttagttacagtaacttacaatagcgcacagacactacgtgatactataacttctgtattatcacaaactcatcaagctatagagtacataataatagatggtttttcgaaagataacactgtggcgattataaaagagtatgagccattgtttaatgggcgcctgaagtggattagtgaaaaggacaatggcttgtatgatgcgatgaataaaggttttcaaatggcaacaggagatgtgattgggattattaattctgacgatttaatatctgatcctaatgcaattgaaaaagtgataaaatgctttgaatcagatacttctattgatgctgtttatgctgatttatattatgttgctcagaacgatatatctaaaatagttcggtattggaaatcagggggacaacgtcctttctgtaaagggtggcatccggctcatcctacattttatgtgaagaaggaagtatatcagagatatgggttgttcgatctggattttaagttcgcagcagattttgagttaatgcttcgtttgattgataaagagcatattaaattatattatcttcctgaacctttagtcaggatgcgattagggggaactacaagtaagaatctatctaatattaggaaaggaaatcttgaatgtataaatgcttttaaaaagaacggaataaaagtgagtatgttatatcctttatatcgtttattacccaaaatcaggcaatattttcaataa

SEQ ID NO: 544 - DNA, 636 bp, B.fragilis
aataaaagatttgaatttatgaatacattattaatgtctttaatatttacgaccatgacttacgaaatgcctaaacttccgtacgcaaacaatgcgctggaacctgtaatcagtcagcaaaccatcgattaccattatggtaaacatcttcaaacatatgtaaacaatctcaatagcctggttccgggcaccgaatatgaaggaaaaacagtagaagccatcgtagcctcggctcccgacggagctatcttcaataatgccggacaggtgctgaaccatactctgtacttcctgcaatttgcgccgaaaccggcaaagaacgaaccggcaggcaagttgggagaagccatcaaacgcgacttcggcagctttgaaaacttcaagaaagagttcaacgcagcttctgtaggattgttcggttcgggatgggcatggctgtccgttgacaaagacggaaagctgcacatcaccaaagagcccaacggaagcaatccggtacgcgcgggactgaaaccgttactgggatttgacgtatgggaacatgcttactacctcgactatcagaaccgtcgtgccgaccacgtaaacaaactgtgggagatcatcgactgggatgtcgtagaaaaacggctgtaa

SEQ ID NO: 545 - DNA, 381 bp, B.fragilis
agatttgaatcgggcgatggactggacacctgtcaggaaaagaaatctgtgaccctctttttctttcttcaactcgcgcaacagatcccgattgtcatattcaaatttaaaaggcaaatcatcagggtcgcagttgtcttcgaaaatcgggttgaggtaagagcggtcgtaaatgcgttcgtatcgaatgcagggaatgccgagatcatgcgcaacatcggttactgtatcatgcagcttttcggcaaaggggtgggcggcatctatcaaaaggcgaatgtcgttttggcgacagaaagctttcagggttctccgggtcatggcgccgctcaggcgtatgccatgatgcaggtagatatcctgttcgtcacctttggttga

SEQ ID NO: 546 - DNA, 852 bp, B.fragilis
tcggtacgatccgtgactttgtctcttcccgtaagtaatttccggttattaaccttcaataatctgtcaagcataatgaaagccgtcattttagccggtggcttcggcacccgcctgagcgaagccactaacctgatccccaaacctatggtggagatcggtggtaaacccatcctctggcatatcatgaaaacctacagccattacggcatcaacgatttcgtgatctgctgcggttataaacaatatatcatcaaggagtatttcgccaactatttccgtcataacagcgatatgaccgtggacctttccaacaatacgaccaccattctggacaaccattccgagaactggaaagtcacgatggttgataccgggctgaacacccaaacgggcgggcgtatccggcgtgtacagaaatatctcgggaacgaacgtttcctgctgacctatggtgacggtgtcaccgacctgaacatcggtgataccctgaaggctcacgagtcttcgggctgcctcctttcccttacggcctacaaacccggtggtaagttcggcgccctgcagctcgatctcgatacggacaaggtcctctctttccaggagaagcccgacggggaccgtaactggatcaatgcgggctattttgtgtgtgaacccgaagtgttcgattatatccctgagggtgactccaccatctttgagcggcaacccctcgagtctatagccaaggcgggccggatgcatgctttccgtcatacgggtttctggaaaccgatggatactctgagagacaatacagaattgaatgaaatgtgggatcagggagtcgctccctggaaagtgtggtaa

SEQ ID NO: 547 - DNA, 1125 bp, B.fragilis
aatgtgggatcagggagtcgctccctggaaagtgtggtaagccgtatgggaattgatatatttgataatttttatcggggcaaacgtgtccttgtcaccggtcatacgggttttaaaggtagctggctctccatctggttgcatgaattgggggccgaggtgattggtgtggctcaagacccttttacggctcgagacaatttcgtactttccggtatcggcgagaaaattaaggccgaccttcgtgccgatatccgcgatggtgagcgtataaaggctatctttcaggaatatcaacctgagattgtttttcatcttgctgcccaacctctggttcgcttgagttatgacatccctgttgaaacctacgaaaccaatgtaatgggaacaatccatgttcttgaggcagtccgttctacggatagcgtgaaggtaggtgtgatgattaccacagataaatgttacgagaataaagagcaaatctggggctatcgtgaaaacgagcctatgggcggttatgacccttattccagtagcaagggagccgctgagattgctattgcttcatggcgtcgttctttcttcaaccccgagcaatacgataaacacggaaaatccatcgccagtgtaagagctggtaacgttatcggtggtggagactgggctttagaccgtatcattccggactgcatcaaggctttggaatctggagcggctatcgatatccgaagtccgaaagctatccgtccctggcagcatgtgcttgaaccgttgagcggttatatgctgctcgcacaaaagatgtgggacgcccctactgactattgtgagggctggaacttcggtccccattccgagtccatctcgacagtttgggatgtggccacccgggttgtgtccgagtatgggcggggtgaactgcgtgacctttctactccggatgcattgcatgaagcccggcttttgatgttggatatctccaaggctcggttctgtctgggctgggagcctaggatgaatatcgggcagacggtcggattgacggtggactggtataagagataccgggaagaagaggtatatgatgtttgtgttgaccagataaaagattatttattgaaatga

SEQ ID NO: 548 - DNA, 186 bp, B.fragilis
ttaatgatgtcagttatttggctctttaatagtcctgaggaatcagattgttcattaggagtaataatagggatattattatcccaagcattgtcttcattgccacaggacataaaaactaaaaaaaatagactgagaaagagtggtacaaaatacttcataatgtttaggttaggttataaatga

SEQ ID NO: 549 - DNA, 1434 bp, B.fragilis
accaagaggtcttaccttttaaaccaacgtacctttggttttaaaccaaaaaagagtagttttgcaactcaaaaattgatgcctatgcttttaattatagatgatgatagcggggtccgctcttccctgagttttatgctgaaacgcgccggttatcaggtaattgcagtgaccggcccgcgtgaggcgatggaagtagttcgttcggaagctccttctctgatcctgatggatatgaattttacactttccacttccggtgaagaaggattgacgcttttaaaacaagtaaaggtttttcgtcccgatgtcccggtcattctgatgactgcctggggcagtatacagttggctgtacaagggatgcaggccggtgcattcgactttatcacgaaaccctggaataacgctgctctgttgcagcgcatcgagacggcactcgaactgactgccactcccaaagacactccgcaagagcaaagcggaacactcaaccggagccatatcataggcaaaagccgtgggttgatggaggtattgaatacggtagcacgtattgctcctaccaatgctcccgtattgatcacgggtgaaagcggaacgggtaaagaactgatagccgaagccatccatatcaatagccaacgtgtccgccagccttttgtaaaagtcaatctgggaggaatttcgcagagccttttcgaaagtgaaatgttcggtcataaaaaaggtgcgtttacagatgccactgccgaccgtatggggcgttttgaaatggcgaacaaaggaactatttttttggatgaaatcggggatctcgatccgtcgtgccaggtaaagctgctgcgggtattgcaggaccagacctttgaggtgttgggagacagtcgcccgcgtaagacggatatccgggtggtttcggctacgaatgccgacctgagtaagatggtgagcgaacacacttttcgtgaagacctgttctatcgtatcaacctgataaccgtaaaactgcctgcactgagagaacgcagagaagatataccattgcttgccagacactttgccgaccgtcaggcggagattaacaatctgccccgtacagaattctcgtcggatgcgttgaacttcctgagccgtttaccttttccgggcaatatccgtgaattgaagaacctggtagaacgtacgattttggtcagcgggaaggaagtgttggatgcaatcgatttcgagaaccaataccaacgtcatgacgaaagtgtggcaacttcttcttcatttgcgggaatgaccttggatgaaattgaaaagcaaacgattcttcaggcactggaacgctataaaggaaatctcagccaggtggctaccgcattgggcatcagtcgtgcagcattgtatcgccgtttggagaaatatgatatcggtgataagtaa

SEQ ID NO: 550 - DNA, 324 bp, B.fragilis
tgcgcggatccttctcagcccctggtgaagacttatcctactttcgacaccatgcttcagcaactcaaagataacaaaacgaaacaggttacgctggttccgttcatgtttgtggcaggtgatcacgccaataacgatatagccgtcgactggaaagaagcccttgaaaaagaaggtttgaaagtagatgtacgtatgcaggggttgggcgaaatacccgccatccaacaactgtttatcgatcatgcccaatttatgctaaagcatgaaatggtggatataatgaagaaaaaagccaaatatgcaaaagacaaagacgaatga

SEQ ID NO: 551 - DNA, 1503 bp, B.fragilis
cttcatgctttccgcatcttatactttataatgatgatcacgaaattcatgtataccattcacagggtactgggcacactgctcagtatcctgtttttagtttggttcctatcggcttttgtcatgatgtaccacggatttccacgtgcatcacaagctgaaaaattagaaaagctggagcctctgtctccttctctgccttctgtcagtgaaattacttctcgcctgcccgaaggagaaaaagttaagggaatccgtttagaccgatacctcggacaaaccatattccatatccgtacggacaaaggtgaacacaatcttccggccgactccgttcaggcacttccggttatagacggaagccgcatccaccgggtagcctctctatggtgtaacgcaccgatagacagaatcgatactttgaaccgactggatcaatggatacccttcggcggtctgaaaagagagtttcccatctataaatttcactttgccgacacagaaaagcaccagctatacattggttcgcaaagcggagaagtcttgcagttcactacccgtaacgaacgtttctgggcatggctgggagccattcctcattgggtttattttacttggctccgccaagatgccgctttatggagcattacggtaatctggttatccggtatcggatgcctgatgactattgccggattgtgggtaggtatggatgtatggcgtcgatcacgaaagcaaaaaggaaaattctcaccctatcgtaaaaagtggtatcactggcattatgtaacgggaattgtttttggactttttgttctgacattctgtttcagcggtatgatgtcactggcggaagtgccggcatggatcagcaaaccggtattggacaggaaccccacacgggaaataaagaagggagcacccaaaccggttcagtatctattggattatcggcaaatactaaccgaatatccggacgtacgccaggtggaatggagtaatttccgttcaaaaccctactacatagtaaaacggagtgaaggagatctgtacatcgatgcctccgactctctgccccatccgttgaatttggacaaaaaacaggttactgacgcagtaaggacaatccatggggacagcatccatctgaaggtcgaattgattgataaattcgaaacttactaccgcgacatgagtaggatgtatcgcgaccgcagtttattaccggtatggaaaatcacagtagacgatcccgaccacagttgttattacattcatccggaaacagccacagtccgatacgtcaatagcactgcccgttggaaatactggatgtataccgctttgcacagactacgcatacaaggactgaactcctctcctacacttcgtaaaagtgtactgtgggtattgctgcttggcggcacggtttgttcattaagcggagttgtactcggagtgagatatatcgaacgaaaatgcagaaagaaaacaagaagataa

SEQ ID NO: 552 - DNA, 519 bp, B.fragilis
ctaaacactacacaaacgatgaataagaaactgttgaaacaaatagtaaacgaacggcgctctaactcctggctgttcatagaactgctgctggtaagcattgtgctttggtatgtagtcgattatatgtttgtcaccctttatacctattttgaacctcgcgggttcgatattgagaatacctaccgggtggagttcgattacctgatagagaaaagtcccgactacatagccaaccgtacggatgaggaagcacatgcagatatgcgtgagttattggatcgccttcgtcgtcgtcccggagtcgaggcggtgagtatgtcgcaaaattctttcccgtacaacggaagtaacagtgggatggacgtacgcctggataccatggagagcaagtacaacatccgtcgttgggtgacgcccgacttcttccgtgttttccgttatcagggagccaaccggagaaactccggaacaattagctgctctgttgaaggagggtacttttatggtatcgcgtaa

SEQ ID NO: 553 - DNA, 1044 bp, B.fragilis
aaagtatatacactgctttgcaaaaggagattgttgatctttggagtaaacctaaataagatgaaagtatatattaaaaatatttctagaaaaaaaggggagttccagttctatatgcatcagtttgtagaagcttgcatcagacaaaacataccatttgtgaatgaattgcatgtgtgtgtgcggttgaaactgagtgctgtgatgatcaaactgggacattggataaattttttcttttgtcggtgtaataataaagcgattattgtctctacttggggtggtggattaatgtatacgtcatttccgtatagtctattgtatgaaataattccagtattttgggatagttggccttttaattgggaagagcagatttattcgttaagaagattaaattgtagaacatgttttgtgacttctagccaagttgcacaaaggataaaagaaacactaccaaacataaatgtccattggcttcctgaaggtatagatatattggattatgtgcctggtcaggatttgacagaacgaagcattgagatttatgagcttggaagacaaaaggctgattatcacaagattttgtgtgatttgaaatcagaaggtatcttttcgagttttctttgtaatgaatacgatataaatggaatgactactaaactagcatttcctactgcaaaagctttgttgaaggctttacccaatataaagatagtgatttcttttcctcaagtggatacacatccggaaaaagttggtaatatagaaactctaactcaacgatattgggaggcaatgcttagccgaaatctgatagtgggtcgggctccaaatgaattgatccagttgataggttataatcctgtaattgatgtggattgggaagatcctaaaaaacaactttcagatatattacttaatataagctcttttcaaaaattagtcgatagaaactatcgaacggcaagaaaaatatcttcttgggataacagggtcaaagatattataacaattcttcggacttctggctatgaaatatag

SEQ ID NO: 554 - DNA, 1161 bp, B.fragilis
agaagattaaccagaagaataaaaagaaaaaataaaatgttttcagatgaattagaaaagatttcctgggaagagacgactaaagccatctattccaaaactgacgctgatgtgcgccgcgcattgtcgaaagaacactgcgatgtaaatgattttatggcattgatttcgccggctgccgctccatatctggagacgatggcacgtctcagccggaagtatacgatggaacgcttcggaaaaacaatctcgatgttcgtgcctctctatattacaaattcttgtacaaactcgtgtgtatactgcggctttaaccacaacaacccgatgaagcgtaccatccttacggaagaagagatggtgaacgagtacaaggcgatcaaaaagctggccccctttgagaatctgttgctggtgacaggcgagaatcctgccaaagccggagtggactacatcgaacgtgccctcttgctggcaaagccctactttgctaaccttcagattgaagtaatgccacttaaagcagaagaatatgaacgacttacacatgcaggtctgaacggggtcatctgctttcaggagacgtataacaaagccaattacaacatctaccacccccgcggcatgaagtctaaattcgaatggagggtcaacggattcgaccgcatgggacaggccggagtacacaagataggaatgggcgtactgatcggactggaggaatggagaacggatatcaccatgatggcctatcatctccgctacttgcagaagcattattggaaaacgaaatatagtgtcaacttcccccgcatgcgcccgtcggaaaacggaggcttccagcccaatgtggtgatgaacgaccgtgagttggcacaagtgacttttgcgatgcgcatcttcgaccatgatgtagacatctcctactctacccgcgaaagcgcagccttccgtaaccacatggctacgctcggagtgaccaccatgagtgcagaaagcaaaacggaaccgggaggatactttacctatccgcaagcactggaacagtttcacgtaagcgacgagcggaaagccgtggaggtggatgcagcactacggtcgctgggacggataccggtatacaaagactgggacacggcgctgacgctaccccaatgctga

SEQ ID NO: 555 - DNA, 1668 bp, B.fragilis
ttaaacataactcttgatataatgatgaaaagtaatgaaaacaacggagcagtaactaaaagttttgctaaaaagatggagagcatcagtcctttcgaattgaagaacaaactgattgaaatggctgacgagagcatcaagaagatagcccacaccatgctgaatgccggacgtggaaatccgaactggattgctaccactccgcgcgaagcgttcttccttttaggtaaattcggactggaagagtgtaggcgtgtgatgtacctgccggaaggaatagccggtattccgcaaaaagacggaattgccgcccgctttgagactttcctcaagaccaaccacagccagccgggggcagagctgttgaaagggacgtatcaatacatgttgctggaacatgccgccgacccggatacccttgtccacgaatgggcggaaggagtggtaggcgatcagtatccggtgccggaccgcattctgcaatttaccgaaatgattgtgcaagactatctggcacaggagatgtgcgaccgtcgtccgccgaaaggcaaatacgatttgtttgccaccgaaggcggaacagcagccatgtgctacgttttcgactctctgcaagaaaacttcctgctcaataaaggggatggaatcgccttgatggtacctgtcttcactccttatattgaaattcctcaattgagacgctatgaatttaacgttacggaaatatctgcggatcagatgacgacagacggattgcacacctggcaatacaaagacgaagatatagaccgcctgaggaacccgcagatcaaggcactcttcattaccaatcccagtaacccgcccagttatacactgaatcccgagactgccgcacggattgtagatatcgtgaaaaaagacaatccgaacctgatgattattacagatgacgtatacggaacattcagtccgcatttccgctcactgatggccgaattaccacaaaacactttgtgtgtctactctttctccaaatatttcggagccacgggatggagggatgccgtgatcgctctgcacgaagagaatatcttcgaccggatgatagcccacctgccggaagagcagaagacaattctcaataagcgttactccagtctgactcttacacccgagaaactgaaattcatcgaccgcatggtggctgacagccgccaggtagctctgaaccacaccgccggattatcgctgccacaacagacgcaaatgagcctgtttgcttctttcgccattctggataaggaaaatcggtataaaaacaaaatgcaggagattatccggcgtcgcttgaaagccctgtgggataacaccggattctcactcgtagacgatccgctgcgtgtaggttactacagcgaaatagatatgctggtatgggccaagatattctatggagaagaatttgtcagttatctgaagaaaacttacagcccgctggatgttgttttccgcctggccaacgaaacctcactggtattgcttaacggaggaggttttgccggaccggaatggagcgtacgtgtatcactggctaacctgaatgaaaaggattatgtgaaaataggtcagggaatcaaacggatactggatgaatatgccgtgaaatggcaagaatcacggaaatag

SEQ ID NO: 556 - DNA, 1788 bp, B.fragilis
acgaataaaacaataacctcgcctccggcccctctcccgtcgatcactcttcgggaaaagaatacggggctgagagatcctaataacgaatgtatggaacaaagaataaaatttccccgctctgagaaggtatatctgtccggcaagttattccccgaaatccgtgtaggtatgcgaaaagtagagcaagtgcccagcacaactttcgaaggagaaaagaaagtgatcactcccaatccgcatgtgtacatctacgataccagcggtcctttcagtgaccccgacatagaaatcgacctgaaaaaaggcctcccgcgcctgcgtgaagaatggatactgaacagaggagacgtggaacaattgcccgagatcagttcggaatacggacgcatgcggcgggatgacgggagcctcgaccacctccgttttgaacatatcgcactgccctaccgggccaaggccggccggcatatcacccagatggcgtatgccaaacagggcattgtcactcccgaaatggaatatgtggctatccgtgagaatatgaactgcgaagaactgggcatcgagacccatatcacacccgaattcgtacgtcaggaaatagccgaaggacgggcggtgctgcctgccaacatcaaccatcccgaagccgaacctatgattataggccgcaacttcctggtgaaaatcaataccaacatcggcaactccgccactacctcgagcatagacgaagaggtggagaaagcaatgtggagctgtaaatggggaggagacacattgatggatctttcgaccggagagaacatacacgaaacgcgggaatggatcatccgcaactgtcccgttccggtggggaccgtacctatctaccaggctctggaaaaggtaaacggaaaggtagaggacctgacctgggaactgtatcgcgacacactgatcgagcagtgtgagcagggagtggactacttcaccatccatgcgggcatccgccggcataatgtgcacctggcggaaaaacgcctctgcggcatcgtatcccgcggcggaagtatcatgagcaaatggtgcctggtgcacgaccgggaaagcttcctttacgaacacttcgatgacatctgcgacatcctggcacaatacgatgtcgcagtgtcgctcggcgacggcctacggcccggatcgacccacgacgccaatgatgaagcgcaatttgccgagctcgacacaatgggcgaactggtggtgcgcgcctgggagaaaaacgtacaggcatttatcgaaggaccgggacatgtgccgatgcacaagatacgcgaaaacatggaacgccagattgaaaaatgccacaatgccccgttctatacgctcggcccgctggtgacggacatcgctccgggatacgaccacatcacttcggctatcggagcggcacaaataggatggctgggaacagccatgctatgctatgtgacccctaaagagcacctcgccctgcccgataaagaagatgtacgcgtgggagtaatcacttataaaatagccgcccatgcggccgatctggccaaaggacacccgggggcacaggtacgcgacaacgcactgagcaaagcccggtacgaattccggtggaaagaccagttcgacctgtcgctcgatccggaacgtgcattctcttacttccatgccggacggcataccgacggagagtattgcaccatgtgcggaccgaatttctgcgcgatgcgactgagccgcgatctgaagaaaactcaaaaacaaaaatag

SEQ ID NO: 557 - DNA, 774 bp, B.fragilis
ccgataaaaacaaagaagcatacagccatggaaataacacttaaaaatcagttcattactttgtggaatacttattttccacaagccggacttccgataacattccaatactcggcagatacacaaaatctcccgatagtggaagctccgaaaggacatcggtgcatcattgcacagttgacccaggtacagcgtggaaaaactctctgcatgcaggcggattctgtgggatgccgaggtggaaaacggtacacaaacttcacggacaagatgtttcccggattcgaatgtttcctttcacacaatgaacagggcgaaggagaacgatacaagcagactccagagctggcagctgccgctctggcacagttgcctgcacttcctgtcaagggagaaaacctgatcttcaaacgttgggataagctggaagcggaagacatgccggaagttgttatcttttttgtatctgccgacatcctctccggtctgttcacattggcttgttttgacaatgtagctcctgatgcagtgatcgctccctttggtgcaggctgtgcttctattatctatcatccataccgggaacaactggacagaaccaatcgggcggtattgggatcattcgacccttctgcacgcaaatgtatgaaacccgatctcttgtcttttgccattccgtttaacaagttcaagagtatggtgtcacaaatggaagaaagcttcctaaagacagcaacgtgggatgtaatcaaaaagagaataggctcgtcataa

SEQ ID NO: 558 - DNA, 468 bp, B.fragilis
caagcgagaaccttgttcggttcacttttaacaactatctttgcccaatattcacacattaaaaagattaagcaaatgaaaaaaattattctcggagcatgcgctgttcttttcacgcttgcttcttgccaacaggccaaacaaaaagttttcgaactggctgccgaacaagtaaacaaacaatgccccatcactgtcgatgaaatgacaagaatggacagcaccacttattcaggtaaggacaatacatttacctatttctataccttaagcggccaggctgacgatcctaccatgtcagaacaactgaagaaatcattggaagaaaccctgccggaaacaataaagaacactgaagagatgaaagtgtacagagaatcggatgtgaccattaaatacatctatctgtcaggcaaaacaaaggaagagctgattcaagtaacagttactcccgatatgtataaataa

SEQ ID NO: 559 - DNA, 1227 bp, B.fragilis
atggaactgactctcctcttgattattgcagccttactggttgccctgcttgtattgacacttacccgcaacaatcgcgcacaaagcgaagagatgcaacgggcattgcgccaacaaatgcaggaaaaccgggaagagttgaatcgcagtattcgcgagttacgcatggaaatgacgcaaaccctgaatcagggtttgcaacagctgcaagatgccatgcataagaacatgatgaccaccggagaactgcaacgccaaaagttcgacgcaatggcacgccagcaggaaacgctgatacagtccaccgagaagcgtctggacgacatgcgcgtgatggttgaagagaaattacaaaagactctcaacgaacgcatcggacaatctttcgagatagtccgttcgcaacttgaaaatgtgcaaaagggcctgggcgaaatgaagtcgctcgcacaagacgtaggcggtctcaagaaggttctgagtaacgtgaaaatgcgcggaacgttcggtgaggtccagctaggcgcacttctggaacagatgatgagtccggaacagtatgaagcgaatgtcaagaccaagaaaagcggaaccgaatttgtggagttcgccatcaaacttccgggaaaagatgatgccaacagcactgtttatctgccaatcgacgccaaattccccaaagatgtttacgaacaatactacgatgctttcgaagccggagatgccgcattgatggaatcgtgcggacgccaactggagacaaccatcaaaaaaatggcgaaggatatccacgacaagtatgtcgatcctccgtttacaacggacttcgctatcttatttctccccttcgaaagcatctatgcagaagtgatccgccggacaagcttagttgaaacgctacaaaaggattacaagattgtagtaaccggaccgactactttgggagctatcctgaacagtttgcaaatgggattccggacactcgccatacagaaacgcacaggcgaggtatggaccgtactgggagctgtaaaaaccgaattcggaaaattcggaggactgcttgagaaggtccagaagaatctgcaaagcgcaggtgaccagttggaagaagtgatgggaaaacgtacgcgcgccatcgaacgcaaactccgtcaggtcgaagaactcccccacgaggaaagccggagaatattaccgatagacgatggcggagaagatgactga

SEQ ID NO: 560 - DNA, 423 bp, B.fragilis
tgtaatgtcgcaaaaaatgcgatgattttaggcgcaaaacgtctggtggttacgatttacatccagtatcacttatgcctaaaatatgaatttgctttggtgagagtgaaagaacttctgccattggttgatgataatatccctgcgaatgataaggatgcagtggaactctctgttatgtccgacatcgttattgcatatgggaaagaacattatccgatagaaaaaccaactgttgcagaattaatagaactttatcttgaagaaaaaggaatgagccaaaaacaacttgccattgagattggaataagtctttcacgggtgaatgattatattgcaggacgttcagaacctactttgaaaatagcccgtttgctttgtcggatattgaatattcctcccgttgcaatgttgggtttttaa

SEQ ID NO: 561 - DNA, 756 bp, B.fragilis
ggcaaatattttaaaccaatgggaagagcgttcgaatatagaaaagctaccaagctgaaaagatggggcaacatggcccgtacatttacgagaatcggtaaacaaattgctatcgctgtaaaagccggtggtcctgatcccgaaaacaacccgcatctgcgtgcagttgtcgctactgcaaaacgtgagaacatgccgaaggataacgtggaacgcgctatcaagaatgccatgggtaaagaccagaaggactataaggaaatgaattatgaaggttatggtcctttcggtattgcggtatttgtagaaacggctacagataacacaacccgtactgttgccaatgttcgtagcgttttcaataagtttggcggaacactgggtacttcaggcagtcttgattttatgttcagctggaagtcaatgttcaccattacaaagaaagaaggcgtggatatggacgatctgattctggaactgatcgattacggggtagaggaagagtatgatgaagacgaagatgaaatcacgctttacggtgatccgaagtcgtttgcccagattcagaaatatcttgaagagaatggcttcgaggtgaaaggtgctgagtttacccgtattccgaatgacgaaaaagatctgacaccggaacaacgtgccaccattgataagatggtagaacgcctggaagaagacgaggatgtacagaatgtgtacactaacatgaagcctgcagataacgaaggcgaagagtaa

SEQ ID NO: 562 - DNA, 2373 bp, B.fragilis
cagataaattttatgcccgactatatcgaagaacttaatgaaagccagcgtgcggcggtgctctacggtgatggcccttcgctggtcatcgccggtgccggttccggaaagacgcgtgtgctcacttataagatagcctatctgctcgagaacggttacaatccctggaatatcctggcactgactttcaccaacaaagctgcccgtgaaatgaaggagcgtattgcccggcaggtgggcgagcagcgtgcacgattcctttggatgggtacgttccattcggttttttcccgtattcttcgtgccgaggcgtcccatatcggctttacgtcgcagttcaccatctacgattcggcggacagcaagagcctgattcgttccatcatcaaagagatggggcttgacgagaagacctataagcccggcagtgtgcaggcacgcatctccaatgcgaagaaccacctggtgtctccttcgggatacgcagccaacaaggaggcgtacgagggcgatcttgccgcaaagatgcctgccatacgggatatctacagccgctactgggagcgttgccggcaggccggagcaatggatttcgacgatctgctggtctatacctatatccttttccgcgactttcccgacgtgctggcacgctatcgcgagcagttccgctatgtgcttgtcgacgagtatcaggacaccaactatgcacagcacagcatcgtgctgcaactgacaaaggagaatcagcgtgtatgcgtggtgggcgacgacgcgcagagcatctactccttcaggggagcggacattgacaatattttgtatttcaccaagatatatcccgataccaaagtcttcaagctggagcagaactaccgttccacccagaccattgtccgtgcggccaacagcctgatcgaaaagaacgagcggcagatccccaaagaggtgttctccgagaaggaacggggtgaggccatcggggtctttcaggcttacagtgatgtggaagaaggcgacattgtgaccaataaaatagcgcaactgcgtcgcgagcacgattatgaatactccgacttcgccatcctttatcgtaccaatgcccagagccgtgtcttcgaagaggctttgcgcaaacggggcatgccttataagatttacggcggcctctctttctatcagcgcaaggagatcaaagatatcatagcctacttccgcctggtggtcaaccccaatgacgaagaggcgttcaagcggattatcaattatccggcacgcggcatcggcgataccacggtgggcaagattattactgccgccaccgataacaatgtcagcctctggaccgcactctgcgaacccattacgtacgggctttccatcaataaaggtacacataccaaattgcaggattttcgtgcgctgatcgagcagtttatggcagatgtgaccgtaaagaatgcttatgaaataggtacggaaatcatccgtcagtccggcatcatcaatgaagtctgccaggacaattcgcccgaaaatctcagccggaaagaaaacatcgaggaactggtgaacggtatgaatgatttttgtgccatgcgtcaggaagaggggaacacgaacgtttctctgatcgactttctctccgaagtatccctgctcaccgatcaggattccgacaaggagggagacggcgagaaggtgactctgatgacggtacattccgccaaaggactggagttccgcaacgtattcgtggtggggatggaagagaatcttttccccagcgggatggcgggcgattcaccccgtgcgatggaagaggagcgacgcttgttctatgtagccatcacccgtgccgaagagcactgtttcctctcgtttgccaaaacccgtttccgttacggtaagatggagttcggcagccccagccgtttcttgcgggacatcgacacccgtttcctgcaacttccgcaggaggccgctttaggccggagcgtcgacgaaggggccggccgcttccgccgcgagatggaagaggggtattcgcgccgttcgtcttccgaacgcttctctgcccgtccgtcggccgaccgtccggaacgcgaacggccgaaggcgcagatcatcgcgccgacggtcccccgtaacttgaaaaaggtaagtgggactacgctctccccatcgtcagcttccggagccggcgtcgccggcgtacagcccggacagaccatcgagcacgaacgcttcggcctgggtgaggtgatccgcgtagaaggtacgggcgacaatgccaaagctaccattcatttccgtaatgcaggcgataaacagctgttgctgcgtttcgccagatttaaagtaatagaataa

SEQ ID NO: 563 - DNA, 219 bp, B.fragilis
cttaaatttctaaagcaaatgttgaaagaaaaagcaggtgaaattgcaggtaaaatctggaatgcactgaatggaacagaaggactgactgccaagcagattaagaaagcaactaaattggtggataaagatttgttccttggcctcggatggctgttgagagaagataagatctctactcaggaaatcgaaggtgaactcttcgttacattgaactaa

SEQ ID NO: 564 - DNA, 1329 bp, B.fragilis
gtaagttattatttagaccaatacgttttttatatgatcttttttaaagtaaaaactcgtaatctggttttttcttttattcttctaagtctattaattgtatcagatctattattatttaccagatattcaaattggggaataaaaacagattctatttggctttttattgcaatcatagatgtagtattactttttatgcttatttctttttttcgatttaaaagaatagtaaacccatcttctgtatatcttgtttttgtaggactatttgcatatagtgtattaccactatcagagaatattcgcttctcgaatgagttgctcttgataatattatgtggtgtagcagcttattttgtaggtgtattttgtttgcctcaaatacacattattactttcccggtttttacaaacaggacaaaaagaatcttttattatattctatgtgtactaactttttcttgttttatttatgagatcaaaaatgttggttacatacctgtctttgtgataggacaaagtttagatatttatggagaagttggtgaatctaattccgttttacatacatttgttttattgactcctatattattctattggtcgcttatcttagcgaaagagggaattatacagacacgaattagaaattgtattgtttcttttttgttgtttgtatttgttaataattttggtcgtacttctcttttgatgtttataataacaggattgatatatttagaattttatacaaaattaagtgtctcaaagtttattagtataatttttttgtttatcagtttatttattattatgggtaatgtgaggtctggaagtacttttgatggaataaataaagtgctgagaagaataggaaatacccaatatgaaacatctattttagaatcttatctaatatcatattcttctgttaatttctataagatgaatgatgtaatacaactaaaagaagtattgaattactcttctaatggtagaaattcattaaagccaatagttaaactattgagtataagtgaaccattggataatgtcgcagagtttcaaacacaacaaaatttatctacttatatcgcagatccatatcttgattttggatatgcaggggttgttgttcttaattgtctatatggaatgattgctgttatgttattcgaaaggtatgagaaaaagaattgtccggaatacataatctcatggggggtagttgtcttttgtatattgatggggtgtttttttaatgcgttcaatacgatgttggtatgggtaatatatatatgtaataaaatattgctaaaacgatga

SEQ ID NO: 565 - DNA, 1356 bp, B.fragilis
acaatacattatatgagtaagaaagaaacactcaagcaacaaattctcgatttaacccgggaatactacaaagaggttcacgggtcctcccgctccttcgaacccggtaagagttttgtcaactacggcggccgttattttgatgaccgcgaactggtgaacctggttgactcatcccttgatttctggctgaccgccggtccgtgggcccggaagtttgaaatccgttttgccgaatggttgggtgttaaatattgctccctgaccaattcgggctcttcggccaaccttcttgcctttatggccctgacctcgccgcagttgggtgagcgcagaatcaggcggggtgatgaagtgatcacggtagcctgcggctttcccacaaccgtgaccccctgcatccagtatggtgcggtccctgtttttgtggatgtcaccatccccgagtacaatatcgacgtgactcaactggaagccgcattatctcccaaaactaaagcggtaatgattgcccactctttgggtaacccgtttgatttgcaggctgtcaaagatttctgtgataaacataacctctggttggtagaggataattgtgatgcccttggctctacttatacaattgacggtgtagaaaagaaaacaggtacgatcggccatatcggcacaagtagcttttatcctccacaccacatgacgatgggagagggcggtgctgtctataccgatgatcctctgctgcacaaactggtcaattctttccgtgactggggccgtgactgctggtgcatcgggggtgttgacaacacgtgcaaataccgtttcagcaaacagttcggtgacctcccggtaggttacgaccataaatatgtctattcccatttcgggtataacctgaaagtgaccgatatgcaggccgccatcggctgtgcccagcttgagaagctggactccattgtcgaagcccggcggtcgaacttcgcctacctgaaagaaggccttgcgggtacatctggccttatccttcccgaagcgcagaagaactccgacccgagctggttcggcttccttatttcggtgaaggaagatgcgggcttcacccgtaacgacctttcccaacacctggagagcaggaagatccagacacgcaacctgtttgcgggcaacctactgaagcatcccgcctttgatgaaatgcgttccacgggtgagggataccgcgtaatcggcaatctggaaggtactgattacgttatgaatcataccctctggatcggtgtctatccgggcatgacccgtgccatgctcgaccacatgatcggtacgatccgtgactttgtctcttcccgtaagtaa

SEQ ID NO: 566 - DNA, 903 bp, B.fragilis
agagaacattatttgatgtatgtaaagaaaagaaacaaccattttaaaatttataatttgatggagcaacgcacttatttacctttggtgtctgttattacggtgtgttataatgctactactgtgattgaggctactattcttagtatcattgggcaaacatattccaatatcgaatatatcattatagatggtggtagtacagatggaacaatagaagtcatcaagaaatatgaaaagaaaatatcctattgggttagcgaaccggataaaggtatttatgacgctatgaataaaggtattgtaaaatcgactggagaatggatccattttctaaatgcaggagatgtttatttgaacacccacatattggaagattgcataagatgctttaatgagaagaaagtgaaagctgatgttttatatggtgatgtcatatgcaaatttgattttggaaatttacttttaaaacctggtgctttgagtgattttgaatcatattttcctatatctcatccagctactcttgtgaaaggagaattgcttaaggaaaatatatttgatacttcttatcagatatccgctgattatgaactgttatatagattatatcataaggggtgtacttttgagtacatacctataccattggttttgtttgatgcaataactggaatatcttctactaatcctctattgctttataatgaaaatactcggatacaggacaaccgacataaaataagaaaatgtattagaattgctataataaaagtacgtgtgcttttgtcatttataataaatggattcttactaaatgattatgtgcgaaataattatcataaaaagagattgttgagaaataagcgttttaacgaaatagatattaataattttatttga

SEQ ID NO: 567 - DNA, 957 bp, B.fragilis
cttatgtactatctgataatcttagttctgctattcctggcagaacttttttatttccgcattgctgataaatgcaatatcatcgataaaccgaacgaacggagttcgcatacccggatcacgctacggggtggaggtattattttctacttgggtgcattggcttattttctgacaaatcagtttgagtatccttggttcatgctggctctgactttgataacctttattagttttgtggacgacattcgctctacctctcagggattgcgtttagtttttcattttactgcaatggccttgatgttttatcaatggggattattcaatctgccttggtggactatccttgttgccttgattgtatgtacaggcattatcaatgcttataactttatggatgggattaatggcattacgggagggtattcttgggttgtattacttgctttagcttttatcaatgtgcaaattgtccgttttgtggaggaggatctgatatacactatgctttgtgctgtgttggtatttaattttttcaattttcgcaagaaggccaaatgctttgccggggatgtgggatcggtcagtattgcctttgtgattcttttcctgataggtaaactaataattcgaacagagaatttcagttggattgttttgcttgtggtttatggagtagatagtgtgctgactattatccatcggcttatgctacatgaaaatattggtttgccacatcggaaacacttatatcagttgatggcaaatgaactggagatcccgcatgtgatggtttcactgatttacatgacatcacaagccataattattgttggttatctgttaactcccggttggggctattgttatttattgggcacaattgtcatactaagtatggtgtatatcttatttatgaagaaatatttccatttgcatccggctatgaaatga

SEQ ID NO: 568 - DNA, 1488 bp, B.fragilis
ataaacgaatattatatgaaacgatactttctactttctgcttttgcattttgctcgttggcgctgagtgcgcaggaaacgcaggaaatcaccttgaatgaagccattgcactggcacgaacacagtctgtagatgcagcagtagctctgaatgagctgaagacagcttattgggagtaccgcacgtttcgcgccgatcttcttccggaagtaaacttcagcggtacattgcccagttacagcaagcagtataacagttatcagaatgaagacggctcttactcgtttgtccgcagtaataagttaggattgaacggtgctttgtctatcgaccagaacatctggtttacgggaggtaaagtttcattgtcctcttcactcgactttatgaaacagttaggttccggaggaagccggcagttcatgtctgtccctatcgcccttcaactgactcagcccattttcggagtaaacaacctgaagtggaaccgccgtatcgaaccggtgcgttacgaagaggcgaaagccgcttttattactgcgacggagacggtgaccatgaatgcgatcacttacttcttcaatttgctgtcggcaaaggagacactgggcactgcccgacagaatcaggtgaatgccgaccgtttgtacgaggtggccggggctaaacgaaaaatgggtcaaatctcagaaaatgaacttctgcaactgaagcttgccgccctgaaagcccgggctgccgtgacggatgcagaaagcaatctcaatgcccatatgttccgtttgcgctctttcctggccataggaaacgacctgatactggaacctgtggtaccggaatcggctcccaacctaaagatggaatacaaccaagtgctgaacaaagcactggaacgcaattcgtttgcccacaatattcgtcgtcgtcagttagaggccgaatatgaagttgcaacagcccggggaaatctcaggagcgtcgatctttttgccaatgtaggttatacgggactgaataaagacttatctcctgcctatcacaatttgctagacaatcaggtggttgaggtcggtgttaaaattccaatcctcgactggggcaaacgccgtggaaaagtgagggtagccaagagtaaccgggacgttaccctgtccaagataaagaaggaacagatggatttcgatcaggacatcttcctgctggtcgagcatttcaacaatcaggcacagcagctttccatagccaatgaggccgataagattgcgcaacagcgctataagacgagtgtcgaaacattcctgatcggtaagatcaatacactcgatctgaacgacgcccagaactcgaaagacgatgcgcgccaaaaacatatcaacgaactgtactggtattggtattactattatcaactccgtagcctgacgttgtgggatttccaaaacaatactcccctggaagctgattttgaagatattgtaaaaaaataa

SEQ ID NO: 569 - DNA, 2406 bp, B.fragilis
aatggtggatataatgaagaaaaaagccaaatatgcaaaagacaaagacgaatgaaaagaatcatattagctgcattggggagtgctctattacttccctcacaggcacaacagaaaaataaagaatatactaacttcaacgattctgtattttcaatcaacgaagtagtagtggcaaccaactacagacgcaagaccgatgctttgaaactggatgttccggcaaagttcattcctatttcaaccaactccattacttctggaatgcttgagaaacgaaacatccgggatatacaggaagcctcccgtttccttcccggtgtgcgctttcgcacctcttacggagcgtttacccaattctcaatccgtggattcgataattctgtaatcatggtagacggagtacgtgacgaacgctcgtctattgacaactcttatccgttcatggacttatcggctgtggaaagcatcgaactgttaaaaggtccggcttcagtactctacggacaatccgctgtgggtggtgtcctcaatattgtccgcaaggctcctgtaagcaagcaaagtgtctatgcccgcctggcttatggcagttactataacaagcaggccacaatggctttgggtggtaaactgataggaccattgaactaccgtgccagcgtcaattggcaggatcaggagggatggagaagcaatgctaccaaacgtctctccggctatctggccttaggagggcatttgacagaaaatgacgaattggatatccgtatcggagctaaccgcgatttctatccgacagaaatcggtttacctcccacaatgtcttatgacatcctctcagccacagacggcagcaaatatctgagtaagggggatgccctgcccggactgaacaagaaagcccgctacaacagtgaatcggactttatgtacaaccgtggattcaatgcttccgccatgtataagcacacattcagcgaagctttcaaattgatggagaaattgtcttatacctatgacgacattgactacttcggtaccgaatcactggactacctcacaagcgaccgtcccatctatgatcattattacatgaccaaagacaaacagggcaatgataccaaaaagtatatctgcctggactccatctactacagttacccgctacgcttttcacatatcgctaaaactgtgaacaatcaattggaggcaagcggaaagttctatacgggagacgttgcacacaactatttgggcggttattcttttgtatccttgatgcgtgactcttatatggcctatggcaatggaagcaccggagccaccggtcccggaaccacaggacatagctcggtatacaaccctcacagcattggttggatggaagctcctttcagatttgttactgcacagaaaacatttacccacggattttatctgcaagacttggtggaattcagtgataaactgaaaatgatgctggccggacgttacgatctttttatgtataagactgctaacctgaacaccagtgacggaggacgccattatgataaaccggatgacgatgcttataataaaataaccaatggtgccttcaccttccgtgccggattggtatatctgcctattgaaaaactatctgtttacggttcatacggtacttacttcaagcctatccgcgcattttatgacgctaacaccatttatatcgacaaggatggaaaagagttcactcccgtaaatggtaaagaggtattcaagccggagaaaggtttccaggtagaagtgggtgcacgatacgagatcacacgtacattgcagactaacgtaagtttgttctatatcaataaggataatatccgccagactcttgccaacaaaggcgatattgccaacggcgtagaactggacaagaaagttgtgggacaagtaggcaaaatggattccaaaggattcgatattgacattacctggagtcccatctacaacttgtcgatgagcgccggatacggatataccgatgcaaaggtacgcgatttagccgacaacccttatatgccgaccacttcaagcaaaggcaaacaatatgcctacattcctaaaaacacattctatgcttttggcgcttacaccgtatccaaaggcgtgttaaagggactgggagtaaacttttctaccagttttcaggacaaagtataccgcaactcggataatacgagctcgttcgatgcttactggctgaccgacctcggtttctcttatacattaaagagcaatgtgcgcctgggagtcaacatcaataatctgttcaataaagaatactgtaatcaggcacttggtaatcagttaataccaagcatgcctcgtaacttcatgctttccgcatcttatactttataa

SEQ ID NO: 570 - DNA, 285 bp, B.fragilis
gtaaggtttcataagataaaggaaatatttttatttgaattatacaaatattcactctacattttaggtttccgccggcttttctctcctgtaggctctgtctgcaccatacagatatatacaaaaaggcgaggctaccctcttggagtagcctcgcacaaaccagttaatctaaagttattcttcgatggctgcctgcgccgctgccagacgtgcgataggcacacggaacggagaacagctaacgtaattcaaacctactttatggcagaacttaacagatga

SEQ ID NO: 571 - DNA, 900 bp, B.fragilis
tcaatgaatcttctttttactggtgcttctggctttttaggcagcaatctttattctctactgaaagataaatatcaaattaggactgtggggctgactcctcgggataattatactataaatttagtgtcggatgttcctaaactgaatatcaagtacgatgttgtgctgcatgctgcaggtaaagcgcattctattcctaaaacagaagaagagaaacaacttttttttgatgtaaatcttcagggtaccaagaatttatgtactgctttagagaatagtggtattcctaaagctttcatttttattagtaccgttgccgtttatggttgtgattcgggtgagaatatcacggaagagcatcctttaaatggaacgactccttatgctttgagtaagattaaggctgagaaatacttggaagggtggtgtgctatgcataatgtaaagttaagtatacttcgtccttcattgattgccggacctaatcctccgggaaatttaggagcgatgattcgtgggattagaaatggtaagtacttaagtattgccgggggaaaagcccggaaaagtgttctgatggttcaggatattgcaaatcttcttcctatgttaatagaaaagggtgggatatataatgtttgtgacagttaccagccgagttttcgtgaactggagatggtgatatgtaatcaattgaataaaaaaagaccaatatctattccttattggttagctaaaagtatggctgtcattggagattgcctgggtaaaaaagctccgatcaattcattgaaacttcgtaaaatcacaagctctttgacctttagtaatgaaaaggctgtacgagaactcaagtggaagcccatgaatgtgctggagacttttcttatagaatga

SEQ ID NO: 572 - DNA, 1437 bp, B.fragilis
tctggctgccaccctggtaaatgccattctttgctatcccgatgcggaacaactcagacccggaagagacgtatagcagacgaccggtatacagacgttttatttattagaatcgttcattatataaaaagaatgaagacctcagaaacaacccgacctactctttcttctctccctgtcgggaagagagcggaagagggtacaccccataaccttttcaccgttataggtctcgacgacagtccttcgccttacctttcaccttccgtcaaggcattgatagaccaaggatgtgtcttttcaggaggaacgcgccatcacgacattgttgccccactgctccctgccggagcaaagtggatcgacatcaccgttcctctcgaccaggtattcgcccgttatgcaggacatccccatatcattgtctttgcttcgggtgaccctatctttttcggctttgccaacacgatccaccgacgtctgcccgatgcggagattcggctctatccctcttttaactctttgcaaacgctggcacaccgattagtgatgccctacgatgatatgcgcaccatctcccttaccggacgcccatggcatggatttgatcgtgcattgatagaacgtactcccaagatgggaatcctcaccgatcgcgaacatacgcctgctaccattgcaagccggatgctggactatggttacaacgattataccatgtacataggtgaacatctgggacatccggcaaaagaactgattcgccggatgacgcttgaagaggcagccgcagaaacatttgaatatcccaattgcctgattttaactacaggtgacggactgcaatctgtaaacggaggaatactctcccctcgcttcttcggcatccccgacgaagcattcgaactgcttgacggacgtgcccggatgatcaccaaagcccctatccgcctgctcaccttgagtgccttggaactaaaccgacggacttctttctgggatatcggcttctgcaccggctccgtctctatcgaagcccgattacaatttccccatctgcatgtcacatcttttgagatccgccccgaaggcaagcgactgatggaaatcaacagccggcgtttcggtactccgggcattaccaccgtcatcggtgactttcttgaaacagataccgccatttatccctgtcccgatgcagtttttatcggcggacatggcggacggctgaaagaaatcatatcccgggtccggcataagcttcttcccggagcacgcatcgttttcaactccgtatccgaagaaagtaaaacgcatttcatcgaagccgccaacgaatccggactttgttttctcggcggaacaagagtcgcaataaatgaatataatccaatagagatcctggtggcttcagctccggactctccttatctataa

SEQ ID NO: 573 - DNA, 1899 bp, B.fragilis
atcgcccgccatcccgctggggaaaagattctcttccatccccaccacgaatacgttgcggaactccagtcctttggcggaatgtaccgtcatcagagtcaccttctcgccgtctccctccttgtcggaatcctgatcggtgagcagggatacttcggagagaaagtcgatcagagaaacgttcgtgttcccctcttcctgacgcatggcacaaaaatcattcataccgttcaccagttcctcgatgttttctttccggctgagattttcgggcgaattgtcctggcagacttcattgatgatgccggactgacggatgatttccgtacctatttcataagcattctttacggtcacatctgccataaactgctcgatcagcgcacgaaaatcctgcaatttggtatgtgtacctttattgatggaaagcccgtacgtaatgggttcgcagagtgcggtccagaggctgacattgttatcggtggcggcagtaataatcttgcccaccgtggtatcgccgatgccgcgtgccggataattgataatccgcttgaacgcctcttcgtcattggggttgaccaccaggcggaagtaggctatgatatctttgatctccttgcgctgatagaaagagaggccgccgtaaatcttataaggcatgccccgtttgcgcaaagcctcttcgaagacacggctctgggcattggtacgataaaggatggcgaagtcggagtattcataatcgtgctcgcgacgcagttgcgctattttattggtcacaatgtcgccttcttccacatcactgtaagcctgaaagaccccgatggcctcaccccgttccttctcggagaacacctctttggggatctgccgctcgttcttttcgatcaggctgttggccgcacggacaatggtctgggtggaacggtagttctgctccagcttgaagactttggtatcgggatatatcttggtgaaatacaaaatattgtcaatgtccgctcccctgaaggagtagatgctctgcgcgtcgtcgcccaccacgcatacacgctgattctcctttgtcagttgcagcacgatgctgtgctgtgcatagttggtgtcctgatactcgtcgacaagcacatagcggaactgctcgcgatagcgtgccagcacgtcgggaaagtcgcggaaaaggatataggtatagaccagcagatcgtcgaaatccattgctccggcctgccggcaacgctcccagtagcggctgtagatatcccgtatggcaggcatctttgcggcaagatcgccctcgtacgcctccttgttggctgcgtatcccgaaggagacaccaggtggttcttcgcattggagatgcgtgcctgcacactgccgggcttataggtcttctcgtcaagccccatctctttgatgatggaacgaatcaggctcttgctgtccgccgaatcgtagatggtgaactgcgacgtaaagccgatatgggacgcctcggcacgaagaatacgggaaaaaaccgaatggaacgtacccatccaaaggaatcgtgcacgctgctcgcccacctgccgggcaatacgctccttcatttcacgggcagctttgttggtgaaagtcagtgccaggatattccagggattgtaaccgttctcgagcagataggctatcttataagtgagcacacgcgtctttccggaaccggcaccggcgatgaccagcgaagggccatcaccgtagagcaccgccgcacgctggctttcattaagttcttcgatatagtcgggcataaaatttatctgttaaatctctattcacgggcaaagatagaggaaagtttggacaactccgaacatttggcccctatatcctgttatatattcagagaaatgaaataa

SEQ ID NO: 574 - DNA, 312 bp, B.fragilis
ttcggcttcctttttttgtttactgtttaccgttgcttcaagataacagttagggataatagcagtattccagccactgcgcagtcagatggaggaatgttgttgaactatgacgatacggaaaaccgcacttatttgaggttcaccgggtatccacctctcataacacagttgaataatataggtaaggagggatatatcaatgtgatagacaccaagagtgtattgaaggtcagtccctcaaataatcaaattgaggttgctccatttgaagattatgatgcgcacaccacccgttgtgtacaggaatag

SEQ ID NO: 575 - DNA, 207 bp, B.fragilis
acacaattcctattatctatttatttcaaatatcaaatcagcaaatattataagatttaccatcattgggctaccggaaaatttttgggatattataaatgctcctattaccagagccggtattatagatgccgggtggattcccgaagttacaattcttggagatttatgtcgacaaatgagtcatatctgttcagatccatatga

SEQ ID NO: 576 - DNA, 723 bp, B.fragilis
aatattgctaaaacgatgataacagtttgtatggctacctataatggagagaaatatattgaagaacaattagaatcagtactaatgcaattgcattccaatgatgaagttattatttctgatgatggttctggcgatagtacagtagacttgattcgaaccttcaatgaccctcgaataaggcttttagtcggtaataatttcttttctcctactcaaaactttgaaaatgccttaaaatatgcaaaaggcgattatatatttttatgtgatcaagatgatgtttggcttcccgataaagtagaaagtatgctgcaatatttgcttcaatatgatttggttgtgtcggattgtaaggtggtggatgcggaattgaatgtaatttctcagtctttttttatggggcgttcgtcaggaaaaggtttttggaagaatttaattaagaacacttatttggggtgctgcatagcatttagaaaagaagtattaggttacatattaccttttcctagaaatatagcgatgcatgatatatggataggattatctgttgaaatgcatagtaactctttttttctgcctcgtcaactaatactatatcgaagacatggctcaaatgttagttttggaggggaaggaagtaaatactcgttaatgtataagataaagtatcggttgtgtatgcttttttatttattaaaacgaaaatatttgaataaatga

SEQ ID NO: 577 - DNA, 207 bp, B.fragilis
gctcgtcataatactccggaagttcgcggaccaacatcacaccttccttccagaatatcgcatgatttctataaaaaggttcgggataccgcaaaaacaataaatcattcagaacaaacaactaacactattagttattcgactaacagcataaattatttacctaatcttagcaggagattagaaaacggaccttattacaggtga

SEQ ID NO: 578 - DNA, 1230 bp, B.fragilis
tccatacataaaattaatatcatggagaagaatattttcaaactggacaatgaacaactgaaaggaatcgcacacgcattccgggagaaagtggaagagggattaaataagaataatgctgaaatacaatgtattcctacctttattttacctaaggcgaccgatgttaaaggcaaggctttggttctggacctgggaggtaccaactatagagtggcaattgtcgatttctcaaccgaaaagccaatcatctatcccaataatggttggaagaaggatatgtcgattatgaagtcgcccggttatacccgtgaagagttgttcaaagagttggccgacttgattgttgaaataaagcgggaagaggaaatgcctatcggttattgtttttcttatccgaccgaatcgataccgggaggcgatgcaagattgcttcgttggaccaagggggtagacattcgggaaatggtgggacagtttgttgggaaacccttactcgactacctgaatgaaaaaaataaaatcagatttacaggagttaaagtgctgaatgacacgattgccagtttatttgccgggcttaccgacaaaagctatgatgcttatattggcctgattgtagggacaggtacaaatatggcaacttttattccgtctgacaagataacgaagttggacccggaatgtcacgtacaaggcttgattccggtcaatctggaatcgggaaacttttatcctcccttcctgactgcggtggacgatactgttgacgcaacttctgacagtttgggtaaacagcgttttgagaaagcggtatccggcatgtatctgggagatatcctgaaagcagctttccctttggaagaatttgaagagaaatttgatgcaaggaaactgactgctattatgaattatcctgatatacacaaagatatctatgttcaggtagcccattggatctataacagatcggcccagctcgtcgctgcctctcttgccggattaatcgcattgctgaaatcgtataatcgagatatccatcgggtttgtctgattgccgagggcagtcttttctggagtgaaagtcggaaagataaaaactataatatccttgtaatggagaaattgcaggaacttcttcgtgagcttgaactggaagatgtcgaagttcatattaatagtatggataatgccaatctgataggaacggggattgcggcattatcctga

SEQ ID NO: 579 - DNA, 249 bp, B.fragilis
ataagacataaagctacaatgataaatcccatacaactcaaaagcaccaatacagctagtatcttagaaaatgatttatccaattctttaaaatctcgtaatgacaccaatttagacaaattgggtactttagtgtatatccagttcattgaaacagatgagaccccgtttatcacacttaatgtcattccaagttgcccagcagcagcactacctattgtggcaaacagaatcggattgaaaaactga

SEQ ID NO: 580 - DNA, 1320 bp, B.fragilis
gaaaatagtaacaagcacaaaatgattaaacaatatttcaagcaggcccttgcacaactcagacagcagcccttgctgactacgatcagtgtgttgggcactgctttgaccatttgcctgattatggtagtggtcatgcaacagcaaataaaaaccgccccttttgctccggagagtaaccgtaaccggctattgcatgtcaaacagatgagcacgagcaacaaaaactggagtgatgacggatcgagtaacggtccgatggggctgcagacagcaaaaggatgttttgaaggattaacgacggccgaggaagtcagtatctatacgatacccgaaactatgcaggtggctttgccccgtggtgtacgtacggggatcgatgccctcgagaccgacggagctttctggaggatattcgacttttcgtttatagacggtaagccttattcggatgcggaagtaaaatccgggcttccggtagctgttataacagagagtgtcgcacgtcttcttttcggtacgtcccatcaggtgtccggcaaggagatcttggtgaatgatgcggtctaccggataagcggagtggtgaaagatgtgtcttcaatggcttcgacagcctatgcacagatttgggttccatattcatcaacccatattacgggaggagacaatacctggtgtgacgggattatgggagtgatgcgagtggtgatcctggcccgcagttcttccgacttcgaagctatccgtgcagagtgcgaacgtcgccgcttggcttataacgccgggttgggtgattattttgttttctaccgtgggcagccggatgaccaactgacgatgtctcagcataaatgggcaaatgtgcagccggatatggcagcctattttcgtcaacaagtcattatatttttgattctgttactggtacctgccatcaatctgagctcgatgacccatagccgtttgagacaacgcgttgccgagatcggtgtacggcgtgcgttcggagctacccgtgggggagtgatggggcaaattgttgctgagaatctggtactgactttgatggccggagtggtcggactgttgttctgtctgatcatatcttattgttggggaggtacgctttttgccgatagcagattgatgtaccttaacacggctccggttatcgagtggaaaatgctttttaaattttctacttttatttatgcattacttttctgtttggcactgaatctgctgagtagtggatggccggcctggagggcatcgcggatgtctattataaatgctcttagcggaaagcttaactaa

SEQ ID NO: 581 - DNA, 288 bp, B.fragilis
ttgttcttcaatatatttctctccattataggtagccatacaaactgttatcatcgttttagcaatattttattacatatatatattacccataccaacatcgtattgaacgcattaaaaaaacaccccatcaatatacaaaagacaactaccccccatgagattatgtattccggacaattctttttctcatacctttcgaataacataacagcaatcattccatatagacaattaagaacaacaacccctgcatatccaaaatcaagatatggatctgcgatataa

SEQ ID NO: 582 - DNA, 579 bp, B.fragilis
agaaaactcaaaaacaaaaataggatgactgcaacggaaaggacagcggaataccggaaagcactcgatgtgcctatctcccaactggagacggaccggattgtaaaagaaatcctggatcgaccggagaacttcgacaacatttaccggctgacgtcggacgataaattattggtgtcctggcgggccttatggatatgcgacaaactgtgcaggcagaagccggagtggctgatccctttcagggaagagctgaccggaaggttgatgtcctgcgggcacgatggctcgaaacgactgcttctttccatactctaccatgcacccgcaacgaaggtgccttccgtggctctgctcaacttctgcctggacgccatgctgtcgccccaagagagtatcggcgtgcaatcgctcgccatccgaatggcttaccgcctgtgcgagcccgagccggagttgctgtatgagctgcgtaccatactggagagtacagagaccgaaatgtattcgaccgccgtaaaatcggctgtacggaacacattgaagaagattaaccagaagaataaaaagaaaaaataa

SEQ ID NO: 583 - DNA, 801 bp, B.fragilis
aatgaactcaaaacaagatcagaaatggaaaagttaatcattgcgggacgtgaattcaactcccgcctcttcctgggaacaggtaaattcagctcaaacgaatggatggaacagtcgatactggcatcgggcaccgaaatggtgacagtggccatgaaacgtgtcgacatggagagcacagaagacgacatgctgaaacatattgtacatccgcacattcagttgcttcccaacacatcgggcgtacgcaacgcggaggaagcggtgtttgccgcacaaatggcacgcgaggctttcggaaccaactggctgaaactggagattcatcccgacccgcgctatctgctgcccgactcggtggagaccctgaaagcgactgaagaactggtgaaactcggattcgtcgtgctcccctattgccaggcagatccggtgctctgcaaacaactggaagaagcgggagccgccacggtaatgccgctgggagcacctatcggaaccaataaaggactgcaaaccaaggagtttctgcaaatcattatcgaacaggccggtatcccggtagtggtggacgccggaatcggagcaccgagccatgcggcggaggctatggaaatgggtgcatcggcatgcctggtaaacacagctatcgccgtagctggcaacccgatagaaatggcaaaagccttcaagcaggcagtagaagccggacggacggcatacgaggccggactgggtatgcaggccatagggttcgtggcggaagcaagctcaccactgacggcatttttaaacgaataa

SEQ ID NO: 584 - DNA, 330 bp, B.fragilis
aaaaacgccaacactaaaacgcaacatcctatcacagaatccattaaagaaaaaagaggcagaaaaacaggagcgcagataccgggaattatctccaacaatgaaggagttataaaagcgctgatagaatcctacatattggacgcaaaagaacaaaatatcaagacatgcaaagattcgttggcacgctacatagaggaaaaagaactttttgggaaaatgagaaatggagtattcaaaccattagttttcagcacaatcaggaattacgtcaacgaaatctggaataagatggaaagaaagaaaaagaaccaagaaggaaagcgctga

SEQ ID NO: 585 - DNA, 1281 bp, B.fragilis
  unsure (1074),(1086): Identity of nucleotide sequences at the above locations are unknown.
aagaaaaacaagagacatgacatccttatgaaaaatatttttaaagatttaaaaagtaaagaccacaaacgctatctgggaggtttggacgtcttcagatatattggtcccggtttattggttactgtaggttttattgatccgggcaattgggcttctaattttgcggcaggttcagaatttggttactcactgttatgggtggttacgctgtccaccatcatgctgatcatattgcaacacaatgttgctcacttgggaatcgtgacagggctttgcctttcggaggcggcaacgcagtatacgcccaagtgggtatcgcgtcccatactggggacggccgtacttgcttccatctctacatcactggccgagattctgggaggggccatagcgctggaaatgttgctcgacattcctattgtctggggggccgttctgactaccgtttttgtttccatcatgctttttacaaattcatataagaaaatagagcgctccatcattgcttttgtatcggtgatcggcttgtcgttcatctatgaactctttttggtggatattgactggcctatggcagtagaagggtgggtgacgccggctatacctaaggggagcatgctcattattatgagtgtgctgggtgctgtggtgatgcctcacaatcttttcctacattcggaggtgattcagagccacgaatacaataagcaggatacagcgtccataaagaaagtgttgaagtacgaattgtttgatacgctcttttcaatgattataggatgggccatcaacagtgccatgattctgttggcagccgctaccttctttaaaagtggcattcaggttgaagagctgcagcaggcgaaatcattgctcgaacccctgttgggaagtaatgcggctattgtttttgctttagccctgcttatggcgggtatctcgtctacgattaccagcgggatggcggccggatctattttcgccggtatctttggcgaatcataccacattaaggatagccactctcaggtaggggttatcctgtcgttgggcattgcattgctactgatnttcttatcggcngatccgtttaagggtctgatcatctctcagatggtgctgagtatccagttgccgtttacggtttttttgcaggtcggtctgacctcctcgcgtaaggtgatgggcgattatgtcaatagtaaatggagcacgtttgtgctttataccattgccgtgatagtgacagtgttgaatataatgttgttgttctcgtaa

SEQ ID NO: 586 - DNA, 288 bp, B.fragilis
atgaacgacaagccgatcaccgatacaaaagcaatgatggagcgctctattttcttatatgaatttgtaaaaagcatgatggaaacaaaaacggtagtcagaacggccccccagacaataggaatgtcgagcaacatttccagcgctatggcccctcccagaatctcggccagtgatgtagagatggaagcaagtacggccgtccccagtatgggacgcgatacccacttgggcgtatactgcgttgccgcctccgaaaggcaaagccctgtcacgattcccaagtga

SEQ ID NO: 587 - DNA, 1347 bp, B.fragilis
aattgcttaaatctaatattatatatacctattatgacagttttacgttcgatgaaggatttctcgtcgatgaatattacggcgagtattctattgtttgtcacagcgattgccgctgcggtaatcgctaactctccggcagcatcggtgtatcaggagtttttgtcgcatgaacttcattttcgcatcggaggctttaatttactttcgcatgcgggacacaatctgacgatgattgagttcattaatgacggtctgatgacgattttcttcttaatggtcggactggagattaagcgagagttactggtaggcgagctttcctcgttccgtaaagctgcactgccattcattgccgcatgtggcggaatggtagtgcctgttgtcatctattccatggtttgtgccccgggcactgaaggcgggcaaggactggctatccctatggcaaccgatattgccttttctttgggagtgctcagcctgttgggcaagcgtgttccgttgagtctgaaaatcttccttacagcgtttgcggtagtcgatgatataggcggtatattggtgattgccattttctacagttcacacgtggcttatgaatatttgttatgggcggcgctgctttacgtcctgttatattttataggtaagaagggagctaccaataagattttctttttagttgtcggtgtggttatctggtatcttttcctgcaatcgggtatccatagtacgatttccggtgttattctggcctttgtcattccggccaaaccacagttgaacgtcggtacatatattgagcgtatccggcgcattatcagtacattccccgaaatgggagcaaacaacatcgtactgaccaatcaacagatagccaagctgaaagaggttgagtcggcttccgaccgtgtcatcagtccccttcagtcgcttgaggataacctgcatggtgcagtgaattatcttgtccttccgttgttcgcttttgtcaatgcaggtgttatgtttagtggcgaaggtgaagttattggcggggttacccttgcggttgctttgggattattggcaggcaaatttctggggatttattcttttacctggctggctgtcaaaagcggtcttactccgatgcctttggggatgaactggaagaatatatccggagtggcgttactgggtggaataggctttacggtatcgcttttcatcgccaatctttcgttcggctccgcccatcctgtattattgaaccaggccaaactcggtgttttatccggtacggtaatggcgggtatcttgggatacctggttttgcattgggtcttgcccaaaagaagataa

SEQ ID NO: 588 - DNA, 1014 bp, B.fragilis
cctaacctaaacattatgaagtattttgtaccactctttctcagtctattttttttagtttttatgtcctgtggcaatgaagacaatgcttgggataataatatccctattattactcctaatgaacaatctgattcctcaggactattaaagagccaaataactgacatcattaattattccaaaatcaattttgatgaaaactttaataatacagaactttataagaacttgattttaagccctaaatgggaaaatgtttctatggttcttcagaaacaagacacactccatttatgtgttcctctgctagcacaggacaatcctgaacacaattcctattatctatttatttcaaatatcaaatcagcaaatattataagatttaccatcattgggctaccggaaaatttttgggatattataaatgctcctattaccagagccggtattatagatgccgggtggattcccgaagttacaattcttggagatttatgtcgacaaatgagtcatatctgttcagatccatatgatgaagcttttcttgagttcctacacagcaaatggcttaaagaacatggcaatgaaagttcctcggatagttcttcatctggtggcgattatagtcggctgactgaagcagaaaagcgcttccttatgcgacatccacaagtaattaaaaaatttcatgataacgcaagaaaagctagtgaagcagctaaaaaatttccaggacagcacaatggagagggcgatgcggtaagacatgtttattggagtgctctcaacacgctttcagaaaatgcaaatctggcaaaagagttcggtgatgcacatgaacaaaatccgggacaagatattgcagagaagaatatggatctatttaataactccattggttatcaactgggagatctagcaaaacaaaataaatggtcagaagaacgtttatttaaggaaataataaaatataaaaatgatggaaaattacaaacaaaattacatccataa

SEQ ID NO: 589 - DNA, 429 bp, B.fragilis
attttatcaaaccggaatacattcgatccgacttacctttggggcgataatttatctattaaccctttaaatcatatacgtatgaaacagaagaaaagaccggcatcacaaactgaagccatgaaactgagatggaaaaaacggattgtctttgagaaaggatacactgaaatgtgtgccgaatggatggcggagcgcctggaagcgttgaccgaccatctgcaatacgggcacgcagccatcgcttatcagaagcagaacggagacttcaggttggtgaaagcgacactgatctactatgaagcggaattccacaagaagtatgatcccacaaaaatagaaggcgcagtagtctactggaatgtggacgaacagcgatggacgacattccaggtggagaacttcatggagtggagaccgatcgtatag

SEQ ID NO: 590 - DNA, 2484 bp, B.fragilis
aaacataaaaaacttaatgatatgaatatctcttataattggctgaaagagtatgtcaatttcgatctgacgcccgatgaagtggcggctgcgctgacttctatcggactggaaacaggtggagtagaagaagttcaaacgattaaaggcgggttggaaggtctcgtgattggcgaggtgctgacttgcgtggaacatcccaattcagaccatttacacatcacaaccgtaaatttgggtaacggcgaacctactcagattgtgtgcggagctccaaacgtagctgccggacagaaagtcgttgttgccactttgggcacgaagctctatgatggtgacgaatgttttactattaagaaatcaaagattcgcggcgtggagtcgatcggtatgatatgtgctgaagatgaaatcgggatcggaacttcacatgacggtatcatcgtattgccggaagatgccgtaccgggtactcttgcgaaagattattataatgtaaagagcgactatgtacttgaagtagatattactccgaaccgtgctgacgcttgttcacactatggggtggcacgcgacttgtatgcttatctggtacagaatggcaaacaggctgcactgaccagaccgtctgtcgatgcttttgctgtcgaaaatcatgatctggatatcaaggtaactgtagaaaacagtgaggcatgtccacgttatgcaggtgttactgtgaaaggggttactgttaaagagagtccggaatggttgcaaaataaacttcgcatcatcggtttgcgtcctattaataatgtagtggatatcacaaattacattgtgcatgctttcgggcaaccgcttcattgctttgacgcaaacaaaataaaagggggcgaggtgattgtgaaaacaatgccggaaggcacaacgtttgtcacgttggatggcgttgaacgtaagttgaatgaacgtgatctgatgatctgtaacaaagaagacgctatgtgtattgccggtgttttcggaggtcttgattccggttctacagaggccacaacggatgtgtttctcgaaagtgcatatttccatccgacatgggtgcgtaagacggcccgtcgtcatggcttgaatacagatgcttctttccgttttgagagaggtattgatcctaatatcacgatctactgcctgaaattggcggctatgatggtaaaggaacttgccggaggtaccatttcttcggagattaaagatgtctgtgctgctcctgcacaggattttattgtcgagttgacttacgagaaggtacacagcctgattggtaaagtgattccggtagagacgataaagagcattgttaccagtcttgaaatgaaaatcatggacgagacggccgaagggctgacattggccgtacctccataccgtgtggatgtacagcgtgactgcgacgtgattgaagatatcctgcgtatttacggatataataatgtggaaattccatcgacactgaagtcgagcctgactacaaaaggagattgtgacaagtcgaataagttgcagaacctggtggctgaacagttggtaggttgtggtttcaacgagattctgaataactctttaactcgtgccgcttattacgatggtttggaaagttatccttccaagaatctggttatgttgctgaatccgctaagtgcagatttgaattgtatgcgacagacactgttgttcggtggattggaaagcattgcccataatgctaaccgtaagaacgcggatttgaaattctttgaattcggtaactgttatcactttgacgcggagaagaagaatcctgaaaaggttttggctccttactcagaggattatcatttgggactgtgggtgaccggtaaaatggtatcaaattcatgggcacacgcagatgaaaacacttctgtctacgaattgaaggcttatgtggagaatattttcaaacgtttaggattggatttgcactctctggtagtgggcaacctgagtgatgatatttattctacggccttgacggtaaatactaaaggtggcaagagactggctacattcggtgtcgttaccaagaagatgctgaaagcttttgatgttgataatgaagtctattacgctgatttaaactggaaagagctgatgaaagcgattcgttcagtaaaagtaagctataaagagatttctaaattcccggctgtgaaacgtgacttggctctgttgctggataagaaggtacagtttgccgagattgaaaagatcgcttatgaaacagagaagaaactcttgaaagaggtttctttgtttgatgtttacgaaggcaagaatcttgaagccggaaagaaatcttatgctgtcagcttcttgcttcaggatgaaagccagactctaaacgataagatgattgataagatcatgtcgaaactggtgaagaacctggaagacaaactgggagccaaactcagataa

SEQ ID NO: 591 - DNA, 192 bp, B.fragilis
tcccacaaaaatagaaggcgcagtagtctactggaatgtggacgaacagcgatggacgacattccaggtggagaacttcatggagtggagaccgatcgtataggacgccaccacagattacacggattttcacagatgaatgatttctattttgaggaatcaagtgaagacatctttgggaatccggggtaa

SEQ ID NO: 592 - DNA, 579 bp, B.fragilis
aacgtaaaaaataagcttatggaacatatcattcatttactaatcggtttcatcgttttaagtttccttctcaaaaccggtttctatccacgatggggaatctggttgtcagcacttgtctatacggttttccttatttgtataggtccatgggctacggaacaatcgccaacagagataaactctctgctggcctctgccccacacatactgaccctttcagtatatgtcacgctcgaagcctcaataatgatcgctttttgtttcaactgttttgcagacacctcaaaacagcggacacttttccaacggacagttacatacatattgaatttttatcccggactgctaatggcgggcatactaacctatctgcttatacagttgttcttcgcttttccgggagtcagcttcggactgatcaccggcatctcttcagttgctgtttttatactgatatccggactgagcctactcttgaaaaacatagtaggagaacggaaattacgacttgaaatactcttcatcaccaatctgtttatcgtactgcttagtgtcgttagcacaggaaacaactaa

SEQ ID NO: 593 - DNA, 723 bp, B.fragilis
gagaacggaaattacgacttgaaatactcttcatcaccaatctgtttatcgtactgcttagtgtcgttagcacaggaaacaactaaagaaataacaattataaatatggaaacaatatcaaatgcgcttttctggatatccaacgggctacttgtcccggtagtagttctgttgttactattctttgcgcgtgctgtactgcttgcaggcggcttcttcggagaattttatcgtagggtacatactcaaaaatctcttgccgagcagttggaagaactgactcccgacaatatcgaagaaaaagcaaattcccttaccggagacagaagtacccccctgcaacgctgtgtatacaagctttatacgcatcgggacaatgcagcttattgtgagcgattgcttgctaactttgaagtagatgccgaacaagaattgggacgttcacgtacatttgtcaagctgggtcccatgctcggactaatgggtacattaatcccaatgggtcccgcacttgtaggtctggccacaggagacattgcttcaatggcctacaatatgcaagtagcatttgccaccactgtagtaggtatggttatagctgctatcggagtggtcaccctgcaaatccggcaacgttggtatgcccgtgaaataaacgaccttgaatttatcagtaaaaccctaatccatggcacgaaacaaacttctacacaaccagaatga

SEQ ID NO: 594 - DNA, 948 bp, B.fragilis
tgctgcttgaacttaaataaaaaaatgaatatgaagagaatcaaacgaactccggccgagaaggcccgtgcacaatataccggctatctggtgaaagaaccgatggaattaatggatttccttgcggccaaaatgcccgatgccagccgtaccaagctaaagtctctgttgagcaaacgaatcgtgctggtcgacaatgtgatcacaacacaattcaactttcctctgcaaccaggcatgaaggtgcttatcagcaaggacaagaacaagaaagaattccgccatccgctactgaagatagtctacgaggacgcctatatcatcgtagtggagaaaaaggaaggattgctttccgttggcacagagcggcagaaagaacgtactgcccagcatattttaagcgaatatgtaggtcgttcgggacgcggaaaccgcatctacgtggttcatcgcctggaccgggatacttcgggattaatgatgtttgccaaagacgaaaagacacaatacacgttgcgtgaccattggcacgacatcgtgacggaccgtcgctatgtagcggtggttaccggcgagatggagaaagacagcgacacggtagtgtcctggctgacagaccgtaccttgtacgtcagctcaagcagctatgatgatggcggttccaaatcgatcacccactatcgcaccatcaaacgtgccaatggctactcgctggtagaattgcgattggaaaccggacgtaagaatcagatacgtgtacacatgcaggatctggggcatcctctgatcggagacggacgttatgggatagacggtgggcccaatcctctcgggcgcctggctttgcatgctttcaaactttgtttctatcatccggtgacagatcagctaatggagtttgaaaccccttaccctcctacattcaagaagctatttctgaagaaataa

SEQ ID NO: 595 - DNA, 1806 bp, B.fragilis
aaatatatgaaaacagccattattgtcatatcagaagccggcatagcactggccaagacactggaacaggaacttcccgaatcagagatcttttctaccggcacagacacagattgccactctatttccaatcttcaggaggccgttcctgagatattccataaattcgatgctattatcttcatcggagctatgggaatttgtatccgtgccattgctccccatattgaagacaagcataaagatcccgccgttgtctgtgtagacagcacaggacgttatgctgtctctgtcctgtccggacatattggtggagccaacggactgacccggtatgtggcaagcattctgggagccgaacctgtgattaccacccggagtgaccgtaccggtctttgggccctcgatactcttggcaaaaaatacggttggcaaacagtcccggccgaatcatcagatatgaatcatctgatcacactctttgtagattgcaaaccaacagctctattactcgacattcgcgacgaaggcacaacacagttggaacataccttgcctcctcacgtcgatgtattctacaaatttgaggatatggatctccggaaatatgacttgctcctgcttgtcactccatttatttacaacacctctgacactccggcactctactacgtcccaccggtattgcatatgggagttggactggcccgcgatgcccatccggtggataccgtcattacccatctgatggatgttgtggtgcaagccaacatgatccctcttgccatacgtaccgtatcttccattgaagaaaaaaaagacgaaccggtgctcaaactacttgcagaggcttatcagacccggctttacaccgccagtcaactcagcaaaatagaggtgcccactccaagtgaagtggtcaacaagcacatgggtactcccagtgtatccgaagcctctgccctactctcttccggaggcggtcccttactcctgcccaaacaaaaaggcgctaactttactgtagccatcgccatggacgccgcctccgtacgtcaggggcacatcgaaattgtcggagccggtcccggcgatccggagctgatctccgtacgcggacgtcgctttctcgaagaagccgacctgatactttatgccggcagtctcgtcccccgcgaactgacagaatgtgccaaagccggtgctaccatacgcagttcggcttccatgactctcgaagagcaatttgccttgatgaaagagttttatgaccgtggacagttggtagtccgtctgcatacaggcgacccttgtatctatggtgccatccaggagcaaatgaatttcttcgaccaatatggtatgcattaccacatcactccggggatctcttcatttcaggctgccgccgctgctctccaatcccaattcaccattccggagagggtacagaccatcatcctcactcgcggtgaaggtcgtacaccgatgcccgagaaagagaaactcagcctgctggcacgttcgcaaagcaccatgtgcatcttcctcagcgcaggcgtagtcgatcaggttcagcgagagctcctcgagcactatccgcccactacacctgtagctgcctgttatcatctgacctggaaagacgaacgcatctttcgcggacaattacaggatttagctaagatcgtaaacgaaaaccatctgactctgactaccatgattgtcgtaggcgatgccatcgataatcgggaaggactgtcacgactatattctcaccaatttaaacacttattccgtaaataa

SEQ ID NO: 596 - DNA, 489 bp, B.fragilis
caagatatgaactatttagaatcagaaatctccgctctttatgcttctgctcatgaactttgctatctgggcatggacggtcggccgatctacagtgatcaattcacccgtctgaatcgtgatgttttttctcaggctaatgctttgtacgacaagcatggtgatagtgatgaagaagaggcccggttgtgtctgtcgctcctgatgggatataatgcgactctctataataacggtgacaaggaggagcgtatccaacatattctggatcgttgctgggatgtactggaacatctgcctgcctctctgctgaaagtccaactgctggtttattgttacggagaggttttcgacgaggaattggcccgggaagctcaggctatcatcgatacgtggcaggacagagagttgtcggaagacgagcgtgaggtgatggaacgcctgaaggatgtgcaagagaatccgtatccttggagtgaggtggagtga

SEQ ID NO: 597 - DNA, 411 bp, B.fragilis
gaagaaatgaaaggctattggaagattttactgatactgatgctcgctgtcggattcgcgtcttgcgaggacgatcagggagagattgaatatgtcattaccgggcgggcatggaccggcgatgtggggatgaatgcccataatggtgaacccctgttcagtacctttgagttcgggaacgacggttttggagtggagacccagttctatgcttcagacggtcttttgtatgatcagtttcgctttcagtggtattgggaagattcttataatcgtaatttagtattgaattacggtaagaacggtatctcttatatggacgacgtaaggatatacggagatcggataaccggtgccttttatctttcggacgatgcccggggatttaactttgaattaaggatggaataa

SEQ ID NO: 598 - DNA, 3981 bp, B.fragilis
gatatatcgaacgaaaatgcagaaagaaaacaagaagataacatgaaagtattgaccttatttcgtcataaaagaacactgtacatagccggaagcgtattgcttctggctattgcctttactatcggctaccgctattggatggccccgacacggatcctgattgtcaatccgctaccggcacaagctgccgacatagtattgaacaacgatagccggaatatagaagttacttgcatacaaaccgaaaatttggagtcctttaagggctatgatgccgtagttctctatggacgcagcctcaacctgaacgatcgacaaatgaaggaggcggaacgtgccgcatcggccggtattccacttttcacgatttcactgcgtaacttcaatacaattatcaacaggaatatcacccctgagcaggaagccatgcttatgcaatatttcggggatgcctgccgacagaattaccggaacggattacgttatctccgacacattgccacaccgacacgctggaacattgaaacttttgatgcccctcttcgcctacccaacaatctattttatcatcaagaatatggaaaatacttcgagactcagaaagcccttgaacaatacctgcgtcaaaaaggtattttccatgaaaacggacctaaaatcgctttcatctccggagtcagttttccaatggaaggtaacagagcacatgtagacacattaatatccaaaatgacacaagccggatttaatgtttatcccatagcaggaaaggaaaagcgggaagagatgctacgttctctacatccggatgcattggtttaccttcccatgggaagacttggagatgattcgctgattaactggctgcataccgaaaacatccccattttcaatcctttcccccttattcagtcacgggaagagtggcttgatccgatgaaacccgtcagtggcggaacccttacagctcgtgtcctcgtccccgaaatagacggaggaatgacacctttgttaattgctacacagaatttacacaaaagcggatattatctgcacgaaccggaaatggaaagagtggataacttcatcagccatgtacacaaatatctggatttacgtactaaacccaactcggataaacgtatcgccatctgttacttcaagacaccgggcaaagatgcattattggccagtggaatggaagtgattccgtcactttacaactttctgaaaaggctacgcaccgaaggttatgatgtcagcgggcttcctgctactgtcgaggagttcggcaaacaaatctaccgggatggagctgtaatgggttcatacgctaccggagctcaagaaaagtttctacagacagcccatccggtttggctgactaaaacacagtatgaaaagtgggtacatgaagtaatcgaaccggataaatacaaagaagttactgaacgttacggagatgctccgggccatttactgaccggaacaaaccctcaaggagaagcacaattagccattgcctgcctccgcttcggcaacatcctgcttttccctcagccacgtcctgcattgggggacgatgatttcaaacttgttcatggcatgccggtcgcaccgccacacagttatctggcaccttacctatatgtacaaaaagggtttcaggcagacgcgttaattcacttcggcacgcatggcaaccttgaatatactccagggaaaaatgtagccctttctcataatgattgggcagatgctttggtaggcgacttacctcacttctattattatactaccggtaacgtaggtgaaggtatcattgccaaacgtcgcactcatgctgtgcttgtcacccacttgactcctccctatgtggaaagcggaatgcgtcaacgatacacttctttactggaagacattcacaaaatactttccgaagacatagagaaaaaccggactttgggaatccgcataaaaaaagaggtcataaagttggggctacatcgtgacctcaaattagattctgtatccagtcgtccttataccgccgaagaactggaacgtattgatctatttgccgaagagatagccaatgaaaaaacgattggagcttattataccctcggtgaaacctattctgcgagagacctgcttaccaccacacttgcagtcagtgccgatcctttagcctatcaaatggcgaaacgtgatcgcgataaaggaaaaattacgaccgaacagttacaagattttggctacatcacccatcactatttacccatagccaaacaacggttaatccccttgttacaaaatccacctaaggataccacagggatcgcccccgaattgcaagaggcactccgttatcatgcgcttttagtttcatccaccggtaacgaattgaacgccatgctacgcggattaaaaggtggcacagtatttccggctcccggtggagatccggtactcaatccgaatgtcctgccgacgggacggaacatgtatagtatcaatgtagaaacaactccgggcatattgtcatgggaagaaggcaaacgattggcagaagccacactgaaagcctatcgtgagaatcacagcggaaagtatccacgaaaagtaagctactctttttgggccggtgaatttatcacgaccgaaggggctacgctggcacaagtattctggatgttaggcgtagaacctgtacgcgacaaaatgggacgtgtggtcgatctacgcttagtgccttcctcagagttaggccggcccagagtcaacgtcgtcgtacaagtgtcgggacaactacgtgacatagcgggttcccgactgactatgctaaccgatgccgttcgccttgtttcggccgcagacgacaaagcataccctaattatgtctcttccggtacacgcttgcaggaaaaactgctggtagaaaaaggagtatcacccaaaagagcacgtgagatgtcagtcatgcgtgtatttggtcctgtcaacagcggatatagtaccggtatgatggcatatacggaaaagagtgaccgatgggatcatgaatcggagttagtagacggatatctgaacaatatgggagccgcctatggtgatgaagaggactggggaggtatgcaaaaagacctttttgcttccgccctttccgaaactgatgtagtgatacaaccccggcaaagtaatacctggggaccactttcacttgaccatgtatacgaatttatgggaggtctgtcgttgacagtgaagacactgaccggtaaagaaccggatgccttaatggctgactatcgcaatcgaaacaacaaacggatgcagaatatcaacgaagcaatcgctgtagaggcgagagctaccgtgctcaacccaactttcgtgaaagaacggatgaaaggaggtgccaccaccgcgcaaatgttcggtgaaatattccgtaatatcttcggatggcatgccacccgtccatcggcaatggataaagagatcttcaacgatctctataaaatgtacattgtagatgaaaaccatttgggtatccgggactatttccaaagaattaatccggcttcttatcaggcaatgacctcagtcatgcttgaaagtgcccggaaaggatactggaaagcgagcgacgaacaattgaaagtaacagcccgactacatgcgcaaatcacccgcgaagccggtgccgcctgtacagaatttgtatgcgataaccgaaagcttcagcaatttgtagaaggtcacttggacaacaatgactctgaaagttatcgtctggttatgcaagaagtccatcaggcaggaaacgaaaaaggaaaagatatcgtattgaaagaggagaaactcacgaaaacggaaaaccggaaaaagaatgtggtaaatggcatccttaccggcgttattgttcttttagcattcggtggagtaatatacctgctgaaacgtaaaaaataa

SEQ ID NO: 599 - DNA, 522 bp, B.fragilis
ttagttgccgacaaagatacttttttaatatttttgcaagaaataaaaaaatataaaatgacaaaggaagaaaggataagccgtgctactgagcttttcaagagcggctataattgttcgcagtctgtagtagctgcatttgccgatatgtatggatttactgaagagcaggcgctgcgtatggcagcttcgtttggcggaggtatcgggcgcatgcgtgaaacatgtggcgctgcctgtggcatgtttctacttgccggactggagaagggggcaattgacggagccgatcgtgagggaaaggctgccaattatgctttggtgcaagagcttgcggccgaattcaagaaacgaaatggttcgttgaattgtggcgaactgcttggtttaaagaagaaagcaccggtgtcgtccgagccggaagcccggacagaacagtattatgccaaaagaccttgttcgaaaatggtagaggaggcagccagaatttgggcagaatatctcgaaaaagagaagaaatag

SEQ ID NO: 600 - DNA, 288 bp, B.fragilis
gcggaaaacgagactcgaactcgcgaccctaaccttggcaaggttatgctctaccaactgagctatttccgcaatgtagtgcccagaacaggactcgaacctgcatgcctctcgacacacgcacctgaaacgtgcgcgtctaccaattccgccacctgggcattgactaatcagaaacctgccgttaaaaaaaatggagaggaacagataaccgacgttcttgttgagcggaaaacgagactcgaactcgcgaccctaaccttggcaaggttatgctctaccaactga

SEQ ID NO: 601 - DNA, 1812 bp, B.fragilis
cgcatcaaagataacgttaataatgtatacaatgatacaagaatagatcgtttaacaaaacactttcttgcacaggctgtttttaatgagaaattaaacctaaacaaattaactatggattggattgtacatcaacttagggtacaccccgagctggctatcttcctgaccctttttgtgggcttttggattggaaaaatcaaaatcggaaagttcagcctgggagttgtaacaagcgtattgctggtaggagtccttgtcggacaactcgacatcaccgtcgacggacctatcaaatctgttttctttctgctttttcttttcgccatcggctataaggtcggtcctcagtttttccgcggactgaaaaaggacggactccctcaaatggggtttgccgccatcatgtgtgtattctgcctgatcatcccttggatactggctaagattatggggtataatgtaggtgaggctgccggattactggccggatcgcaaaccatctctgccgtaatcggcgtggccggagacacgattaacgaactgaacatctctccggaaaccaaagaagcatataataacattatcccggtgtcctatgccgtaacttacatcttcggtacggccggctctgcatgggtattgggttcactcggcccgcgactgctggggggactcgataaagtgaaagctgcctgcaaagaactggaagccaaaatgggaaataacgaagcggatcaacccggattcatggcagccgcccgccccgttactttccgtgcttataaaatagccaacgagtggtttggtgacggcaaacgggtgtcggatcttgaaagttattttcaggaaaacgataaacgcctgtttgtggaacgagtgcgccaggcaggagtcatcgtaaaagaggttagtccgacttttgtactgaagaaaggcgatgaagtggtactgagcggccggcgcgagtatgtgatcggtgaagaggactggatcggtcctgaagtattggacccgcagttgctggacttccctgccgaggtattacccgttatggtcacccgcaaaacggttgccggagaaaaagtcagcaccatccgggccctgaaatttatgcacggtgtcagcattcgccgcatcaaacgggcaggtatcgacataccggtattggcccagaccgtggtcgacgccggtgacatggtggaactggtgggtaccaaacatgaagtggatgcggcagccaaacaactgggatatgccgaccggccgaccaaccagacagacatgatctttgtcggactgggtattttgataggaggactgatcggcgcactcagcattcacatgggaggagtccccatcagcctcagcactagcggaggagccttgatcggcggattattcttcggatggctacgcagcaaacaccctactttcggacgtattcccgaacccgctctctggatactggacaacgtggggctgaacatgtttattgccgttgtgggcattgctgcaggtcccagcttcgtgcaagggttcaaggaagtgggtttaagcctgttcatcgtaggcgcactggccacttccattcctctgatagcaggcatactgatggcaaaatatatctttaaattccatccggcactggtattgggatgcacagccggcgcacgtaccactacggctgcattaggagccatccaggaagccgttgaaagcgaaactcctgctttgggatatactgtgacgtatgctgtcgggaatactcttctgattatctggggagtagtgatcgtattacttatgtag

SEQ ID NO: 602 - DNA, 1788 bp, B.fragilis
tatcagatggataaaatcagaaatttttgcatcattgctcatattgaccatggtaaatcaacattggcggaccgtttgttggagttcactaataccattcaggtgacagaagggcagatgcttgatgatatggacttggaaaaggagagggggattacgattaaaagtcatgccatacagatggagtacacttataagggggagaagtatattctgaacctgatcgatactccggggcatgttgacttttcatacgaagtatcccgctcgatagctgcctgcgaaggtgcgttactcattgtggatgcgtcgcaaggagtccaggcacagaccatctcgaatctttatatggctattgagcacgatcttgaaatcattccgatcattaacaagtgcgacatggcaagtgccatgcccgaagaggtggaagacgagatcgtagagctgctgggatgtaagcgggatgaaattatccgtgcgtccggtaagaccggtatgggtgtggaagagatactggcagcggtcatcgagcgtatacctcatcctcaaggtgatgaaagtgcgccgttgcaagctttgatattcgactccgtattcaactcattccgtggaatcatcgcttattttaagataacgaacggagtcatccgtgctggtgataaggttaagttcttcaataccgggaaagagtatgttgcagacgaaatcggagtgttgaagatggaaatggttccacgcaaggaactccggacgggagatgtaggctatatcatttcgggaattaagacttcgaaagaggtgaaagtgggagatacgatcactcacgtagcccgcccttgcgataaagcgattgcgggattcgaagaggtgaagccgatggtgtttgccggagtttatcccatcgaagccgaagaatttgaagatctgcgagcttcacttgagaagttgcagctgaatgatgcctcactgacgttccaaccggaatcatcgttggccttaggcttcggtttccgttgtggcttcctgggattgcttcacatggaaattgtacaggagcgtctggatcgtgagttcgatatgaatgtcatcaccacagttcctaacgtatcttatcatatttacgacaaacaaggtaatatgacggaggtgcataaccccggcggtatgcccgatccgactatgatcgaccatatagaagagccttatatcaaagcttctattattacaacgaccgattatatcggacctatcatgacgctttgtctcggtaagcggggcgaattgttgaagcaggaatatatctcgggaaaccgcgtcgagttgttctataatatgccgttgggtgaaattgtgatcgacttctacgacagactgaagagtatttcgaaaggttatgcttcgttcgattatcatccggatggtttccgtccgtccaaattggtgaaactggatattttgttaaacggtgaatcggttgatgcgctttctaccctgactcacttcgataatgcttacgatatggggcgtcggatgtgtgagaagttgaaagaactcattccgagacaacagtttgaaatagctattcaggccgctatcggtgctaagattatagctcgtgaaacgatcaaagcggtgcgtaaagacgttacggcaaaatgttacggaggtgatatcagccgtaaacgtaagctgcttgagaagcagaaaaaaggaaaaaaacgtatgaagcagatcggtaatgtggaagtgccgcagaaggcattccttgccgtgcttaaactggattag

SEQ ID NO: 603 - DNA, 717 bp, B.fragilis
aataaaagggaatttatggaaagatacagcagacaaaccatgcttccggaaataggagaagcaggacagctaaagctaaaagctgccaaagtactgattgtaggcgtgggaggactcggttctcccatcgccctctatctggccggcgcgggagtgggtaccatcgggttggcagatgacgacgaagtgagcctcagcaatctgcagaggcagatactctacacggaggaggaagtgggcgacctgaaggctatctgtgcctccatgcggatcagcgccctcaacagggagataaaagtgaatgcctgtccgggaaggctaagtaaagaaaatgcacgtgatctgataggccagtatgacatcatcgtggacggttgcgataactttgcaacccggtatctgctcagcgatgtctgttcggagctcgggaaaccgtatgtatacggtgctatctgcggatttgaaggacaggtgtccgtcttcaactacggagaaggaactcaacggaaaacttatcgtgacctctacccggacgaagaaggaatgttacacatgcctcctcctcccaagggggtggtcggagtgacaccggcagtaacgggcagtgtggaagcatgcgaagttctcaaaatcatttgtggattcggagaggtcctggcaggcaaactatggacaattgacttgcggacattgcaatctaacatattttcactataa

SEQ ID NO: 604 - DNA, 447 bp, B.fragilis
caaatgacacttatgaagacattgaattttatgaaaacgctattcttattggtagctatagtaggcctaagctcttgtggtgacaagtattattcagatgattatctacgaaatagcaatgcaaagctctgtggcaaaacctgggtaaatgattcggagaagaatgatgtagacgagtgggttcggcatacattgaagtttgatgataacggccggctggcagagacttatgcctattatcatgtaaatgaaagtcagccttaccgcacggagaccaataatctgacctggtcgtggatagacgatacgatggaaggtattgtttttgactatggagtgaacggggtgacttatttcgataacgtgtgggtacgtgagcataatctgtccgggaagctgaacggaaaggtagttgtatttgtcgattcaaaatataacagaaactaa

SEQ ID NO: 605 - DNA, 1779 bp, B.fragilis
atgccggtttggagtatactatcacttattataaaaaacaacatgaaagtatctgactatataatatcgtatatcgagtcccggggagtacatgtcatattcggatatataggtggaatgatcacccatctggtcgattctgtttctcagaatccgaatatgcaatttattcaaacttaccacgaacagaccgctgctatcgctgcagaaggctttgcgaaagaatccggactttttggagttgctatttcgaccagtggtcctggagctactaatatgatgacgggtattgctgacgcatattttgactctattccggttctttatataacgggtcaggtgaatacatatgaatacaaatatgataagcctgtccgtcagcaaggttttcaggagacggatattgtaagtatggttaagtccgtcactaaatatgccaaattgatagataaggctgaagatattaaatatgaactggataaagccttatatattgctttgtcgggtagaaaagggcctgtactgctggatctgccaatggatatccaacgggaggaaattaatcaggaaacattgatcggatattccggtgagagtattttaaataatcctttgatagcctgggaggaaatcaggttattaatggagtcgtcccatcgtcccatgttgcttttaggggcaggatgttgcaattcggatatggttttgctgaatgatttcataagacggcaccatttcccggttattacttctttaatgggtagaggggctattgatgaaacatacgataattacattgggatgataggcagttatggtaaccgttgtgctaacatgggagttgccaatgccgatttgttgattgcattaggaaccagattggatactcgacagaccggtgcccggttggatcaatttttatcaaatgggcacatcattcatgttgatattgatgacaacgaactggaatatcatcgtttattgaatcgtaaaaaagtgaattgtaccattgattgctttctacagaaggaaaaagaaatgccgatttctttaggggacatttcagagtggaattttttcctgcatgggctcaagcaacgatatggtcaggatgcagaaatagagcgttttgttgaaaacaaatctccatatcgcttcatgcagtattttgattctttgactcaaaccgacgatgttatatgtgcggatataggtcagaatcaaatgtgggcggctcaaaccttacggttaaaatccgggcaaaaatttgtaacaagtggcggacttgccccaatgggcttttcattaccggtagccatcgggtgttcgtttgccaatccaaataaaaaagttttttctataaatggtgatggaggttttcatatggctatccagtctttgatgcttatttctcaatataatcttcctattaaggtaataatattgaataatgcttctttaggtatgattactcaatttcaacatttgtattttgatgatcgaatgtgtggaactactttgaatggaggctacagagtgccggatattaaatctctctctacggcttatggcttaccttattttagattgactgttgatcggttggatgatcctgatttgcgggaagagatgcaggcagcccacaactgtattattgaatgtgtggtagaaggcttgactagtgtttctccgaaattggaatatgataagcctatttccaagcctttacctttattgccagaagaagaatataaggagaatatgctattagaggcttga

SEQ ID NO: 606 - DNA, 789 bp, B.fragilis
cgggcagtgtggaagcatgcgaagttctcaaaatcatttgtggattcggagaggtcctggcaggcaaactatggacaattgacttgcggacattgcaatctaacatattttcactataaaggttggtttctgattaagttaattagtaactttgctaaacttaacagtttaacaaaagaaatgaaacttatcgtagtaacgacgcctactttctttgtagaagaagataagattatcactgctctttttgaagagggactggatattctgcatctcagaaaaccggaaacaccggctatgtattcagagcgcctgttgacactgattccggagaaataccacaaacggattgtcacgcacgaacacttctatctgaaagaagaattcaacctgatgggaattcatctgaatgcacgaaatcccaaagaaccgcatgactattcgggacatatcagttgttcgtgtcactcggtggaggaagtgaagaataaaaagcacttttatgattatgtattcatgagcccggtttatgacagtatctcgaaagagggatataactcaccctatacagccgaagaactgcgcctggcagccaaagacaagatcattgacaacaaggtgatggctttgggaggtattacgccggataacatactggaagtgaaagatttcggattcggaggtgcagtagttttaggagatttatggggcaaattcgacgcttgctccgaccaggattacctggcagtgatagaacacttcaagaagctgaaaagaatggcggactga

SEQ ID NO: 607 - DNA, 330 bp, B.fragilis
tccatggcacgaaacaaacttctacacaaccagaatgatactgacccgatgggaacagtagccaacttattcgatgtagccatggtttttgctgtggcattgatggtagcactcgtcagccgattcaatatgaccgaaattttctccaaagaagattatacgatggtaaagaatcccggacaagagaacatggagattatcacaaaagaaggtaaagagattaaacgatatactccatccgaacagaaagaatcatccggtaaacgaggaaagaaagtaggtgtagcctatgaactcgagaatggaaagatcatttatgtccctgaataa

SEQ ID NO: 608 - DNA, 924 bp, B.fragilis
tttcgatctagtaatttaattttaataagtatattgatgaaaggtattgtcttggccggtggttcgggcactcgcttatatccgatcaccaaaggagtcagtaagcagttgcttccgatatttgataagccgatgatctattatcctatctctgtactcatgttggcggggattcgtgaaatattgattatttccactccatacgatttacccggctttcaacgtttgctgggtgatggctctgactttggagtacgttttgagtacgccgaacaaccttctcccgacggtttggcacaggcatttatcattggtgagaagtttataggtggtgattctgtatgtctggttcttggcgataatatcttttatggacaaagttttacccgtatgctgcgtgaagcagtccatacagccaaatcagagaacaaagcaactgtttttggttattgggtcagcgatcccgaacgttatggggtagctgagtttgacaaggctgggaatgttctcagcatcgaagagaaacctactgttcctaagtccaattatgccgttgtgggtctttatttctatcctaataaagtggtggaagtagccaagagtattcagccttcccctcgtggagaattggaaatcacgacggtcaatcaacggttcctgtccgatcgggaactgaaggtccagcttttggggcgcggctttgcctggttggatacaggtactcatgattctttgtccgaagcaagtacatttatcgaggttattgaaaaacgtcagggtttgaaagtggcctgtttggaaggcatagccctgaggcaaggctggatttctcctgaagagatgaaagcattggcaggtccgatgctgaagaatcaatatggacaatatctgttgaaagttatcgatgaattatccataaagtag

SEQ ID NO: 609 - DNA, 1437 bp, B.fragilis
tataattcaaggagtactgtggctagaaagaaaaaagaacttcctctgctggagaaggtaacaataacggatgtggctgccgaaggaaaagccatcgcaaaagtagatgacctggtcgtttttgtaccttacgtagtgccgggcgacgtggtagatttgcaggtaaaaagaaaaaagaataaatacgccgaagctgaagcggtgaagtttcacgaactctcaccggtacgtgccgttcctttttgccagcactatggcgtatgcggcgggtgtaaatggcaggtattgccctacgcagaacaaatcaaatacaaacagaaacaggtggaagacaacctccgccgtatcggaaagatcgaattgccggaaatctctcctatcttgggatctgctaaaacagagttttaccggaacaaactggagttcaccttctcgaacaaacgctggctgacagcggaagaagtgaaacaggacgtcaaatatgaccagatgaacgcagtaggattccacattccgggagcattcgacaaggtgctcgccatcgaaaagtgctggttgcaggatgatatctctaaccgtatccgcaatacgatccgcgattacgcctacgagcacaactactctttcatcaatctccgttcgcaggaaggaatgctccgcaacatgattgtacgtacctcgagtaccggcgaactgatggtgattctgatttgcaagataacggaagagcatgaaatggatctcttcaagcagttattgcaatatgttgccgaccaattcccggaaataacctctctcctatacattattaataataaatgtaacgacacgatcaatgacctcgatgtacacgtattccgtggcaatgatcacatcttcgaggagatggagggacttcgtttcaaggtgggaccgaaatcgttctatcagaccaactcggaacaggcatacaatctttataaggtggcacgcgactttgccggactgacaggtgacgaattggtatatgacctctatacgggtaccggaaccatcgccaactttgtgtcacgccaggcacaaaaagtgatcggcatcgaatatgttcccgaagccatagaagatgcaaaagtgaatgccgagatcaatggaatagagaacaccctgttctttgccggagacatgaaagatatcctgacacaggatttcatcaatcagtacgggcgtccggatgtaatcatcaccgaccctccccgggcgggaatgcatcaggatgtggtagacgtaatcttatttgccgaacccaaacggatcgtatatgttagttgtaatccggctacacaagcgcgtgacctccagttgctggatgtcaaatatcgtgtgaaagcagtgcaaccggtagatatgttcccccacacccatcacgtggaaaacgtagtgctgcttgaacttaaataa

SEQ ID NO: 610 - DNA, 507 bp, B.fragilis
tataatccaagcagtaatacaaggtttattgcatttatagaatataattatcaaaacatgaagtttaatagaaaggaaaaaacttttattatgaagaaaacttatttatggacggccatgctttgcacggcaatagcattttcggcatgcaaatccaataaagccggacaggacaccgcaagcgaagcaaagactgaagaagcagttataccgggaagtgataaagacgaacacggttgcgtcggctctgccggatacgtatggagtgaagtgaagaaagattgtattcgtcccttcgaagcaggactgaaaatcagcgaaacccaaaaagacaacgctacttacgccacttacattgtatttgctgccgactctgtgcaagcagaactctacacacccgagtctgaaggaagtatcctgctcgaacgtgcggacaaccaatggaaaaacgatacgatcagcgtcagttgcaagaacggtcaatggagcatttctaaacagaaataa

SEQ ID NO: 611 - DNA, 945 bp, B.fragilis
ccagataaaagattatttattgaaatgaagatattattgacgggggcgactggttttttaggatcgcatattgcagaagccttgctggcaaacgatgttaacctgatgataactaaacggtcaatgtcttcgttgaacaattgtacctctttcattgatcatgtacaagtcataaactcggataaccctatctggatatcccaagcttgctcttttagccctgatattattattcattcagcctggacgggggtcctgtctggcaatagatacgattggccggtccaactgtctaatattgactttatgaattctttgctttatatagcagagaaaagtaacgtttctaaatttatagctttgggtagtcaggccgaatatggggattttgatgggatagtctctgaaaatgccggcttgtttcctgtcaatagctatggatacgtgaagtccatggtttcccggatggttggttctttctgtgatttacgtgggattgattggtactggttaagagttttttccgtatacggagagcgggagtcaaaccaatggctgatccccggtcttttgactaatatgcttgacaatatggctggtatggatctgactttagggcaacaacgctacgcttatttatatgtgaaggactttgccaatgccgtaatgaaagtatgttcagggaaaactccctgcggtgtctataatttatcatcttctactgcgatcgaattaagagtacttcttgaacatttgagagatagattaaatccggcttttgagttgcgttttggtgcgttgccctatcgtgccggtcaaccaatgttggtgcaaggtgatgtgtcgaaatttgtaaagtcgtttgggcactttgagaatacaccgttaaatgccggtttggagtatactatcacttattataaaaaacaacatgaaagtatctga

SEQ ID NO: 612 - DNA, 261 bp, B.fragilis
cgaaggcgaagagtaatgaaatacgtttataaaacccagggtacttgcagcacaaacatcgaattggaggtggagaataatattgtgaaggaagtagctttttggggtggatgtaacggtaatctgcaaggaatttcacgtctggtgaccggaatgcctgtgtcggatgtcattacgaagcttgaagggatccggtgtggggctcgctctacttcatgtcccgaccaactatgccgtgctttgcacgagatgggtttctaa

SEQ ID NO: 613 - DNA, 618 bp, B.fragilis
cctatgttgagcctacaatttatcacccatcaaacagagaattactcctatctggaatcggcgcgcatggctctcgaagggggctgtaaatggatccaactgcgcatgaaagaggcatcgccggaagaggtggaggcagtggcactgcaactgaaacctctctgtaaagctaaagaagctatcctgattctcgacgaccacgtagagctggccaaaaagctggaagtggacggggtgcacctgggcaaaaaagacatgcccatcggcgaagcccggcagatgctgggcgaagcattcatcattggcggaacggccaatacctttgaagacgtaaagctgcattatgccgccggagccgactatctgggcataggccctttccggtttaccaccactaagaaaaatctgagcccggtactgggactcgaaggctacacctccatactggcacagatgaacgaggccggtatccggataccggtagtagccatcggagggatcgtagcggaagacattccggccattatggaaacgggggtgaacggcatcgccctctccggagcaatcctgcaagcaccggacccggtagaagaaacaaaaagaattctaaacatataa

SEQ ID NO: 614 - DNA, 894 bp, B.fragilis
tattgggttggctattgtataataatagagctgaatttcaaaaaaaatacgtattatatgagtaatcaaagagaagctggaataacagcttttttacctgtatataatgaagaaaaacgccttaaaaatgtattggagtgttttcagtggtgtgatgaaatcttgttattagataaaggaagtgttgacgatacggtaaaaatagcaaaacaataccctaatgtcacggttttaacaaaagagcataccgaaaaatatgattccaatgaaattgaatattttattaagaattgtacaacagagtggtgtatgattgttacagcaagtgatttgattcatcccaaattggcgcggaacatgaaagaacttataaataactgtaatttcgaatatgatattgtctctgtaccgtataaaccatattttctaggttgttgtgagaagtattctccttggtatacagagcacatgaataagatttttcgggtaagtgtattgaatcttaatctcaactctgtacatgctgttttaactcctacatcttcccgcttgtatcagattcctttcactgatcctaaagttgcttattatcatttgactcatcaaagtgctgagagtattatagaaagaaatgtaagatattggaaaggagaggcttcttcttcggaacccttatccctaataaataaaatcataataaggactgtgcttcgttttgtttttttgcgaggtgggttgttcaaaggacggcaagctttagccttattttattctttcttaagctattatatgatgacttatgtatgtaaatgggaataccagaatggagaagtagaaagtatatacactgctttgcaaaaggagattgttgatctttggagtaaacctaaataa

SEQ ID NO: 615 - DNA, 360 bp, B.fragilis
gcgaacaatgggcattgggcgttgagcttcagttcaaccatgaaatacaaggagcatatctcgacaaacacatttgccattgctccttacgcacgtttttcttattatgaaaacaagatcgtacgtctgtttgtcgatggcggatttggttttgctaccactaaggtgaaagatggcggtgatgctgtaaacggtttcgagatcggtctgaaaccgggtatcgctatcaagttgaaccagcatttcagcctggttgccaaatgtggcttcctgggatataaggacgattatatgggtaacggttttggctttagcgcaagcagtgaagaccttacattcggattccattacgaattttaa

SEQ ID NO: 616 - DNA, 291 bp, B.fragilis
gtgtgtttggggataaatgaaagtaaatacaaagaggggtgcgtgcgggaaaaagaaaaaacggaagaaatacacaatcccttcggcagtactaactgcatcaggttcttagggtataatctcagccaccgggtggcacccctttgtctttacggaggcaaagtaagtgaaaaagaaaataagaagaaagtaaatcggggattatttcatcgcggagtcatgcggaatttgtttttgccctttctcaaaactcaccataaaaaacacagagtaacacagaggcgattttag

SEQ ID NO: 617 - DNA, 357 bp, B.fragilis
agacaaaggggtgccacccggtggctgagattataccctaagaacctgatgcagttagtactgccgaagggattgtgtatttcttccgttttttctttttcccgcacgcacccctctttgtatttactttcatttatccccaaacacacctatacgaatatgaaagtacaagtgaacaacaaagaagtggaaacagccgcaagcacactggcccagcttgccacccaactgcaacttcccgaaaacggtgtagccatcgccgtcaacaaccgaatgataccgcgtccgcaatgggacggattcgggctgcaagagaatgataacctgattgtgattaaagcagcctgcggaggatag

SEQ ID NO: 618 - DNA, 2730 bp, B.fragilis
aatcgtattatggacaaaaaaagagtttatacctttggtaatggactggcagaaggaaaggccggtatgcgaaacttacttgggggcaaaggtgcgaaccttgccgaaatgaatctgatcggtgtccccgtacctccgggcttcacaattacaactgacgtttgtaccgaatattacgagatgggacaggaaaaggtcgtatctctcctgaaagaagaagtcgaaaaagctattgcaaatattgagaacctgatgcgttcaaaatttggtgacgtagagaatccgttgctggtttctgtgcgttcgggtgcacgtgcatccatgccgggtatgatggatacgatcctgaacctgggtttgaatgatgaagtggttgaaggtctgacccgtaagaccggaaacgctcgttttgcatgggattcttaccgccgttttgtacagatgtacggtgacgtagtattgggtatgaaacctgttaacaaagaagaccaggatccgtttgaggcgatcattgaagaagtgaaacatgccaaaggcgtgaagctggacaacgagctcgaggtggaagatctcaaggaactcgtgaagaaatttaaagctgccgtaaaggcacaaacaggcaaggacttcccgacttgtgcatacgaacagctttggggagctatctgcgctgtgttcaattcatggatgaacgaacgtgccatcctgtaccgtaagatggaaggaattcccgatgaatggggtactgccgtaagtgttcaggcaatggtgttcggtaacatgggcgatacttccgcaacaggtgtatgcttctcccgtgatgccgctacgggcgaggacctcttcaatggtgaatatctgatcaatgcacaaggtgaagacgtggtggcgggtatccgtactccgcagcagatcactaagatcggttcccagcgttgggctcagcttgccggtgtgagcgaagaggaacgtgcatcaaaatatccttctatggaagaggctatgccggagatctacaagcagttggatgaattgcagaccaagcttgaaaatcactacaaagacatgcaggatatggagttcaccgttcaggaaggcaaactttggttccttcagacacgtaacggtaaacgtaccggtgctgccatggtaaaaatcgccatggatctgttccgccagggcatgattgacgaaaagaccgcgctgatgcgtgtagaacccaataaactggatgaattacttcacccggtattcgataagtctgctttgaaacaggctaaagtgctgactcgcggtttgccggcttctccgggtgctgctaccggtcagatcgtattctttgctgacgatgcagccgaatggcatgctgccggaaaacgcgttgtgatggttcgtatcgagacttcacccgaagatttggccggtatggcagttgccgaaggtatcctgaccgcccgtggaggtatgacctcacatgcagccgtggttgcccgtggtatgggtaaatgctgtgtttcgggagccggtgcattgaatatcgactacaaggcccgtacagtggaagtggatggtgtattgctgaaagagggagatttcatctccttgaacggtagtaccggtgaagtttatcagggtaaagtagaaacgaaagcagccgaactgtcaggcgactttgccgatctgatgaagttggctgataaatatacccgtctgcaggttcgcaccaatgccgacactccgcatgatgccgaagttgcccgtaatttcggtgcggtaggtatcggtctttgccgtacggaacacatgttcttcgaaggtgaaaagatcaaagccatgcgtgagatgattctggcagaaaatgctgagggacgccgcaaagctcttgccaagatcttgccatatcagcaagccgacttcaagggaatcttcaaggcaatggccggttgtccggtgactgtacgtctgctcgatcctcctttgcatgaatttgttcctcacgatctgaaaggacagcaggagatggccgatacaatgggagtaagcctgcaatatatccagcagcgtgtcgaatcgctctgcgaacacaacccgatgttaggtcaccgtggttgccgtttgggaaatacgtatcccgaaatcacacagatgcagactcgtgccattctgggtgccgctcttgaactgaagaaagaaggaatagagacacatcccgaaattatggtgccgctgacaggtattctttacgagttccagcagcaggaaagtgtgattcgtgccgaagcagacaagctctttgaagaggtgggagaccgcatcgacttcaaagtcggaaccatgatcgaaattccccgtgcagctctgactgccgaccgtatcgcttcgtctgccgagttcttctcgttcggaaccaacgacttgactcagatgactttcggttactctcgtgacgatatagcttctttccttccggtttatctggagaagaagattctgaaagtagacccgttccaggtactcgaccaaaatggtgtaggtcagttggtacgtatggcaaccgaaaaaggccgtgccatccgtccggacctgaagtgcggtatctgtggtgaacatggcggtgagccttcatctgttaagttctgccataaagtaggtttgaattacgttagctgttctccgttccgtgtgcctatcgcacgtctggcagcggcgcaggcagccatcgaagaataa

SEQ ID NO: 619 - DNA, 1419 bp, B.fragilis
attatcattatgaaacaatccaaaattatcgtagccggcattgggccgggaagcgaacaagatatcactcctgccgtgctcgccgctgtacgcgaagcagatgtagtggtgggatataaatattatttccgttttatacgtgattttgtccgtccggacgccgagtgtatcgacaccgggatgaaacgcgaacgtgcccgcgccgaacaggctttcgaatatgccgaacaaggaaagaccgtttgtgtcattagctccggagatgccggtatctatggcatgacacccttgatttacgaaatgaaacgcgaacgtcagagtaacgtagagatcattgccttaccgggaatcagcgctttccagaaagcggcctcactacttggtgcaccgatcgggcatgacttctgtgtcatctctctatcagacctgatgacaccatgggaacgtatcgagcgccgtatcctcgctgcagcccaggccgactttgtgacggctgtatacaatcccaagagtgatgggcgctattggcaaatttatcgtctgcgcgaaatctttctgcgcgaaggacgctcaccggaaacccctgtaggctatgttcggcaggctggtcgtgaagaacaggaaatacacatcaccactctcgccgcattcgatccggaaactgtggatatgtttacggtcgttctgattggtaactcacaaacatatacatttaaccaaaacataattactccacggggatactatcgcgaaacacgcagtgaagcaaccggtatcggacaagacatcatgatacgcagtttccgcaccatcgagacggaattgaagaaccgtgatattccactcgaccggaaatgggccttattgcatgctatccatacgacagccgacttcgagatggaacgtttgctttacactgatcccaatgctgtggcctctctctatgacgccatccgcacaggaaatctgcggactattgtaacagatgtaacgatggcagcttccggcatccgtaaaggtgcattgcagcgtctgggtgtagaagtgaaatgttacttgaacgatgaaagagtagccgaaatggcaacttcaaaggggatcacccgtacacaagcgggcatccgcctggctgtggaagaacatcccgatgcactctttgtctttggtaatgcccccacagcactgatggaactttgtgatctgatccggaaagagaaagcgcaaccggcaggtatcgtagccgctcccgtagggtttgtccatgtagaagagtcaaaacacatgacaaagcccttcacccgcatccccaaactgattgtggaaggacgcaagggcggaagtaatctggctgccaccctggtaaatgccattctttgctatcccgatgcggaacaactcagacccggaagagacgtatag

SEQ ID NO: 620 - DNA, 591 bp, B.fragilis
agtagaatttttattccaatgaatataataaaaacatcaattgaaggtcttgttatccttgagccccgtctgtttcaggatgaccgtggctactttttcgaatccttcaatcagggggagttcgaatcaaatgtatgtcaaacgacttttgttcaggacaatgaatccaaatcgagctacggtgtcattcgcggtctccattttcagaaacctccttttgcccaaagcaaactggtacgggtaatcaagggtgcagttcttgatgtggctgtcgatatccgcaagggttctcccacatttggaaaacatgtttcggttgaattgacagaagacaatcaccgtcagttttttattccgcgtggcttcgcacatggttttagtgtgctgagcgaagaggtcatcttccaatacaagtgtgataatttctatcatccggaagctgaaggggcgattgcctggaatgatccggatttgaatatcgactggaagataccacaagaccgggttatattgagtggtaaagactacacacatcctctgttacataacatagaattacagtttgatataaacaatacattatatgagtaa

SEQ ID NO: 621 - DNA, 423 bp, B.fragilis
tcaatgatttttatggcaacaacctttgacatacaattgccacactatccacgtggcttccatctgatcacccgtgacatcctttctctccttccggacctgccggaaaacggactgctggttgtgttcatcaagcatacctcagcaggcatcactatcaacgaaaatgccgatccggacgtgcgtcatgacttcaatacgtttttcaacaaactcgtacctgacggtgccccttatttcgtccacacccttgaaggcccggacgatatgagcgcacacattaaggcttcactaatcggaacctcagtcagtatccccatccggaatcaccgtctgaacctcggaacctggcaagggatctacttgtgtgaattccgggacgggggcgacaaacgcaaactgagtattaccattttggagtaa

SEQ ID NO: 622 - DNA, 471 bp, B.fragilis
ccgggaggtatgcttcgctactccggtgtccccaaagaacatcctgacgtgaacgacatgacaacatccgcatctatcgagtcttcgatggagcgctctcaatctatcctatcttcttccgctttgaactggtatgccttgcgtatcacttacgggcgtgaactggctttgcaggagtacctcaattcggaggggatcgagaatttcatccccatgcactacgaatataccattaaaaacgagcgtcgggttcgtaagcttgttcccgcagttcataatctggtttttgtccgttcctcgcgtagttgtatcgatgccattaaagaaagcaggagcgccacgcttcctatccgttacattatggatcgtgaatatcatcgtcccatcatcgttcctgattcccaaatgcgtaatttcatggctgtctctgcgaattatgatgaatccttgctttatttcgaacccttttga

SEQ ID NO: 623 - DNA, 1311 bp, B.fragilis
tcgttaatcatcaatcacatgtcagtaaagggattcttcttcatacttgttttcttcttggtcgctatcatgggttttctgatttatatatccgaaactgttgtcgtgaagtatctctatattgccgaagcattgatgctgctcctgatgctgtatcttattttgttttaccggaaaatcgtgaaaccgatgaacaccatcggcagtggtatggaacttctcagagaacaggacttcagtagccggttaagccatgtggggcagcaggaggccgaccgtgtggtaaatgttttcaatcgcatgatggaacaactgaaaaacgaacggctgcgcttgcgagaacagaatcattttctcgacctgatgattaatgcttcccccatgggagttattatcatgacgctggacgaagaggtatctcaactcaatcccatggcgatgaagatgatgggggtccgtccggaagaagccgaggggaggaaattgtcggaaatcgattctccgcttgccctggaattggccgccattccgaatggagcaaccagcaccgtccggctgaacgactcgagtatctataaatgcacccactcttcatttgtggaccgcggcttccagcatcctttctatctgatggaaggattgaccgatgaagtgatgaaagctgaaaagaaagcatacgagaaagtgatccgtatgattgcgcatgaggtgaataatacaacagcgggcatcacttccacattggatacggtagagcaggcattgtacgagtcggaaggtatggaggatatttgcgatgtgatgcgcgtatgtaccgagcgttgtttttctatgagccatttcattacccgctttgccgatgtggtgaagattcccgagccccgttttactccgaccaacctgaatgaccttgcatttacctgcaagcgctttatggaagggatgtgcaatgaccggaacatccggttgcaactgatatgtgacgaatctctggacgatgtgaagctggatgcgtctctgtttgaacaagtattggtaaatattattaagaatgcagccgagagtatcggacaggacgggcagatcatcattcgtacttcattgcctacagctatcgaagtggtggataacggacccggtatatcaaaagagactgaagcaaaactcttcagtcccttcttttctaccaaacccaacggacaaggtatcggtttgatttttattcgcgaagttctgagccgtcatggctgcacgttttcattgcgtacatacgccgacggactgacaagattcaggattctatttccgtga

SEQ ID NO: 624 - DNA, 291 bp, B.fragilis
gtgtatttaattaaaactactaagaagatgaaaaagattgtattgtttttatttgttgctattgcaactttatctgttaaggcacaagacctttacatgggaggtaccgtaggtttgtggcgtaatgatgatgccaataccacttcctttaaactggctccggagatcggatacaacctgagcgaacaatgggcattgggcgttgagcttcagttcaaccatgaaatacaaggagcatatctcgacaaacacatttgccattgctccttacgcacgtttttcttattatga

SEQ ID NO: 625 - DNA, 462 bp, B.fragilis
aatataaaaatgatggaaaattacaaacaaaattacatccataagccatatctgtttttagcaatcttattttctttgcttagttgccaaaaagaggtggtatcaaaggtaactttcgaaagaaagttatcaggaataaaaccagaaaccgaatttagacttgattctctgagaaatgataaatggcaaaaatgctatattattccaccgtatcaacagtacaattctgcattaaataggataaagttgagaaagcatgatttaaataaaataaaggaaaatgcaatctctgatggaataaatacatttgtgtttataaataacgatggatcaatatcaatagaaacagtttcaagatctatcattgatattcaagacacattgtcagactccatatttcttttttatcccacaacaataatgaaaatggatagtaaaagaaaaattatagacataaaataa

SEQ ID NO: 626 - DNA, 1188 bp, B.fragilis
acaataaaaatgagaaaagttctgtctttttcggcctttttgattattggccttttgctatcacaatacttgccgttattggcaggtgaaggatatgctaccgtaaaaattgtatctaacattcttctttacatctgcctgagttttattatgattaacgtagggcgtgagtttgaagttgataagacccgttggcgaagttatgccggagactacttcattgcgatggctactgccgccatgccttggttcctgattgctatctattatgtatttgtgcttttgccgccagaattctggaacagttgggaggcttggaaagagaatctgctgttaagccgtttcgcagctcctacatcggccggtattcttttcacgatgctcgcggctattggacttaaatcaagttggatttataaaaagattcaggtcctggcaatttttgatgacctcgataccattttgttaatgattcccctgcagataatgatgattggtttgcgctggcagctgatcgtggttgtctttattgtcttcttattgctttcattgggttggaaacagttgggaaggtataactggcgtcaggactggaaagcgataatgggctattcggtgcttgtatttgttgctacccaagccgtttactattttagcaagcagctctatggcgaagaggggagtattcacatcgaggtgttgttgccggcttttgtgctgggtatgatcatgaaacacaaagaaatagatactcctgtcgagcataaagtttcaacaggggtttcgttcctgtttatgttcttggtaggtatgagcatgccgcatttcattggggtgaactttgccgagacacatgccggaacccattcggtgacaggttcgcaggaaatgatgtcgtggggaatgatagcacttcacgtattgattgtttcactgctttcaaatatcggtaagctgtttcctgtgttcttttaccgggataggaagttcagcgaacgcctggcgctttctatcggtatgtttacccgtggtgaagtaggagccggagtcatctttattgccctcggatacaacttgggtggtcctgcattggttatttcagtgctgaccattgtattgaatttgattctgaccggtatctttgtactatgggtgaagaagttggcattgcgaagctatacaacttag

SEQ ID NO: 627 - DNA, 936 bp, B.fragilis
tctaaaaaaataaatatggcaacaatatatgacgggatcaactatttcccggtgggcgtaaacttcatggaagagaacgcaatggaagtgatagaagctaaatacggaataaagggctcggcaattgtactgaaactgctgtgtaagatatacaaggagggatacttcatccgttgggatgaagagcagtgcctgatctttgccaacaaggcgggaagggaagtgcaggccgctgaggtgcagggcatcattgagatcctcttcatcaaagggataatggacaaaaacagctatctggaaaacggaatactgacctcggaaaacatacagaaggtatggatggaggcgacaaagcggagaaagagagagttgtcggaactcccctacctgatggtgaaaacggaaaaggaaaaggaaaacgataaaccggaaaaggaaagcgacaaaccggacaatgcatccacacaacaggaaattgaacgacccaagccgcttaaagaaggaaaagtagctggcagcacaggagatgtagccgttagcccgggaaatgtagtacacgatgtagccgttaacgcaaaaaatgcatgcaattccggacaaagtaaagtaaagaaaagtagagcaaaggaaaataaagaattacccccctcagttccccccgaggggaaggaggaagaaaggaaggaggattctgtttctctcccgataccgggatacgctttcaatacaatgacacacaattatccgggactgacggatacgctccaaagattggggatcaacgaggtaagcgaggtaaatgccattctcaggctatcggactatggcagaaagggaacgacggtgtggcggctgattgccaacacttgctggagtgacataggggcaaaaggaaggtatctgatagcggcactgaacagggcaaaaaggaaataa

SEQ ID NO: 628 - DNA, 801 bp, B.fragilis
tatatgaaaatatcagtgattattccttgttttaatcaaggaaaatatttggctgaagcattagattctgtagtaatgcagaccttttctgattgggaatgtattatcataaatgatggttcgattgataattccgaaaatgttgctttatcctatgtagaaaaggaccctcgttttcattatatatgtcaaaaaaatcaaggagtatgtatagccagaaatagaggtatagcaatggcacaaggagagtatatcttatgccttgatggtgatgataaaatatctcgtaattttttggaatgtatgtatcctattttggatgaagaacaatctgtgaaggtagtaacaagtactgttgtgcaatttggtaaaatccatcgtgtgataccatcaactgattactctttagaaaagttaatggggcgaaatctatttgtgattacgtctatgttccgtaaagttgattttgaaaaaacggaaggttttaacgaaaatatggcaaagggcttagaggactgggatttttggttgtctatgttagagtctggtggtgaagttgtttgtgcaaagcaggctattttttactatagaatcagaggctattctagaaataaaagtatttctgaagattattattcattattacgtaaaactatatacgaaaatcataaacacttattttctaccattttctttaatccgaagtattcatttgagtattatttgattgcaaaatcttatgaatataagttaggtaagttattatttagaccaatacgttttttatatgatcttttttaa

SEQ ID NO: 629 - DNA, 765 bp, B.fragilis
aagatgaaaattataacttataatgtgaacggacttcgtgccgcagtaaacaaggggctgcccgagtggttggccgaggaaaatcccgatgtgctttgtctgcaggaaaccaaactgcaacccgaacaatatccggcagaggcttttgaggcacttggatataaagcatatctctattcggcacagaaaaaaggatatagcggagtagccatcttgaccaaagtagagcccgatcacatagaatatggcatgggaattgaagaatatgataacgaagggcgttttattcgtgcggattttggtgatttgtctgtggtgagcgtttaccatccttcgggcactagcggagacgaacgccaggcttttaagatggtctggctggaagcattccagaagtatgtgacggaattgcgtaaatcacgtcccaatctgattctttgtggggattataacatttgccatgaaccgatcgatattcacgatccggttcgtaatgctaccaacagtggtttcttgcccgaagaacgggaatggatgacccgtttcctgtcggcgggcttcattgattctttccgtacgctttatcctcaaaagcaagagtatacttggtggagttaccgtttcaattcgcgtgccaagaacaaagggtggagaatcgattattgtatggtcagcgagccggtacgctctttgctgaaagaagccgttattctgaacaacgccgttcactccgatcattgtccgatggcgttggagatcggctga

SEQ ID NO: 630 - DNA, 582 bp, B.fragilis
aattacagaattatgaaaagaaatcttgtgtttgtattgtttgccctcgtttcggttgtgggcttttctcaagtgagctggaatgccaaggtgggaatgaatatcagtaactttaccggtgattttgacatgaatgccaaagtaggattcaagataggaggtggcatggagtatggatttaatgaaatctggtcgttgcaaccctctttgtttgtatcttccaaaggtgccaagaaggacgaactgagtgtgaatgctgtttatctggaactgccggttatggctgctgcgcgtttcaaagtagccgataatactaatatcgtgttgagtgcaggtccttattttgcttgcggtatcgcgggtaattccaaagtagatctgggcaaagggcgcttggaagtcgatacctttggtgacgacggtctgttgaaacgcggcgatgtaggtcttggtatcggtgttgccgcggagtttggcaagattatcgcagggcttgacggtcagttcgggtttgtcgatgtcatggacaacgtaaatggtaagaatctgaatctttctattagcgtaggttataagttctga

SEQ ID NO: 631 - DNA, 2871 bp, B.fragilis
actgacaccttcgtggtacttttctactttttctgtcggtcgctttatgttgtgcgaaggcatcacgttactgttgatggcactgatgatcttggcaggtatctggttcccggcccgtcagtctatgaaaatccagccggcagaggcattgcacgaagaataaaagcttatcgcaatattttatcatctatctgcgttgttttcaagattataacgtatatttgcgttcacaatcctgatacaacgcagatttttgctatgaacaaacgattatatactatatttcttatatctgtcttcttattactcccgggattttccactgctgcggaacgtatttataatgttctcttcgttcagtcgtatgctccggaaacaccttggcataatgacttggtccgggggttgaaagacggtttcggtgaatcgggattgaaagtgaatattacaaccgaatttctggatgccaatttctggacttatcaatccgaaaagctgattatgcgtcgtttttgcgaacgggcccgtgaaaggggaacagacttgattgttaccgtcagtgatgaggcttttcatactttgctgacatgcggagactcgttagccttgcagttgcccgttgtcttttttaatataaaatatccggaaggcagcctgattgattcgttacccaatgtgtgtggatatacggcgaatcccgatttcggagaattactgaggcaggcgagtcgccttttccctacccggacggaggtggtctgtatctccgacaatagcctgttgagttcgaaagggaaagatgattttatgaacgaatgggaaggttttgtggaggagcatccggaatatacggtgaccttttataattcgcagaccgatacaaccaataaaattattgcttctacctgctatccccgcaatacacataagacattgatcatcgctcctaagtggtcgtcttttatgtcctttatcggtcgtaactcaaaagcgcctttcttttcgtgcgagaaccttgcgttgactaatggtgcctttggcgcgtatgatgccgattcgtatgcttcggcgcatgaagtagggcggacggctgccgatgtgctgcgtggcaaatctccctcggaagtgggaatcattgaatctcctttgaagtttatgtacgatttcaagcagcttgtgttttttaaggtagatcccaagcaggcgagtgctatcggcggaaccattattaacgagccatacatggagaaatatcgtatgctgtacatcttgttgtatagttcgatattggctttactggtgttcctgatagtgtggctgtatcgtataaaccgtcgtgaatcccgccgtcgcatccatgcccagacccgcctgctgatacaaaaccggttggtggcccaatgtgatgaatttgataatgtgtttcattccatccgtgatggtgtgatcacttacgacaccgatttccgtattcattttaccaatcgttctttattgaagatgctgcatttgcccaaagatgaagccgctcgaccttacgaaggcttgccggcaggcagtatttttaagatctacaataatggtaaagagattctccgtcctatgctcaagcaggtggtgactgaagaaagcagcgtagtcattccggaaaattcattcatgcaagaggtgcacagtgggagttattttccggtttcaggagaggttgttcctatccgtgcacatggaaaaattacggggatggccctctctgcccgtaatatatcggatgaagagatgcagaagcgttttttcagaatggcggtagacgagagttctatctacccttggcaatataatatccgcaccggtctgtttactttccctgcgggctttctgacacgttttggttttgcggaaaataagactaccatttcacgtgacgagatggaccggatggttcatccggacgatcaggaatcggcatacgaggttttcaaccgggcactggcgggcctcagtcagagtacgcgtatgagtttccgtcagcttagtggtgacggtaattatgagtggtgggaatatcggacgtcggtgctttcaggattgacaacagacacgccctacagtattttgggagtatgccagagtatacaacgctataagacgaccgaagaggaattaaccgcagcgcgtgataaagcacttcaggcggataaattgaaatcggctttccttgccaatatgagccatgagatacgtacgccgctgaatgcgattgtaggtttctctgatttgttgagcgataccagcgggtttacggaagaagaggttaagctatttatagagactatcaataagaattgtggactgttgctggcacttatcaatgatattctcgatttgtcccgtatagaatccggcacaatggattttcagtttgccggtcacaatcttccgttattgatgaagaatgtatacgattcacagcgtttgaatatgcctccgggagtgcagttggtgctgaagttgccggagaatagcaaaaagtatctggtgacggataatgtccgcctccaacaagtggtaaacaacttgatcaacaatgccgttaagtttacgacccaaggttcgattacattcggatataccgaagaagaacccggctacacttctctttttgtcgaagacaccggaaaaggtatttcggaagatggattgaggcatatctttgaacgtttctataaggtagatagctttacccagggtgcggggctcggactgagtatttgccagactatcgtaggacgtctgaacgggacgattaccgtcgcttcagaagaagggcacggaacccgtttcactgtccgccttccggatatttgcgaataa

SEQ ID NO: 632 - DNA, 1146 bp, B.fragilis
ttgactatgatagattttacccaattcccctctccgtgttatatcatggaagaggagctgctgagaaagaacctcagcctgataaagagtgtagccgatgatgccggagttgaaatcatccttgctttcaagtcttttgccatgtggcgttcatttcccattttcagggagtacatcggacactccacggccagctccgtctacgaagcccgtttggcgctcgaagagttcggcagtaaggcgcatacttattccccggcctataccgaggcggacttcccggagatcatgcgttgcagcagccacatcacgttcaattccctgtctcaattcagccgcttctatccgctgaccgtggccgaaggcagcggcatctcttgcggcatccgtgttaatcccgagtattcggaggtagagaccgaactctataacccgtgcgctcccggcacccgtttcgggatcactgccgatctgttgcccgcccgtttgccgcaggggatcgaaggtttccattgtcattgccattgcgagtcatcttcgtttgagcttgagcgcactttgcaacatcttgaagagaagttctcgccgtggttttctcaaatcaagtggctcaacctgggcggcggccacctgatgacccgcaaggattatgatacccggcatctgaccggcttgttgcaaggattgaaaaagcgctatccgcatttgcgtatcatcctcgagcccggttcggctttcacctggcaaaccggagtcctcacctccgaggtggtggatattgtcgaaagccgcggcatccgtacggccattctcaacgtcagcttcacctgccacatgcccgactgtcttgaaatgccttatcagccctccgttcgcggagcggtgatgggagaggagggaccgtttgtctatcgtctcgggggcaattcctgcctgagcggagattacatggggtcttggagtttcgaccatgaactgcaggcaggcgaacgaattgtctttgaagatatgatacattatacaatggtaaaaacgaatatgtttaatggaattcaccatcctgccattgctctgtggacagcggatggcaaagccgaaatcttcaggcagttttcctacgaagattatcgcgatagaatgagttga

SEQ ID NO: 633 - DNA, 1935 bp, B.fragilis
ataatcatgatacttatatttggaggaaccactgaaggacgggctgccgtcaatgtaatcgaagaagccgggaaaccttattattactcaaccaaaggtgacgaacaggatatctacctgcatcatggcatacgcctgagcggcgccatgacccggagaaccctgaaagctttctgtcgccaaaacgacattcgccttttgatagatgccgcccacccctttgccgaaaagctgcatgatacagtaaccgatgttgcgcatgatctcggcattccctgcattcgatacgaacgcatttacgaccgctcttacctcaacccgattttcgaagacaactgcgaccctgatgatttgccttttaaatttgaatatgacaatcgggatctgttgcgcgagttgaagaaagaaaaagagggtcacagatttcttttcctgacaggtgtccagtccatcgcccgattcaaatctttatggaccaagaagaagtatgaatgttacttccgtattctcgaccgtgacagctcccgtgaaatagcccgtcaagccggattcccggaagatcatctggtgtactatcatcccgaaacggagaatctgccccaactcctgcaagaactgtctccccaggcagtcgtcctgaaagagagtgggaagtccggaggattcaccgaaaagaaagacatgatcctggaatatggggcaactccttacatccttctccatcccgaattagaatattacgatataacagtagacggagtaaacagtctccgccgtacccttgagaaaatgctgcccgattacttcccattgcgtagcggactcactaccgggagttgtgccgcagccgctgccatagctgcttttcgaaaactgaaaaatcccatactcgaggattttaaccggaatatccataccgtccttcccagtggcgaaacgattgagattccttgccaatccgtatccggaacattctccgacgagaaaattgaagtcagcgctaccgtcatcaaagatggaggagacgaccccgatgtaaccagtgggctgccgattgtaaccactttaaccctgaacctcgcagaagcgaaacaggctaataacgcacctgtacaaactccggaaacatgggagttcgtcttccatggtggcccgggtgtaggaacagttaccctgccgggactcgggctcgaagtaggtggtccggccattaacgccactcccaggcaaatgattatcgacaatctgaggaattgcatccggtactactatcgatacctgccaaacgttcccatccatgtcaccatctcagttcccggaggtgaagaagtcgccgcacgtactttcaacccccggctgggtgtcgtaggcggaatctccatcatcggtaccagcggtattgtgaaacccttttcttccgaagctttcgtccgttccattcgtaaggagatggaagtggcacgtgctacaggtgcttgccgtattgtcatcaattcgggagccaaaagcgaaaaatatattcgcaatctctatccggaacttccgccgcaggcttttgtacactatggcaatttcataggcgaaacgatcggaattgcagccgaactcggcatctcgcggctgaccttgggagtgatgatgggtaaagctgtgaaactggcggaagggcacctcgacacacacagcaagaaagtcaccatgaacaaggagttcctcaaagaaattgcccgacggtgtggatgtaccccctccagcatagaggcaatcgaccatatcattctggcacgtgaactttggaacatccttcctgaaaccgaactgcaggctttctgttccctgttgatcgaacaatgccaccgccactgcgatgtgctgctccccaatggagaactaaccatccttctgattaccgaagaaggaaaaatcatacagtaa

SEQ ID NO: 634 - DNA, 228 bp, B.fragilis
ttatcgtatgtttcatcaatagcccctctacccattaaagaagtaataaccgggaaatggtgccgtcttatgaaatcattcagcaaaaccatatccgaattgcaacatcctgcccctaaaagcaacatgggacgatgggacgactccattaataacctgatttcctcccaggctatcaaaggattatttaaaatactctcaccggaatatccgatcaatgtttcctga

SEQ ID NO: 635 - DNA, 1353 bp, B.fragilis
tttcaaagagtgttttttaaaaatatatataattttttgcaattagatgctgctgtcatttactcttcattaagtaagatcctcagtggctttggaggctttctaacggtttatttaatcgcaaaaaaattaacattagtagaacaaggatactattatacttttatcagtgtattgtatatacaggtattttttgaattggggcttaactctattatcactcagtttgttgctcacgagaaagcacatttagattggaaaggaaaggatgatttagtaggaaaagagtttcatctctctcgtttagcttctgtattacgattatgcgttaaatattattcctatttggctataggattactgattgttttgtttataggtggctatgtctttttttcaataaatagtaatattggggttagttggaaaattccttggttactgctttgtgtttcaacatctttatcgttcttcttaaatcctttcttatccttcttagaaggattaaatttaatgaaagaggtttgttttatccgttttattcagcaaactgtaagtttgctgatattatgggtgggactgataggaggtatgaagctatatgttggaggatgttcgagtttagctggtggtgtggctattcttatttttgtttcttacagatacagaattttgtttttgaatatatatgggaaagtaactattcattttattaattacaagaaagagatatttccatttcaatggaaggtagctgtgggatggcttagcagttctttggtttttcagtttttcaatccgattctgtttgccacaataggtagtgctgctgctgggcaacttggaatgacattaagtgtgataaacggggtctcatctgtttcaatgaactggatatacactaaagtacccaatttgtctaaattggtgtcattacgagattttaaagaattggataaatcattttctaagatactagctgtattggtgcttttgagttgtatgggatttatcattgtagctttatgtcttattcagtttaatatactgcatattgcgtctaagttgcttccgatgtcgttgttcctaataatgtcattatcctctgtattcacacagattacatcctgttgggctatttactttagatgctttaagaaagaacctttcttaagggtatctttaattaatctagctgttgtttttttaatagtctttccgtgtactctttattatagattaagtggattggtgttgtcttattctctagctgctttggtgggtttaatattgggttggctattgtataataatagagctgaatttcaaaaaaaatacgtattatatgagtaa

SEQ ID NO: 636 - DNA, 186 bp, B.fragilis
agtctggtggtgaagttgtttgtgcaaagcaggctattttttactatagaatcagaggctattctagaaataaaagtatttctgaagattattattcattattacgtaaaactatatacgaaaatcataaacacttattttctaccattttctttaatccgaagtattcatttgagtattatttga

SEQ ID NO: 637 - DNA, 918 bp, B.fragilis
aataccgcattcccctttttattccctacatttgtactacgaataaaaaatcaagatagtaaaatgaaaaaatttatcaaaggagtccggtttactccttccaattatccggatgaaatagaagataaaatacagaaatacagaaaacaaggttacaaacttcctccacgcaaggtattgcgcacaccggaacaaattgaaggtatccgtgaaagtgcaaagatcaacacagctctgctgaaccacattgcagaaaatattcgtgaaggaatgtccaccgaagagatcgatcgtttggtctacgatttcaccacgtcccatggggctattccggctcctctaaactatgaaggatttcccaaaagcgtctgcaccagcatcaacgatgtagtgtgccacggaatccccagttcaaccgaaattctaaaaagcggagatattatcaacgtagatgtttctaccatttacaatggttatttctctgacgcatcacgcatgtttatgatcggcgaagtcagccctgaaaaacagagattggtacaggtcactaaagaatgtatggagatcggcatagctgccgcacagccttgggcccgtttaggtgacgtaggtgcggctattcaggaacatgccgaaaagaacggttatagtgtggtgcgcgacttatgcggacatggagtgggaatcaaattccatgaggaacccgacgtagagcacttcggacgccgcggtaccggtatgttgattcttccgggaatgacttttaccatcgaaccgatgatcaacatgggaacgtatgaggtctttgtcgactctgctgatgactggacagtctgcacagacgacggattgccgtctgcacaatgggaaaatatgattctgattactgaaaccggaaacgaaatattgacttattaa

SEQ ID NO: 638 - DNA, 1011 bp, B.fragilis
tgcgttaaattgtatattgttttgaagaataaatttcgtaatttgtttttggcctttggcatcctggccgtcatcatcatgctgttcactttcgatgtgtcctatgatgaactgctggacaacctgcggcgtgccggattttatctgccgctggttctggtcctttggctttttatttatctgattaatacgctttcgtggtatatcattcttcgtagtagcggtccggtgaattcattgtcgttcgcccggctctataaattcacggtttccggttttgcgttaaattatgtcactcctgtgggacttatgggaggggaaccttaccggattatggagcttacttcatatgtcggagtggagcgtgccacatcttcggtcatcctgtatgtgatgatgcatatcttttcgcatttctgtttctggctcagctcggtgttgatttatgtctttttttatccggtcggttgggggatgggcattgtcttggggttgatcacgctcttctgccttttacttgtcactctttttatcaaaggctaccggaacggtatggctgtggcatgcgtacgtctgggtagtcatatccctttcttgaagaagcgcgcagtccgcttcgcggaacttcacaaagaaaaactggaaaccatagaccgtcagatagcactgcttcatcaacagcgcaaaagtaccttttattcggcattggggttagagtataccgctcgcattgtggggtgtcttgaagtctggttgattctgaatgtattgactacggatgtcagttttgtcggttgcattctgatcgtcgctttctcttccctactggccaatctgcttttctttcttcccatgcaattagggggcagggaaggaggttttgccctggcggtagccggtttgtctttatccggagcatatggggtatttgccgctctgattacgcgggtgcgggagatggtctggattgttatcgggctggtgctgatgaagataggaaatcggagatag

SEQ ID NO: 639 - DNA, 849 bp, B.fragilis
cgcccgacttcttccgtgttttccgttatcagggagccaaccggagaaactccggaacaattagctgctctgttgaaggagggtacttttatggtatcgcgtaatgtgttcgagtcacgttataagatcgatttgaaagactatgtaggcaaagagttttgtctggatcaggacactgcccatttatccaaattggtggcagcgctccaagtggtccgttatgatgatttttcctccggtgcttatagccggtccgcagtcatcttgttaccggagaatcggttggcttcgggcaatgaaatctgtttgcgtacgaacaaaaacgaatctgccgcctttgccgaacaattgatgaaggatgccccctcccagtatcgggtgggcaatctttttctgactaaggtaagttcattccgggacatacggcatacgttccagttggacgatgtgaatactttacgtaactatctggtaggtatgggctttttgctgctcaatatttttctggggctattgggaacattctggttccgcacccagcagcgtaaaggtgagatggcgctgatgatggcagtaggagggagtaagcaaagcgtattctttcgtttgctgagcgaaggttggctgatgcttcttctggttactccgttggctattggtgtcgatttctatatcgcaaagagtgaactgacaccttcgtggtacttttctactttttctgtcggtcgctttatgttgtgcgaaggcatcacgttactgttgatggcactgatgatcttggcaggtatctggttcccggcccgtcagtctatgaaaatccagccggcagaggcattgcacgaagaataa

SEQ ID NO: 640 - DNA, 441 bp, B.fragilis
tctgaaattccgataacaacgccaccttttgccgtcccatccaatttggttatagccatagcagttacttctgttgcaagtgtgaattgttttgcctgctcaaaggcattttgtccggtcgagccatcaagcaccaacaacacctcgtttggagcatcaggcactactttcttcattacatttttaattttcgtcagctcgttcatcaagccaactttattgtgcaaacgtcctgctgtatcaataatcaccacatcagcgttattagctactgcagaacttaacgtatcaaacgcaacagaagccggatcggcccccatcttttgtttaatgaccggaacatccactctctcgccccatatcaccaattgctccactgctgctgcacgaaaagtatcggctgcccccaaatatacagatttaccggctttcttaaattga

SEQ ID NO: 641 - DNA, 1092 bp, B.fragilis
acgaaattaacgggaaagatgaataaatatatattgctgatagtattgttatttctggtttctggcagaattgctgcacagtcagtgactgtggatgccaaaatagactctttgcaaattctgataggagaacaggcgaaagtgcaattacaagtagcgatggatgcgaagcagagggctgtttttccgtcatttacagatacattggtacgtggtgtggaaattgtggatattgctaaacctgatacacaatatttgaatgatcgccagagaatgctgattactcaagaatatacggtaacttcttttgattcggcattatattatattcctcctatgggagtaaagattgataataaagagtataaatcaaaggcgttggcattgaaggtatattcaatgcctgtagatacgttacatcctgatcaattttttggtcagaagactgtcatgaaagctccctttgcctgggaggattggtatggtttgattgcttgctcttttctggcattaccattgctaggattgcttatttatctgatcatccgtatccgtgataacaagcctattattcgtaaagtgaaagttgaacctaagttgcctccacatcaattggcgatgaaagagattgagcgaataaagactgagaaaatttggcaaaaaggacaatcgaaggagtattatactgaattgacagatgctcttcgtacatatattaaaaatagatttggctttaatgcattggagatgacttcatccgaaataatagataaactgctggaatttaatgataaagaagctatatcagatttgaaatatttattccagacagctgatttagtaaagtttgccaagcatgatccgcagatgaatgagaatgatgcgaatttgatcaatgcaattgactttataaatgaaacaaaacaattggaagaagagaatcagaagccgcaacctactgaaatcacgataatagagaaacgatctttacgtacgaagatattgctgatctgtggtatcgtattcctgtcggcagctcttattgcgactttcgtctatattgggttgcaactctataatctatttggataa

SEQ ID NO: 642 - DNA, 288 bp, B.fragilis
gacatgagaacaataacatttaatgaactccgtaaaattaaagattcattgcctagcggtagcatgcatagaatagcagacgaactcaatttaaacgtcgatacagtgagaaacttctttggtggtcataattttaaggaagggaaaagtgtcggaatacatcttgagcctggtccggatggtggattggttatgattgatgataccactgtgctcgatcgggcattaagaatattggatgaattaaatatgagtaaagaagaagctaccgaatctgtgcaggtttaa

SEQ ID NO: 643 - DNA, 699 bp, B.fragilis
atctcccgtgctataatttcttcggcagtcaatttaggagaaccttcgtcttctatcaccttttttaaattatctgtagtttcttgccctgtatctccagtgacctggattggctcttcagaattttccactactttatccaatccaccctcttctcgaacctcagcaatggatgaaccttctactacagcttcactacctttatgtatgctaacatcttcaacagtttcaagtatgtcaatatcatctacaacctctgtcctttcggattccttcataacttccgaaacgtcttctgcaacttccacatctgacgacacaacatcctgcccttttgaggtttccggttctactttcccattcgcctctgtttcaaccaccttctcctctgcttttgcttcctctctctctacggtctctgttattaacggaagctcagttgtttcggatatattccctgattcttcctccaattcctctattggcgtatcttccaagactgtattctcattcagcactactgtttcgaaatgtgaaaaaggtctatttatgatatctcttaaagaagggtcaggagtaaaagaaatcttagtatgtccctctattttaatacgttcacccgtattgacatttacactttcacgactattgacccctatcaatttgaatgtacccaatcctttgattttcacatattga

SEQ ID NO: 644 - DNA, 723 bp, B.fragilis
gtagtaatgtatatgtcaagaaataaatatatattgtttgctctgttgctatcgctttctgcgggtgcgtttgcacaaaaagccgagcgtgattatatccgtaaaggcaatcgtctgtttaaagacagtgtttttgtggatgctgaagttaattaccgtaaagcattagaggcaaatcctaagtctactatttccatgtacaacttgggtaatacgttgtcgcagcagcaaaagttcaaagatgcgatggaacaatacgttgcggcaaccagtatagaaaaagataaagctaaactgggacaaatttatcataatatgggagtgttattccagtctggtaaagattatcaaaaagcggttgaagcttataagatgtctttgagaaataatccgaaagacgatgaaacccgctataatctggcattagctcaaaagttgctgaaggatcaacagcaaaatcagcagaatcaagatcagaatcaggatcagaataaagatgatcaacaaaagcaacaagataaaaaagatcagaataagcagaatgatcaaaataaagatcaacaacagcaacaacctcctaaatcagagaaaaatgataacgaaatgtctaaggagaatgcggaacagctgctcaattctgtgatgcaagatgaaaaaggggttcaggataaagtgaaaaagcaacagactcttcaaggaagacgtctggaaaaagactggtaa

SEQ ID NO: 645 - DNA, 192 bp, B.fragilis
gaaatagatttcacctatttctctttttgtgttacgctattgttcaggatcagatcaagcaaaaaaaagaggctgcccaatttctcgaatcaggcaacccctttcacaaaaatctttgcgaaaaaagatctatttgatcattacatcattttctcgatttcttcgaattccggtcccatattcaggttgtaa

SEQ ID NO: 646 - DNA, 1068 bp, B.fragilis
atcctacttttatcattacttttgcatcgtttaaatatcaaaaagcgtatgagtacaattatattaggaattgaatcttcctgtgacgatacatcagctgcagttattaaagatggttatttgttatcgaatgtggtatctagccaggctgtacacgaagcttatggtggagtagtaccggaattggcatcgcgtgctcaccaacagaatatagtacctgtggtgcatgaagcgttgaagcgtgcaggagtgaccaaggaagagttgagtgcggtagcctttacaagggggcctgggttgatggggtcattgctggttggagtatcttttgcaaagggttttgcacgttcattaaatattccgatgattgatgttaatcatctgacaggacacgtgttagcgcattttattaaagaggaaggagaagcaaatgaacagcccgattttccattcctttgtttgctggtatccggaggtaattctcaaattatattggtgaaagcatataatgatatggagattctgggacagactattgacgatgctgccggagaagcaattgataaatgttcgaaagtaatgggacttggttatccggggggacctataattgaccgtttggcacgtcagggcaatccgaaggcttatacttttagtaaacctcatatttctggtttggattatagttttagcggattgaaaacgtcgtttctttactctctgcgtgattggatgaaagaggatcccgatttcatcgaacaccataagaacgatttggcagcttcgcttgaagcaacggtagtagacattttgatggataaacttcgtaaagcagccaagcaatataaaattaatgaagtggctgtagcgggcggtgtttctgctaacaacggtttgcgtaatgcctttcgtgagcatgcagagaaatatggttggaaaatttttattcccaagttcagctatactacagataatgccgcaatgatcgctatcaccggatattttaaatatcaggataaagatttctgctctatagaacagcctgcttattcacgtgtaactttgtaa

SEQ ID NO: 647 - DNA, 651 bp, B.fragilis
agaagataccataaaattgataaaaagatgtttcgatttgaagaacctgcatatttatatttgttgctgctgctaccattgctggcagccttctacctttattctaattatagaaagaggaaggctattcgtaaattcggagatccggtgttgatggcacaattgatgcctgatgtatctaaatatcgtccggatgtaaaattctggttgttatttactgccataggtctatttgctgtactattggctcgtccgcaattcggctctaaattggagacagtaaagcgcaaaggggtggaggttatgattgcattggatatttcaaattctatgcttgcccaagatgttcagcccagtcgtttagaaaaagctaaacggcttatatctaaattggtagatggtatggagaatgacaaggtaggaatgattgtctttgcaggagatgcctttactcagttacctataacaagcgattatatttctgctaaaatgtttttggaatcaatcagtccttcgttgatatctaaacagggtacagctatcggtgctgctatcaatcttgctgcccgtagttttactccgcaagaaggagtgggacgtgctattgtggtgattaccgatggtgaaaatcatgaaagggggagctgttga

SEQ ID NO: 648 - DNA, 984 bp, B.fragilis
tgtattatacaaataattgtaatcatgggattttttagttttttctcaaaggaaaagaaggaaactttagataaaggattatctaaaaccaaagaaagtgtattcagcaagattgcccgtgcggtggccggaaaatcgaaggtggatgatgaagtgttggataatctggaagaggtacttatcacatcggacgtaggggtagagactactcttaatatcatcaagcgtatcgaaaaacgtgcagcagaagataaatatgtaaatacacaagagttgaattcgattcttcgtgaagaaatagctgcattactgactgaaaataattcggatgatgttgccgatttcgatgttccggtagagaaaaagccttatgttattatggtggtgggtgtaaacggagttggtaaaacaaccactattggtaaactagcttatcaatttaagaaagccggtaaatctgtatatttgggggcagccgatacttttcgtgcagcagcagtggagcaattggtgatatggggcgagagagtggatgttccggtcattaaacaaaagatgggggccgatccggcttctgttgcgtttgatacgttaagttctgcagtagctaataacgctgatgtggtgattattgatacagcaggacgtttgcacaataaagttggcttgatgaacgagctgacgaaaattaaaaatgtaatgaagaaagtagtgcctgatgctccaaacgaggtgttgttggtgcttgatggctcgaccggacaaaatgcctttgagcaggcaaaacaattcacacttgcaacagaagtaactgctatggctataaccaaattggatgggacggcaaaaggtggcgttgttatcggaatttcagatcagtttaagattccggtgaaatatatcggattgggtgagggtatggaagacctacaggtgttccgcaagaaagaatttgtagactccttatttggagagaatgcatga

SEQ ID NO: 649 - DNA, 1200 bp, B.fragilis
ataagagataaagtcagaatcccaattggcaaaacaattgggatttcttatttgttgaattcaataaataaacgaattatggaagagaaattagtaactttagctattctgacttatacaaaagctcagatattgaagaatgttcttgagaatgagggtatagagacgtatattcacaatgtaaaccagatacagccggttgtttcatccggtgtgcgtttacgtattaaagaaagtgatttgccgcgtgcattgaagattaccgagagttctgcctggcttgctgaaagtatagtaggagagaagacccctaaagtggagcatcgcactaagaaggtccttattccggttgatttctctaactattcaatgaaagcatgtgaatttggtttcaattttgctaaatcttttgatgcggaggttatcttgctacatgtctactttacgccaatttatgcttcatcattgccatatggagatgtatttaactatcagattagtgatgaagagactgtgaagaatgtattgcataaagtacatgatgatctgaatactctgtcggagaagattaagcaaaaagttgcatctggagagtttcctgatgtcaaacatacgtgtgtcttgcgcgaaggtatcccggaagaagaaatactcagatataataaagaacatcgtcccagaatcattataatgggtactcgaggtaagaatcagaaggatattgatcttattggtagtgtaactgccgagataattgaacgtagtcatactacagtactggctatccccgaaaatactcctttcaatcgtttcaatgaagtgaaacggattgcctttatgacgaactttgaccaacgtgatttgattgctttcgattcattcatcaatggacttagtccatttcatttttctgtttctcttattcatttatcggatgtaaaagatacatggaatgaaataaaattagctggtattaaggattatttccaaaagcaatatccggatcttgagatttattatgatgtggtgatgagtaatgattttctgaatagtttggataattacattaaaacaaatcagattgacattatcacattaacttcttataaacggaatatattttcccgtttgttcaatcccggtattgctcgtaagatgatcttccattcagatacaccgttgttagttattaacggatga

SEQ ID NO: 650 - DNA, 369 bp, B.fragilis
cttttattcaacgcattcatcggtatttttcccgccaatacccgttttacgttttcaaagacagcctcgctaaagatcagtctggtaccgaagtatttgcaaagagtctgtttggtaatatcatctttggtgggtcccaagccccctgtcactagtacaatatttgcccttttcatcgaagcatctacagcttcaataatctcatctgcccgatctcgtacagacacgacacgaattacctctatacctactttatttaattcgcgccccatccatgccgaattggtatcagtcacctgtcctatcaacagttcatcaccaatagttattatctccgcaaacatagggctcttacaaagttacacgtga

SEQ ID NO: 651 - DNA, 1848 bp, B.fragilis
ttgatgataaaaacttcagatgaaatgagaaaattgattttcttattgattgcactggtagccatgactacgcaagcgcaggctgacggaaaggtagtgtttactgcatctgcccccgatgctgtagtagtaggtgaccagttcaggttatcgtatacggtaaatacgataaaagtacgagattttcgtgtgccttctattaaaggatttgaggtgttaatgggacctaaccgttcacaacgtatgcaatcgattaatggggttactaataatagtattacctttacttatatcttaatggctacggctgaaggagagtattctattccaggtgcaacgattacggctgacgggaatcagatggtttctaattcggtaaaaattaaagttcttccttcggataaaaccgggaatacggcagatggcaaaggaactgcatcgtctggcaatcaaagtggaacgtcttcctctgtttctaaccaagacttacttataactgcgacggccaataaaacgaatgtatatgagcaggaagcctttctattaacttttaagatttacacaagagagtctcaacttcgctttgagaatgtgaagcttcctgattttaagggatttcattcacaagaaatagagatgcctgctaatgcaaaatggtcacaggaacattataagggaaagaactattttacgacagtgtatcgtcaatttgtattgttcccacagcagtctggaaaactgactattgagcctgcacgttttgatgctaccattgctaaagctgtacaatctgatgatccgtttgatgctttctttaatggtggaagcaattatgtgaatgtaagtaaggtgattgtaactcctaagattacggttaatgtgaatccgttaccgacaggtaaacctgccaatttctccggaggagtaggggagtttagtatcacttcttccattaattctaaagaagtgaaaacgaatgatgctatcacaataaagttagtgatttcgggaaccggtaatttaaaattaattgcaaatccggaaataaaattcccggaagattttgatgtatatgatccaaaggtggatagcaaagttcgtttgactcaagaaggactttccggtaataaagttattgaatatcttgctattccgagacatgcaggagtttataaaataccaggagtatccttcagttattttgatatcaagtcgaaatcctataaaacactgaataccgaagattatgaggttaaggtggaaaaaggagcaggaaatgcagatcaggttattgccaactttactaataaagaagatctgaaagtattgggtgaagatattcgctatataaaactaaatgatgtgaagcttcagccaaaagataatcttttgtttggctctttactttattggctattctacattgttcccgccgtggtgtttattgtcttctttatagtttatcgcaaacaggctgccgagaatgccaatgtagccaagatgcgtacaaagaaagccaataaagtggctactaaacgaatgaagttagctggtaaattgcttgcggagaatagcaaggaggcattttatgatgaagtacttaaagctctatggggatatatcagtgataaacttaatattccggtttctcgtttgtctaaagataatgtagaagagaaacttagaaattatggagtcagtgacgaattaataaaggatttcctgaatactctgaatgaatgtgagtttgcacgttttgctccaggagatgagagtcaggctatggataaagtttattcatcgtcattggaagttatgagtaagatggaaaattcaataaaacgctaa

SEQ ID NO: 652 - DNA, 282 bp, B.fragilis
aactataaaaataagatagaaatgtcgaagatttgtcaaattaccggaaagaaagccatgattggcaacaatgtttcacactcaaagagaagaactaaaagaacctttgatttgaacttgtttaacaaaaagttctactatgtagaacaggactgctggatcagcctgagcctctgtgctgctggtttgcgtattattaataagaaaggtttggacgctgctttgaatgatgcggttgccaaagggtattgtgattggaaaaccattaaagttgttggctaa

SEQ ID NO: 653 - DNA, 840 bp, B.fragilis
gtcatgaaaaaaatattgtttattgctttgggtttgttaatggcagtaacttctttcgggcaggattcgttaataacagattctactcagatgatacagggagatactgtcagtatccataatgcagagttttccggttccaaattagaagatgccacaaaagctgagggagatagtgcatatatcagaaatgactttgcgtctgcaatccagatttatgaatcacttttgcgtaaaggcgagtcggccgatgtatactataatcttggtaatagctattataaaataaatgagatagcaaaagccattttaaactatgaaaaggccttgttgcttcagcccggtaacggagatattcgtgccaatttggagatagctcgtggtaagactgtagataaagtagaagttgttcctgagatattctttgttacatggacaaaggcattaattaatagtatgagcgtggattcatgggccatatgggggattgtgagtttcttgctgctaattgtctctctatatttctttattttctcgaaacaagtggtgttgaagaaagtcggttttattacaggcattatctttttgatagttgttgtaatggcaaatatttttgcttctaagcagaaagaagagttgttgaacagggatactgcgataataatgagtccgagcgtaacggttagaagtacacctagtgaaaatggtaccagcctatttattcttcatgaagggcataaggttaacattaaagatgattcaatgaaagactggaaagaaatccgccttgaagatggaaaagtgggatgggtgccggttggttcaattgaaattatttaa

SEQ ID NO: 654 - DNA, 207 bp, B.fragilis
aaagaggagaaactgattatggcaaagaaagcaaaaggtaatagagttcaggtgattctggaatgcacagaacacaaagatagcggtatgccgggaacatctcgttatatcacaactaagaacagaaaaaatactactgaaagacttgagttgaagaagtacaacccaattctgaaaagagtaacagtacacaaagaaattaaataa

SEQ ID NO: 655 - DNA, 3390 bp, B.fragilis
tatttaaacgatgcaaaagtaatgataaaagtaggattcataacgaactattttatatttttgttctcaaaatcaaaacaaccgcctatcagaacgctgaagaagactgtacgttgggttatcggtatcatattaggtatatatatcggaactattattttgctgaatattccatatattcagcgaaatatgactacgtttgtcacaaaagaactatcccggactttgggtacagaactgactatcggtaagatagacattggattattaaaccgtatcattatagatgatgtattgctcgacgatcaatcgggaaaagaaatgctcaaaattacacgtctttctgccaaatttgatattattcctttattcaacggaaaaatcacaatcagcagcgtgcagttatttggctttaatatcaacttgaataaacccgctccgcacatggagccaaattttaaattcgtcttggacgcatttgcatccaaagatacagtaaaaacaaaaaaggacattgatctacgtattaattccatattaatacgccgtggtaaactatcctacgacgtattatcggaagaagaaacgcccggaaagtttaacccgcaacatatcaaactacacaatatcattgccaacatttcactcaaggcacttcaaaacgattcgatcaatgcagccatcaaacgcctgagtgtagacgaacaatcgggctttgaactacgaaagttgagcctgaaagtcattgctaataacaaaggcatgaaaatagaaaatttcgcaatagaaatgccgggtaccgaaatgaaaatggatactatccgaatggaatatgacagtttgaaagcactcaaccattttgccgataacgttcgcttctctttccgtactttaccatctcatgtgactttgaatgacatttcagcttttgtcccggcattatccaattttaaagaaaaactagatctcaacattgatgtagaaggtacgctcaatcaactgaattgcagaacattggaaatcaacgcaggagataagttccgactaaaaggagatgtatctttacaagacttatcacgtcctcaagacgcttacgtttatggacatctggccaatctctctgccaacaaagaggggatcggatttttagtgcgcaatctaagcccgcactataatggcgttccccctgtattacaacacttaggaaatacctcttttcatggtgaaatatcagggtactttacagacttggttatgtacggcctgttccgtactgacataggctccgtccaaaccgacttaaagcttagttccgataaagctaaagcgctgttttcttattcaggaggcgtaaagaccaccgattttgagttagggcaactgctaggaaacaagcaattgggcaagattacctttaatctggatgtccgaggaaaccactacaagagccaatatccttccattacgttaaaaggtttgatagcatccctcgaatacagtaattataaatatgaaaacatcacgctggacggagaattcaaacgcggtggttttgacggtaaagtggcattgaatgacgaaaacggttcggtacatttaaacggcaacatcaatgtagtcgaaaaagtccctacttttaacttcaatgcagtcatagacaaaatacgtccacacgacctgaatctgacaaaggagtatccggatgcagaattttctttgaagctaaaagctaatttccggggtggttccatcgatgaaatgatgggtgaaatcaatatagacagcttacaatttaccgcaccagagaagagctattttctggataatatcaacatcactgcaacccgccaagataaagagaaccaattgaaactaacctccagtttcttaaaagcaagtatcgaaggcaattacctgtatcatacgcttccggcaagtgttatgaacattatgcggcgatatattccttcactaattcaaccggataaaaagcctattaaaaccaataataactttagtttcgatattcacatatttaatacagaactgttgtcgacagtatttgacatcccattgaaaatatattcacactcgactgtgaaaggttacttcaacgatcaggcacaacgcttgcgtgtagaaggctattttccacgtttacaatatcaaaacacgtttatcgagtcaggtttggtactttgtgagaatcctaccgatcagttcaaagcaaaggtccggttcaataacctaaagaaagaaagtgctgtaagcatctctctggacgcacaagccaagaatgacactataaatgccaatatcaactggggtaacaatgccatcagtacttatagcggacgattatctgccgccgccagtttcttccgcgcagccgaagaaaagtccccactgaaaactgtcgtagatattaaacagacagacatcatcctgaatgatactctatggcaggttcatccgtcacaagttgtcgtcgattcaggaaaaatagatgtgaatgatttctatttttcacatcaggaccgtcatatccgtatcaatggacgcatttcagaacaagccaaagatacattaaaagtagaactaaaggacatcaatgtaggctacgtattcgatgtggtaaactttgacgatgtggacttcaaaggagacgctacgggaacagcatatgccagtggcattttaaaagaaccggtcatgaacacccgcctgcattttaaaaacttcacctttaatgatgcctcactgggggctatggatatttacggtgcgtggaagaacgacatgcgtgctatctttcttgatgcacacatggaagaagaaggagtgtcgaagacgcatgtcatcgggcatgtctatccgttaaaaccggaaagcaaactagacttgaatatagagacggatcatacgaatatccaatttctccaatacttcatgcgttccattgttgaagacttgcatggacgtaccagtggtaaagcccatttctacggaaagttcaaggcactcaatatcgaaggaaacctgatgacggacgcatccttaaaaataggaatactgaatacttcgttcaccgtaacagacaccatccgtttgtccaccagtggcattagcttcgataatatacgcatagcagatatggaaggacatcagggtactatgaacggcaaactgaatttccgacatttcagggacctaagttatcatttcgaattcaacgtaaacaacatgttacttatgaatacgaaagaaaatccggatattaacttttacggaaaagtatatggaaccggtaatgcaatgttgattggaaacccgcaggaattacaagtcaatgcagctgtcactaccaatcgtaacaccaattttgtctag

SEQ ID NO: 656 - DNA, 1479 bp, B.fragilis
aagataagtttaaagaaacatttccgtatgaatgaaaagttgactatacaagatcttgttgaactactggttaacagacatgaggtttctcaagaagatgctgatgttttcgtccgggagtttttcttattgatagaacaagctttggacgctgatcaatatgtgaaaatcaaaggattgggtacattcaaattgataggggtcaatagtcgtgaaagtgtaaatgtcaatacgggtgaacgtattaaaatagagggacatactaagatttcttttactcctgacccttctttaagagatatcataaatagacctttttcacatttcgaaacagtagtgctgaatgagaatacagtcttggaagatacgccaatagaggaattggaggaagaatcagggaatatatccgaaacaactgagcttccgttaataacagagaccgtagagagagaggaagcaaaagcagaggagaaggtggttgaaacagaggcgaatgggaaagtagaaccggaaacctcaaaagggcaggatgttgtgtcgtcagatgtggaagttgcagaagacgtttcggaagttatgaaggaatccgaaaggacagaggttgtagatgatattgacatacttgaaactgttgaagatgttagcatacataaaggtagtgaagctgtagtagaaggttcatccattgctgaggttcgagaagagggtggattggataaagtagtggaaaattctgaagagccaatccaggtcactggagatacagggcaagaaactacagataatttaaaaaaggtgatagaagacgaaggttctcctaaattgactgccgaagaaattatagcacgggagattcaaaaagcagaagtatcgactatccctgtaaaaaaggaaaagcgcccaaagaaggaagttaaaccggaaaaccaaaaatctcctgttccttacttaatagtaattatagtagttgttatgtcgctttgcggtgcagcattagtttttatttattatccggatttgttttctaaaaaagaatcggaacagtcaataaccacagagactgtagagaaaaaagaaccgatacgggaaattccattggatactgttgcaaaagcggatactattgtcaaggtggtagcaaagactccgaatcaacaggagataaaacagatgtctgagcgtgtcaatgtgtcggagaaagtagataaaacttcagaaagtgaatcggtatcccgggaaaagagcactaaaacagtggcaatcccggtcaagccggattcagtgaattatacaattaccggtactaaggcgacttatacaattaaagaaggtgaaactctgactagggtatctctacggttttatggtacaaaagatttatggccctatatcgttaaacataatcggggagtgattaagaatccgaataatgtaccgtatggtactgtacttaaaataccggaattggttaaaaaatga

SEQ ID NO: 657 - DNA, 2543 bp, B.fragilis
gaagactgcttgaacaagacagaattataaagattaacatcgaggaggaaatgaagtcatcgtacattgactactccatgtcggtcatcgtttcacgtgcccttcccgatgttagagatggatttaagcccgttcaccgcagaattctctacggaatgatggaactgggaaatacgtcagacaaaccctataagaaatcagccagaatcgtaggtgaagtacttggtaagtatcacccgcacggagactcttctgtatattttgcgatggtacgtatggctcaggaatgggcaatgcgctatccgctggtagacgggcaaggtaacttcggttctgtagacggcgacagtcctgctgccatgcgttacactgaagcacgtctgaacaaattaggtgaagaaatgatgcaggacctctacaaagagactgtagatttcgaacctaacttcgataatacgctgatggaacccaaagtgatgccgacacgtattccgaatttgctggttaacggtgcttccggtattgctgtaggtatggcaaccaacatgccgccccataatctgtctgaagtcatcgatgcctgcgaagcatatcttgacaataaagatgtgaccgtagaggaactgatggaatatgtaaaagcgcccgacttccctacaggaggatatatatatggcataagcggcgtacgtgaagcctatcttacgggacgcggacgcgtggttatgcgcgcgaaagcagaaatcgaatccggacagacacatgataagatcgtcgttacagagattccctacaacgtgaataaggcagaattgattaaagcaattgctgatcttgtcaatgaaaaaagaatagaaggcatatcaaatgccaacgacgagtccgaccgtgaaggtatgcgcatcgttattgatatcaaacgggatgcaaatgcaagtgtagtgctgaacaagctctataaaatgacagccttgcagacgtcattcggtgtaaataacgttgcactggtcaacggacgccctaaaatgctgaatttacgcgacttgattgtttacttcgtagaacatagacacgatgtggtaattcgtcgtactcaatttgacctgcgtaaggccaaagaacgtgcacacatcttggaaggtctgattatcgcttcggataatattgacgaagtaattcgtatcatccgcgccgccaaaacaccaaacgatgcaatctccggactgatggaacgcttcaacctgagcgaaattcaggcacgcgccatcgttgaaatgcgcctgcgccaattaacaggtctgatgcaagatcagctccatgctgaatacgaggaggttatgaagcagatagcatatttggaaagtatcctggccgatgatgaagtatgccgtaaagtaatcaaagacgaattgctggaagtaagagctaaatatggtgacgaacgccgttctgaaatcgtttattcatcagaagaattcaatccggaagacttttatgcggatgatcagatgattatcaccatctcacacatgggatatatcaaacgtacaccattgacagaattccgtgctcaaaaccgcggtggagtaggctcgaagggtactgaaacccgtgatgaagactttgttgagcacatctacccggcaacaatgcacaacacgatgatgttctttactcaaaagggtaaatgttactggctgaaggtatatgaaatacctgaaggaacaaagaactctaagggccgtgctatccagaacttgctgaacattgactcggacgatgctgttaatgcatatttgcgtgtgaagagtttgaatgaccaggaatatattaacagtcattatgtactgttctgtaccaagaatggcgttataaagaaaacatctttggaacaatactcacgcccgcgccagaatggtgtcaatgcaattactatacgtgaagacgaccgagtaatagaagtgcgtatgaccaacggaaacaacgaaatcatcatagccaaccgtaacggacgcgcaatacgtttccatgaagcagcagttcgcgtaatgggccgtacagctaccggagttcgtggtatcacactggatgacgacggacaggatgaagtaataggcatgatttgcattaaggatctcgagacagagtccgtaatggttgtctccgaacaaggctatggtaaacgttctgatattgaagattatcgtaaaacaaaccgtggcggcaaaggtgtgaagaccatgaatattaccgaaaaaacaggtaaactggttacaatcaagtctgtaacagacgaaaacgacctgatgatcattaataaatcgggtattacaattcgtctgaaagtagctgatgtccgcatcatgggccgtgcaactcaaggagtccgtctgatcaatcttgaaaaacgtaacgaccagatcggttctgtatgtaaagttacatccgaaagcctggaagatgaagttccggaagaagaaagagaaggaaatattccaagcgatccggaaacgaatacaccggtaaatgaaacagaagaatag

SEQ ID NO: 658 - DNA, 996 bp, B.fragilis
attataaatagaatggtttttgccaatattgaatatttgtttttgctgctgttgcttgtgccatatattgtatggtacataatgaagcggaaaaagactgagccgactcttcagatttctgatgcacgagtatatgcgcatgcccctaaaagttacaagaattatctgcttcatgtaccgtttggtctgcgtatcatcactctaatattgattattttggttttggcacgtccccaaacaacaaacagctggcagaacagcgaaattgaaggtattgatattatgttggctattgatgtgtcgaccagtatgttggcagaagatttgaaacccaacaggttggaagctgccaaagatgtggctgcggaattcatcaacggtcgcccgaatgataacataggaattacactgtttgccggtgaaagttttactcagtgtcctttgacagtagatcatgctgtattacttaacttatttcaggggatacagtgcgatattattgaagatggaacagcagttggtatgggaattgccaatgcagtaaccaggttgaaagatagtaaagcaaaatcaaaagtgattattttgttgacggatggtaccaataataaaggagatatttctccattgaccgctgctgaaattgcgaagagttttggtatacgtgtttatactattggtgtgggaacaaacggtatggctccatatccggtacgggttggtggtacaacacagtatattaatactccggtagagattgatgagaagactcttactcaaatagcaggtactacggatgggaactattttcgtgctaccagtaattcgaagctgaaagaggtttatgaagagattgataaattggaaaaaacaaagttgaatgtgaaagagtacagtaaacgtcaggaagaatatcgttggtttgcgttagctgcattcttatgtatattgcttgaggtactgttacggaactcaatattgaagaagataccataa

SEQ ID NO: 659 - DNA, 870 bp, B.fragilis
atggaaacaagtgaaattctaaaaaaagttcgtcggattgaaataaagacgcgtggactgtctaacaatatctttgcaggccagtatcattcagcttttaaaggtaggggtatggctttttccgaggtgcgcgaatatcagtttggcgatgatatccgtgacattgactggaatgtgacagcgcgtttcaataaaccttttgtgaaggtgtttgaagaagaacgcgagttgacggtaatgttgatggtagatgtttccggcagtttggaatttggcactgtaaaacagctgaagaaggacatggtgacagaaattgcagccactcttgcattttctgctatccagaacaatgataaaatcggagttattttcttctcagacagaatagaaaagtttattcctcctaaaaaaggacgtaagcatattctatatatcattcgtgaattgattgattttaagcccgatagtcgtcggaccaacatacgtcttgctttggaatatttgacgaatgtaatgaaaagacgttgtaccgcttttattctgtctgactttatcgatcaggaaaattttaagaatgcaatgaccatagcgaataggaaacatgatgtagttgccattcaagtatatgacaggcgagttgccgagttgccggcagtaggtctgatgcggattaaagatgcggaaaccggacatgaacaatggatcgacacatcttcggctggagtacgtagggcacatcatgaatggtgggtgaataaacaaactgagttagatgaaacgtttaccaaaagtaatgtcgattctgtttcggtacgtactgatcaggattatgtcaaagcattactgaatttgtttgctaaacgaaattaa

SEQ ID NO: 660 - DNA, 1365 bp, B.fragilis
gggtatggaagacctacaggtgttccgcaagaaagaatttgtagactccttatttggagagaatgcatgaaaagaaaaactatagatatcataacattagggtgctcaaagaacctggtggattcagaacagttgatgcgtcaattggaagaagccggatatgatgtaacccatgactcggaaaaaccgacaggagagatagctgttatcaatacctgtggttttatcggtgatgcaaaagaagaatcgattaatatgattctggagtttgcacaagaaaaagaagaaggcaatttggagaaactttttgtaatgggctgtctttcggaacgttatttaaaggaattagcgattgagattcctcaggttgataagttttatggaaaattcaattggaaggggttgttacaggatttgggtaaagcttaccatgaggagcttcatattgagcgtactcttaccactcccaaacattatgcttatctgaaaatatcagagggttgtgatcgtaaatgctcttattgtgctataccgattattacaggaagacatgtatctcgtcctatagaagaaatcttggatgaggtgagatatttggtttccaatggtgtaaaggagtttcaggtaattgctcaggaattaacttactatggagtggatttatataagaagcaaatgcttccggagttgatcgaacgcatttctgagattccgggtgtagaatggatacgtttacattatgcatatccggcacatttccctgaagagttgttccgagtgatgcgtgaacgagataatgtatgtaaatacatggatattgcattacagcatatcagtgataatatgctgcaacgtatgcgtcgtcatgtgacgaaaaaggagacttaccggttgattgaacaatttcgtaaggaagttcccgggattcatttgcgtacgacgttgatggtgggacatccaggagagacagaagaggattttgaggaattgaaagagtttgtacgtaaagtgcgctttgacaggatgggggcttttacttattcagaagaagaaggaacatatgctgcggctaattatgaagactctattcctcaggagctaaaacaggcacgattggatgagttaatggctattcagcaaggaatttctactgaattaagtgcatcaaaagttggacaaaaaatgaaagtcattattgatcgtatagaaggtgaatattacattgggcgtacagagtttgattctccggaagtagatcctgaagttttaataaggtgtgaaggggataatttaatgattggtaacttttatcaagtacaagtgattgattccgatgaattcgatctttttggtgaaataatttaa

SEQ ID NO: 661 - DNA, 1248 bp, B.fragilis
ctttgtaagagccctatgtttgcggagataataactattggtgatgaactgttgataggacaggtgactgataccaattcggcatggatggggcgcgaattaaataaagtaggtatagaggtaattcgtgtcgtgtctgtacgagatcgggcagatgagattattgaagctgtagatgcttcgatgaaaagggcaaatattgtactagtgacagggggcttgggacccaccaaagatgatattaccaaacagactctttgcaaatacttcggtaccagactgatctttagcgaggctgtctttgaaaacgtaaaacgggtattggcgggaaaaataccgatgaatgcgttgaataaaagtcaggcaatggtacctgaagattgcatcgttattaataatcgggtagggagtgcttctgtcagttggtttgagaaagatggtaaggtacttgtttctatgccgggagttcctcaggaaatgaccactgtgatgagtgaagaggttattccacgtttgtgtgcaaagtttcgtacgggtgcaattattcatcgaacatttactgtacaaaactatcccgaatcggtgttggctgagaaattggaatcttgggaaatggcattacctgcttgtctaaaactggcttatttaccaaaaccgggtttgattcgtttaagattgacgggacgcgggcagaatcgtagcgagatagaagcttgtgtaaatactgagagtgccaaacttgaggcaattttaggagaagatattttggatgaggaagatactccgattgaaattttgataggcgaacttttaaagaagaagaatttgactctttctaccgcagaaagttgtaccggtggaagcattgcagcccgtatcacttcggttgccggcagttcggaatattttaaaggaagcatagtagcgtatgccaatgaagtaaagacggagttgctgagtgtatcgatggaaacgcttgaaaaaagaggtgcggtaagtgaggaaacggtcattgaaatggtaaaaggtgcgatgaaagcgctaaaaactgactgtgctgtagctacgtctggaatcgcaggtcccagtggggggactgaagagaagcccgttggtacggtttggattgctgctgcctataaaagtgaaatttgcactatgaagcaggaaactaatcgtggaagagagatgaatgtggagagagcaagcaataatgcccttctattgcttcgaaaattggtgaaatga

SEQ ID NO: 662 - DNA, 1005 bp, B.fragilis
ttagtatttatggctgaatcaattgacatccgcgaattgaacgagcggattgaaagacagagtgctttcgttaccaatcttacaacaggcatggaccaaatcattgtgggtcagaaacatttggtagagtcactgttaatcggactactttctgatggacacgtgctgcttgaaggtgtaccgggtttggcaaaaactttggccattaagacattggcctcgttgatcgatgcaaaatacagccgcatacagtttacgcctgacttattgccagctgacgttgtcggtacgatggtttacagtcagaaggatgaaagtttccaagtgaagaaaggtccgatttttgctaattttgtattggctgatgaaataaaccgtgctcccgctaaagttcaaagtgctttgcttgaagcaatgcaggaacgtcaagtaactattggtaaagaaacattcttgttacctgaaccgttccttgttttggctactcagaacccgatagaacaggaaggtacatatccgcttccggaagctcaggtagaccgttttatgttaaaggtgattattgattatccgaaacaggaagaggagaaattaattattcgccaaaatatcaatggagagaaatttaatgtgaagcctatcttgaaggctgaagagattatcgaggcacgtaaagtggttcgtcaagtttatttagacgagaagattgaacgttatattgtagatatcgtgtttgctacacgttatccggaaaaatacgatttgaaagaattgaaagatatgattggattcggtgggtcacctcgtgcctctattaatttagctttggctgcacgtacatatgcgtttatcaaacgtcgtggctatgtgattccagaagatgtacgtgctgttgcgcatgatgtacttcgtcatcgtatcggattgacatatgaagcggaggctagcaatgtgacttctgatgaaattgtcagcaaaatattgaataaggtagaagtgccttaa

SEQ ID NO: 663 - DNA, 1257 bp, B.fragilis
aacagaagaatagacataatattaataattaatcaaacaacaatcatgaaaagagtattattttcaatggttttactgatggcagtaagttttgcattcgctcaggagaaaaatgtaaaagaagcgaaaagcattgccggagaagtaaaacctgacttcgcaaaagctgaacaactgattaacgaagcattaactaaccctgaaacaaaggataatgcggcaacttgggacgtagcaggttatattcagaaaagaatcaacgaaaaggagatggaaaatgcttatctgagaaaaccttatgatacattgaaggtatacaatagcgtactgaatatgtacaattattacgttaaatgtgacgaactggcacagattcctaatgaaaagggtaaaattaaaaacaaatacagaagcgccaactcaaaaacaattctggcagaacgtcctaacttgattaacggtggtattcaatacttcaatttaaataagaacgaagacgcattaaaatattttgcagcttatgtagatgcagctacactgcctatgatggaaaaagaaaacttgctggaaaaagacaccattttgccacaggtagcatattatgccactttggctgcagatagagtaggtgacaaagatgctgtcatgaaatatgctcaatatgctctgaaagacaaagaaaatggccaatttgcaatgcaattgttgacagatgcttacaaagctaaaggtgatactgctaaatgggtagaaaaattgcaggaaggtattgttaagttccctgaaaatcaatatttcttcgcaaatctggttgactactatagcagctccaaccaaaatgataaagcaatgcagtttgctgatgatatgttggctaaagatccgaataacaaattatatctgtatgtgaaggcatatctgtatcataatatgaaagattatgagaaagcaattgagttctataaaaagactctcgacatagatcctgcatatgcagaagcatgctcaaatttaggtttggtatacctgttacaagcacaagaatatgctgacaaagcaccggcagatatcaatgacccgaattatgcaacagcacaagctgagatcaagaaattctacgaagctgctaaaccgtattacgaaaaagcaagagagctgaaacctgatcagaaagatttgtggttacaaggtctttaccgagtatattacaacctgaatatgggaccggaattcgaagaaatcgagaaaatgatgtaa

SEQ ID NO: 664 - DNA, 303 bp, B.fragilis
aattgtaggattttgaataataaagaatttacttctgaactttctcgcagattggggtataatacaaaatatacttctgaactgataacatctctgctgtctgatattactcaggaattgcaggaaagcaatgctataggaatacagggatttggtacttttgaggtaaaaaagaaagcagaacgtattgtcatcaatcccgtcactaagttgcgactgttggttccacccaagttagtactggcgtttaagccgagtcctatattaaaagataagtttaaagaaacatttccgtatgaatga

SEQ ID NO: 665 - DNA, 441 bp, B.fragilis
ttaccgatggtgaaaatcatgaaagggggagctgttgaagctggcaaaaaggcggctaaaaagggaattcaggtgaatgtattgggagtaggcttacccgatggagctcccattccgattgagggcagtaacgactttcgtcgtgaccgtgaagggaatgtaattgtgactcgtctgaatgaggcaatgtgtcaagagatagcaaaggaaggaaatggtatttatgttcgtgtagataattctaattctgctcagaaagctattaatcaagagattaataaaatggctaaatcggatgttgaatctaaggtttatacagattacaatgaacagttccaagtgattgcatggatgatattgctcttgttattggtggaaatgttgattctggaccgcaaaaatccattgtttaagaacatcaggttgttttctaataagtag

SEQ ID NO: 666 - DNA, 216 bp, B.fragilis
agttttctatcttcaaaacaggatgcaaaaatactaaaaatgggtgaactgtgctcattctttatctataattttaagagaggtcataccaaggttatatataaatcagccggtttatggatcgacaaccggccggtttatggtttctctaaagacaagagatcaccatttcctgcccttctcttccaacgggaaccatacatattagagaattaa

SEQ ID NO: 667 - DNA, 1551 bp, B.fragilis
acaaacctcccccctcgtctgttacaaggactcataaacctaaaccgtaacagacgtatggaaaaaaagaaaatacccgtcgcactgatgatagcggcaggaatgctcttatacaacaacaccgtcgcggcgcagagcctccctcccacacaggaaacttcgcaacatcagcttagctttaacgaggcgctgcaactgctgcacaaaggcaaccaaagcctgaagatagccgacaaaggcatcgacatagcccgtgccgaacgtgggaagctgaatgctttctggatgcccagcctgcaatcgaccggagcatttgtacacctttcggagaagatagaagtgaagcaaccgctttctcaattcaccgatccggccaaagacttcgtacattccatcttgccggacgataaaatcatatcgtccatactcgatcaaatcgggacgaacaccctcatctttccgttggcaccgcgcaacctgaccactgtcgacctgaccgccgaatgggtattgttcgccggaggcaaacgtattcatgccactaagataggcaatacgatgatagaccttgcccgtgagaaccgggcacagaccgatgccacccaacgaacactgcttgccgaaagctactacggattgcgcctggcacaagaaattgtcggtgtccgcctggaatcgtacaaagcactgaagctgcattacgagaacgcattgaaactggagtccaccggtatgatagataaagcggcacgcctctttgcccaagtcaacatggacgaagcactgcgtgaactggaagccgcccgcaaggaagaggccgtggtgcaacgcaccctcaagaccttgctgaatctggagacgagcggagacatctcaccttcctctcccctgtttatcaacgatactcttcctccgaagatggagtttatgcaggtagtgggcatcagtaactatctgctcaaccaactgagtcttcaagaacacatggccaagcagcaggtccgcatcgaccagagtggctatctgcccaatatcgcccttttcggcaaacaaactctttattcacatggcatacagagcaacctgttgccccgcaccatgatcggggtaggcttcacctggaaccttttcgacggactggaacgggagaagcgaatccggcaatcacgcctgacacaacaaacccttgcactaggacaggagaaagcgcgtgacgacctgtccgtcggggtagacaaactatacaccggcctgcaaaaggcactcgacaacgtgcgggcgctgaacaccaccatcgaactgagtgaagaactggtacggatgcggaaaaaagccttcgccgaaggaatggtcacttcgacagaggtagtagacgcagaaaccttactttcgaaaacaaaagtagccagactggcggcctactacgaatatgacgtgacgctgatgaatctgctggcactgtgcggaataccggaacagttcggaagcatgaaggacatcacctctcttcccattacggagaacagaagaaatgaaatagaaatcgaatga

SEQ ID NO: 668 - DNA, 201 bp, B.fragilis
aaaacacaaccgtctttcggagtaaatgcttacttcttttggtcgaaatatcggctcttcgaagtgaaaacacagactcttccccttcccaagcccggttttctgggcaaagaagcagaaagttccgggacattctcccctatatgggtaagaaaacaaaaagggatagttagcagaaaatgccattacctgtctttttga

SEQ ID NO: 669 - DNA, 435 bp, B.fragilis
tttctatatactctgccagactttgtatgctggctaccgggagcatggggatctggaatccatttgtgccattttctctcttccggtacgccattggaaagattgcaatcggtgttcggacatatcaatgggatgcctgctttgtcaagtgcttccgaagcaaagaaaatgtgtatgtttctgcgttggatgattcgtagggattctcctgtcgacctcggtatttggcggagtttcagtccctcagatctaattatccctcttgacactcatgtacatcgcatctcgactgatcttggattgaccaatgcacgtaaatgcctgaaaacagcacgttgcattactgatgcgttgcgggaaatatggccggatgatccggtaaagggagattttgctcttttcggatttggtatcaacgaaccggtgaaaagttag

SEQ ID NO: 670 - DNA, 807 bp, B.fragilis
caaggaggggcaggcatggctaactggataaccctcaaacaactgtcggagaaacgcggtattgccgaatccgacctccgcacatgggcaaacttgggatatatcacttcatcgaggatagagaacgtcctaatgattgatgacgaaagcctgacccaatatcttgatgttcaccagaccaaagatttaggtgagaactatctggaaaagattatcaaagaaaaggaactggaacgtgaagtactcctctcacaatgtgacgacgaactatttctattgaaaacccagaaactacaccaaccgctttttcatatcctcattcaggaactcggccagttgattacagacgatcatgaacgggaaatattcctttccgtctccagtggcgaacccatcgcacgggtggcgaaacgtaacaaaatgacgtatgcacgagtggcgacttgctatagttccatcctccggactctgggtgaacataagggacgaatcgccacatttcgcagtcggacgatggaactgatgttcgataaatgcaatgcggtcacacccgtaaatactcccctatcaaaccttgtcggcgcgcatgcctataatgttttatatggagagatgggattcaggacagtacgcgaccttctacaatacgccacccagaacggatggcaaagcctgagacgcttcaagggtatgggactggttacgtataagagtgtgatgaacgcactaagggatgccaacttcatcattgtccgcaaagacggaaacatcgagctgtcaccagagatcgctgcactggtaatataa

SEQ ID NO: 671 - DNA, 1242 bp, B.fragilis
  unsure (1135): Identity of nucleotide sequences at the above locations are unknown.
gagaaaagatattctcagtgggactctgtgctactctgtggtaaatcaaaactcaaagacaatctaattatgcaacactcccctataacccgtgtcatacaatgtgagtggcaacggatgacctctcgacgcctctacttcggtgtctgcctggtacttccgttgttcacgctctttttcatggctaccatattcggcaacgggcagatggaaaatatccccatcggcattgtcgaccgggacaacacggccacttcgagagatattacccggcggatgtctgccgtacccaccttccgggtaacccgccacttcgttgacgaagccgaggcacgcaaagcggtacagcagaaagaaatatatggttatctctcgatccctccccgctttgaacaagatatgatatcggggcaggacgccactctgaactattattatcactatgccctgctctcggtaggaggtgagttgatggccgccttcgaaagctcgctcgcacccgtagctctctcccccatcgtgatgaaagctgtggcgctgggagtgaacgaacagcagatagaaacctttctactccccgtgcaagccaacaatcatcccatttataacccgtcgctggattactcggtctacctgagccagcctttcttttttgtactctttcaggtgttggtactgcttatcacggtatatgccgtaggaagcgaaataaagttcggtacagccggtcaatggttgcaggcggcgggcggcgacatcacggttgccgttacgggcaagctgttgccttatacgcttatcttcagcctgatcggtatattgggcaactttgtcatgtttggcatcctgcatataccttttcaagggagttggctgctgctcaacgtcatgacagtgctctttatcatttccactcaggcactggcattgttcatcttctccctgttccctgccgtggcaatcatcatcagtatcgtatccatggtcggctcgctgggagctactttatccggtgtcacctttccggtactcaacatgtatccgttggtgcgcgacgcctcttatctgtttccggtgcgccattacaccgaaattacacaaaccatgctctactatggcggcggatttatccacntatggccttcggcagtgatactctgtatcttcccgttattggcgttggcgatgcttccgcacctcagacgagccataatcagtcgtaaatatgaaaacatccggtaa

SEQ ID NO: 672 - DNA, 753 bp, B.fragilis
ataaagaatctatattttatggagattttctggaaaactattgcgtattataattctgctacatggatctatcagttactgatcattgtcgccggcctgctgttgacagtgatgcttataaagaatccccgtccgtgggtaaagatgggcatgaagctatatatgatttttctgtatttgtggattgctatcgcatattatgccatctgttgtgacgagcgcagttataacggggcgctggctatgttctgggtggttatggccacgatatgggtatgggatgccatcaccggatatactactttcgaacgtacatataaatatgatatcctttcgtacgtattgttgattttaccatttgtatatcctttggtatccattgcgagaggacttacttttccaggcattacatcgccggtaatgccttgctcggtaacagttttcacgatcggtctgcttttgttgttctcccgtaaggtaaatatgtttttggtgctgttcctgtgccattggtcgctgatcggcttatcgaagacttacttctttaatattccggaggatttccttttggccagtgcaacgatccctgccctatatctctttttccgggagtatttcctcaacaacctgcatgccgatacaaagcctaaagcaaagtacattaattggttgcttgtctttgtatgcgtatctatcggaatcttacttaccaccaccctgtttctggagttgatgccgggcaaacagccgtag

SEQ ID NO: 673 - DNA, 1503 bp, B.fragilis
cgtgacgaacacgatatgaataagaacttacaccctttgatgctggccggaaccggtagcgatgtaggcaaaagcatcattgccgcagctttctgccgtatatttctgcaagacggttatcatccggcaccattcaaagcacaaaacatggcattgaactcttatgccactcccgaaggacttgaaataggaagggcgcaagccgtgcaggccgaggccgcaggtgtgccttgccatacggatatgaacccgttgcttctgaaaccatcgtccgatcatacttcacaggtggtgctcaacggacgtcccatcggcaatcggaatgcttacgaatatttccgccgtgaagggcgggaggaattgcgaaaagaggttcatgccgcattcgaccgtttggctgcccgatataatccggtagtgatggagggagcggggagtatctccgagatcaatcttcgtgacagcgatctggtgaatctgcccatggccatgcatgccggggcagatgtgattctcgtggccgatatagaccgtggaggagtgtttgccagtgtttacggttcggtgatgctgcttcggccggaagagcggaagcatatcaaggggatattgattaataaattccgtggagatatccgccttttcgagtcgggggtaaagatgctggaagatctttgtggtgttccggtggttggggtggtgccctactataaagatatctatattgaggaagaagactcggtgatgcttcagaccaagaatatccgtgccggacaaggcaaagtgaatgtggctgtcgtgttgcttcgtcatttaagcaatttcaccgacttcaatgtcttggagcgcgatccgcgtgtacacttgttctacaccaacaatacggacgagttgatgaaagcggatatcatcctgttgcccggttcgaaaagcactttgtccgatctgtatgagttgcgccgcaacggagtggcgcaggccatcgtccgtgcccaccgcgaaggtgccacggtaatgggcatttgtggaggttaccaactgatgggtagggaggtttgcgatcccgatcatgtggaaggcgagatagaacgcttgccgggattggggttactgcctgtcagcacccgcatgcagggagagaaggttacccgccaggtacggttctgttttcttgaagacagcgctgtctgcgaaggatacgaaatacacatgggaacgaccacgccccttgcggatgttcctgtttctccactcaaccatctggcggacggaagggaggatgggtattttgtagaccgcacctgcatgggaacatacgtacatggcattctcgacaatccttcagttatcgattacctgctggagcctttcgccgataaactgaaagagacggcttttgattacaaagcatttaaagaagaacaatacgataaactggcagcccatgtccgtaagcacgtcgacttgccgcttatctatcaaatattgacagacaatgattga

SEQ ID NO: 674 - DNA, 1203 bp, B.fragilis
tcagtcgtaaatatgaaaacatccggtaaactttcgcagatttcctttatcatcgcacgtgagtttcgtgccatcagcaccagctatgccgtactgttggtactgatgggaggtatctttgtttatgggttgctctataactatatgtatgctcccaatatcgtgaccgacgctccggtggcagtggtcgacaactcgcacagcagccttagccggcaatacatccgttggctcgacgccacgccgcaagtagccgtatacgcacaagccatggactatcgggaagcccgcgaatggatgaaagagggcaaggtacaaggcattctgtacattccgcatgattttgagacccgtgtcttccagggacgcgaggctgtattctcactatacgccaccacagacgcctttctctattttgaagcgctgcaagaagccacttcacgtgtataccttgccatcaacgatgcccatcgcatggacggtgccgtattcctccccccgcagggactgcttgccgtggccatggccaagcccgtaaacgtgaccggcaccgcactctataaccacaccgaggggtatggttcttatctgattccggctgtcatgatggtcattatcttccagaccttattgatggttatcggtatgctgacgggtgacgagtatcagcaccgcgctacagaaccgttgcttccggggggcaggacagtagataaaagcggactctggggaggggcaatgcgtcttgttgccggaaagacttttgtgtactgcggactttatacggtcttctccatgttcttgttaggattattaccccacttcttcagcattcccaatatcggaaacggactgtacattaccgctatgatggtaccttatctgatggcgacctctttcttcgggctggcagcctcgcgttacttcaccgattcggaagctccgctgctgatgatcgctttcttctcggtaggcttgattttcctgtccggagtctcctacccgctggaactgatgccatggtattggcgcatggcacattacatcctcccggccgcacccgccacgcttgctttcgtcaagctaaactcgatgggagccgatatggcagacatacagccggaatacattacactgtggatacaggtgatcgtctatttcgggctcagcgtgtgggtatacaagaaaaagctggaagcgtga

SEQ ID NO: 675 - DNA, 966 bp, B.fragilis
ccaagcccaaaggctctctgggaacacttgaagaactggccttgcagatcgggcttatcccagcaaacacttactcccgagctgagacatcctcaaaatatcatattcgcagccgatcatggcattgtcgacgagggagtcagcctctctcccaaagagatcacctggcaacaaatcagcaattttcttcacggaggggcaggtgtcaacttcctttgccgccagcacggattcgagttgaagattgtagatgccggagtggattacgacctcccatacgagaaaggaatcatcaacatgaaggtacgcaaaagctcgcgtaactatctgtacgaggcagccatgacagaagaagaaatgaatttgtgcatcgagcgcggagcggaagtagtccgtcagtgtcatgccgaagggtgcaatgtgctttctttgggcgaaatgggtatcggcaacacttcttcgtcttccatgtggatgacgtgcttcacccatattcctctcgaactgtgtgtcggagcaggcagcggactcgacaatgcaggcgtccgtcataaatataatgtattgcagcaggcactggaccattatcagggagacggaagcgcacacgacctgatccgctatttcggcggactggaaatggtaatggcaataggcgccatgcttcaggcagccgagttaaagatgattatcctggtagacggattcatcatgacaaactgcatccttgcagcctcccaactttaccctgaggtattgcattatgccatcttcggtcatcagggagatgaatccggacataagctggtacttgatgccatgggagccaagccattactgaatctgggtttacgtctcggagaaggaaccggcgccatctgctcctatcctatcattgactctgccatacggatgatcaacgagatggacaactttgcacatgcagccatcaccaaatatttctaa

SEQ ID NO: 676 - DNA, 621 bp, B.fragilis
agccatgcaaagataaatattgtttccgaaatacccatagcaatggcacaatattttgcatccgggaatggaaatataaaatattaccgtacatttgctaaccaaaaatacacagatagattcatgaaacagatcatactcatcaccggaggagctcgttcgggcaaaagcagctatgccgaacgcctggcgttatccctctctcctaatccggtttacttggccacctcacgtatctgggacgaagaatttcgtcaaagggtattgcgccatcaagccaaccgcggaccggaatggaccaatatagaggaagaaaaagaattgagccgccactctttggaagggcgtgtagtgctgatcgattgtgtaaccctctggtgcaccaattatttctttgatctcgaagcagacaccgacaaggcactgactgctgttaaagccgagtttgaccgactgacacaacaggacgcgacccttatttttgtcaccaacgaaatcggtatgggaggaacttcagaaaacctgatacaacgaaagttcactgacatgcaaggatggatgacccagtatatagcctcccgggccaatcgggtaatactaatggaacggggattcctgtga

SEQ ID NO: 677 - DNA, 1509 bp, B.fragilis
aagaagaaaaatataatggcaaaagaactgaaagacctgaccaaacgcagcgaaaactattcgcagtggtacaatgatttggtggtgaaagccgatttggcagaacaatcggctgtgcgtggatgtatggtgattaagccttacggatacgctatttgggagaaaatgcagcgtcagctggacgacatgtttaaagaaaccggacacgttaatgcttatttcccgttgctgattccgaaatcatttctgagtcgtgaagctgaacacgtagaaggctttgccaaggagtgtgccgtagtaacacattatcgcctgaaaaatgccgaagatggttcgggtgtggtggtcgatcctgctgcaaaattggaagaagagttgattattcgtccgacttctgaaacaatcatttggaatacttataaaaactggatccagtcatatcgtgatctgcctattttatgtaatcagtgggctaacgttttccgttgggaaatgcgtacgcgattattcctccggactgcggaattcttgtggcaggaaggtcatacagcacacgcaacgcgcgaagaggcggaagaagaggctatccgtatgttgaatgtatacgccgagtttgcagagaagtatatggcagttccggtagttaaaggtgtgaaatcggctaatgagcgctttgccggtgcacttgacacgtataccatcgaggcaatgatgcaggatggtaaggcattgcagagtggtacttcacacttcttgggacagaatttcgcaaaagcattcgatgttcagtttgtaaataaagagaacaagcttgaatatgtatgggctacctcttggggtgtttctacccgtctgatgggggcactgatcatgactcactcggatgataacggtctggtacttcctccgcatctggctccgatccaagtagtgatcgttcctatctataagaatgacgagcagttgaagctgattgatgctaaggtagaaggtattgtggcaagattgaagcaattgggcatttcagtgaaatatgataatgctgacaataaacgtccgggctttaaatttgccgattatgaattgaagggtgtgcctgtccgtctggtgatgggtggacgtgacttggagaacaatacgatggaggtaatgcgtcgtgatactctggaaaaagagactgtgacttgcgatggaattgagacgtatgttcagaatctgctggaagagatccaagctaacatctataagaaagcgcgtacttatcgtgactcacgtatcactacggtggatagctatgatgagtttaaggagaaaatcgaagaaggcggctttatcctggctcactgggatggaacagtggagacggaggaaaagatcaaagaggagacaaaggcgacgattcgttgcattccgttcgaatcgtttgttgaaggtgacaaagagccgggtaagtgtatggtgacaggaaaaccgtctgcttgccgtgtgatatttgctcgttcttattaa

SEQ ID NO: 678 - DNA, 507 bp, B.fragilis
gtctatatgaaacaagaactaaaggaaaagcttttgcttttagcggataaatatgaggtgaaagaatttattatggacgatccgatacagtttccccatcggtatactgataaagctgatattgagatctccggactgatcgctttctggatcgctaccggtaatagaaaggccattatcaaaagtggtgaccggattgatcacgagcttttcctgaatgctccatatcgatatatattaagtgaagaatggaggaaatatcgggggagtaacatccagttttttatcgctattactcctggaatgatttctatatactctgccagactttgtatgctggctaccgggagcatggggatctggaatccatttgtgccattttctctcttccggtacgccattggaaagattgcaatcggtgttcggacatatcaatgggatgcctgctttgtcaagtgcttccgaagcaaagaaaatgtgtatgtttctgcgttggatgattcgtag

SEQ ID NO: 679 - DNA, 345 bp, B.fragilis
tctgtggtgaagttcattataacatattcgtttgtcaaattggtaccttataaaatgttttctggatcaaaaagacaggtaatggcattttctgctaactatccctttttgttttcttacccatataggggagaatgtcccggaactttctgcttctttgcccagaaaaccgggcttgggaaggggaagagtctgtgttttcacttcgaagagccgatatttcgaccaaaagaagtaagcatttactccgaaagacggttgtgtttttcaaaaatgaataagagttttgcccaatatctctatatgttttcttccattacatatattgttcttatttgggagtga

SEQ ID NO: 680 - DNA, 1002 bp, B.fragilis
gagatggagaattcagaatctaaaaaaggcagaaccttaagtatcgcattcatcgttgtacttgtggcagtagcactcttcaccgtcatcggaatgattgccatgcgccaccagcctctcgtcttgcaagggcaggccgaagctaccgagattcgcatcagcggcaaactgccgggacgcatcgacaccttcctggttgaagaaggccagtgggtgaaacaaggagatacgctggtagtcatcaacagtccgactgtagaggccaagtatcgccaggtggacgcattgaaacaagtagccgtagaacagaacaagaagattgacgccggaacccgcaagcagatcatagctacggcgcagcaattatggaacaaaactcaaagcgacctgacattggcacggacaacgtacaaccgtattctcactttatataaggacagtgtagtcacttctcaacgtaaagatgaagtggaagccatgtacaaagccgcacaagcggccgaacgggctgcttacgagcaatatcaaatggctgtagacggagcacaaagtgaagataaagcctcggcccgctcgatggtcaatgcggccaacagcacggttgatgaagtttcatcactcctggtggatgcccgcctgatcgcaccggaagatggacaaatagcaaccatctttcctaaacggggcgaacttgtcgcaccgggcactccgatcatgaacctggtggtgatggatgatatacacgtggtactgaacgtaagggaagacctgatgccggacttccgtatgggaggtacattcattggggatgtgcccgccctggcccaaaaaggaatcgggttcaagatatattatatcagtccgctgggtagttttgctacctggaagtcgaccaagcaaacgggcagctatgatttacagacattcgaaatccatgctcgtcccaccaagaaagtggaggggctgcgtccgggaatgtcggtactggtagaaatcaaatag

SEQ ID NO: 681 - DNA, 411 bp, B.fragilis
gaaccggagaaagcaagtcaagaccggccgaagaactacttgcagaacttatcagagaaagggaaggtaatgattgaaatacataccatcgtaacctttgataaagaaatgaaacggcttagtaagaagtatcattcaataattaaagattacgcagctctgatagaagatttaaaaaagaatccgcatataggggtagacctgggaaacggcatacgaaaagtacgaatggctatagccagtaaagggaaaggaaagagcggaggcgcacgggtcatcaccgatacatcagccattatcagcgtagaagaaggcagagttaccctacttaccatttatgacaaatccgaccgggaaaatatctccgacaatgagataataagacttcaacaagaaattctgaagaagtaa

SEQ ID NO: 682 - DNA, 498 bp, B.fragilis
aaacagtttgatatgatagctttagatattctttccgatggattttttgccgcaatagcgggtattggttttggagccatatccgatcctccgttgcgggctttcaagatgattgcgatacttgcggcagccggacatgcctgccgttattgcctgatgactttcctgggtgtcgacattgccacggcttctttgttcggggcattggttatcggctttggcagtttgtggctcgggcggaaggtgtattgtccgatgactgtgctttatataccggcattgctcccgatgattccgggtaagtttgcctacaatatggtgttctcgttgattatgagtctgcaaacaatgaacgaaccggagcgtctgggcaaatacatggagacgtttttctctaatggcctggttacctgtaccgttatctttatgttggcagtaggagctaccttccccatgtttctgcttcctcacaaagctttttccctgacacggcattaa

SEQ ID NO: 683 - DNA, 840 bp, B.fragilis
aatgacttatgtgctttctctttcctttcttttttgtacttttgcgcccgatttaaaaaagtgagcaattttatgactacaaatgaatctttgatttccatatccaagttcattgccggatattcggcccatttgatgggagcaggtgtgcatacctcccgtgtgatccgtaattcaaagcgcatcggagaagcctatggagtggatgtgaagttgagtgtgtttcacaaaaacatcattctgactatcattgacaacgagacgcgtgaagcctgcaatgaagtgattgatatccctccccatccgatcagttttgaacataactcagagttgagtgccttgagctgggaggtttacgacaaacatctgtctttacacgaattgtcggataagttcaacaaaatcatatcggcaccgaaaatagatccgctatttgttcttttactggtcggatttgccaatgcttcattctgtaagttgtttggtggcgatattatttctatgggcattgtcttttcggctaccatcaccggacttttcctgaagcaacagatgcagaagaagaaaatcaatcattatattattttcattgtttccgcttttgttgcgtcgctttgtgcatcgacggcactgatttttgataccacttcggagatagctcttgccaccagcgtgctttatctggttccgggtgtgccgttgatcaacggtgtgattgatattgtagagggatacatccttacgggatttgcccgattgacggaagccgcgctactgattgtcagcattgcgataggcctgtcgtttacattgttaatggttaaaaacagtttgatatga

SEQ ID NO: 684 - DNA, 1743 bp, B.fragilis
tcgcctctccggggatatgtaaacaagtattcaatcaacataactttttatactatggaacttttaagaaacctgtttgagggataccccaacctttggggtggaggagtggcacattccgtgcttatcctgtcgctggtcattgcgtttggcattatgctgggtaaaataaaagtagcaggcatctctctgggagttacctggattttgtttgttggcattgtcttcggacattttaatctgaatctgaacgagcatttattgcactttctgaaggagttcggacttatcttatttgtatattccatcggattgcaggtggggcccggattcttctccgcttttaagaaaggaggattcaccctcaatatgttggctatgatcgttgtctttgcaggagtcatcattacccttgcattgcattttataaccggaataccgattaccaccatggtaggtattttatcgggagcggtgaccaacacacccggattgggtgctgcgcaacaggccaacagtgacctgaccgggatagatgcaccggagattgctttgggatatgctgtagcctatccgttgggcgtagtgggatgcatcatgtcgctgttaggccttaaataccttttccgtattaataccaagcaggaggaagccgaagccgaacagggactgggacatttacaagagttgacagtccgtcctgtttcattggaggtccgtaatgaagctcttcacggtaaacgtattaaggatatacgtccattggtaaaccgtaattttgtggtatcgcgtatccggcatttgaacggaaagaaagagtcggaattggtaaattccgatactgagcttcatctgggtgatgaaatattggttattgcgactccgatagatatagaggcgatcactgcgtttttcggcaaaccgatcgaagtggaatgggaacagctgaacaaagaactgatttcacgccgaattctgataaccaagcctgaactgaacggtaagacattggcgcaattgaagattcgtaataattttggtgccagtgtcacccgcgtcaaccgttcgggagtggatctggtggcaagtccccagttgcaattacaaatgggagaccgtgtgacgattgtcggcagtgagttggcggtgagtcatgcagaaaaggtattgggtaattcgatgaaacgcctgaatcatccgaatctgattcctatttttctgggtattgccttgggatgtatcctgggtagcatcccgtttatgtttcccggaattccccaaccggttaaactcgggttggcaggaggcccgttgattgtttcgattcttatcagccgtttcggcccgcagtataagctgattacttataccactatgagtgccaatctgatgataagggaaatcggcatctcgctgtttcttgcttgtgtcggtctcggagccggtgacggatttgtggaaaccattatccatgaaggcggatatgtgtggatcgcttacggtatgattataacaatcgttcccctgctgctggccggttttatcggacgttatgctttcaagctgaactattatacgttgataggggtgttggccggttccacaacgaatccaccggcgttggcctactccaatgatctgacatcgtgtgatgcgccggcagtaggttatgctacagtctatccgctgacgatgttcctgcgtgtgcttacggcacaattattaattctttcgttaggttga

SEQ ID NO: 685 - DNA, 576 bp, B.fragilis
atgatgaaacgaatctatacacggaccggtgaccggggaacaaccggcattcatggcggagaaagggtagagaaagatgatatccggatcgaggcgaacgggaccatcgatgaattgaatgcagtgatcggcattatccgttcattgctccctcaggagcatgactggcagaagttgctgcaccacctccaaagagagttaatggtagttatgagtcatgtggctactccatccgccattcgcgataagaatccgaatgtgctgtcgcccggactggcggctttctgtgagcaagagatggatacaatgactgccggactgaaagagaacggttatttcctgttgcccggtggcacacctgtctctgctcagttacagtttgcccgtaccgtagcccgccgtgcagagcggcggctctggaccttgaatcggcaagatgctgttccggaagatattctgagctttatcaatcgtctgtccgatctgttttttgtaatggcacgcttcgacatgcaacaacaggactggccggaggaacgctggcaggccttcgcatataagacaaagaagaaataa

SEQ ID NO: 686 - DNA, 783 bp, B.fragilis
cagaatgtcaggcggagaatgtgctttcggtctgttatgcggtatacttccttcagcactcctgctaccgtaccgatactggatggctatcgtatttccgctgatcatgctgtatctgctttgcacactgatgaaacggaagttgcaaggttataccggcgactgttgcggagcactgtttcttctaagcgaactgtctttctacctgggaatagttatactaatgtttatatagtcatggaagtcatattaatccgccatacctctgtcgatgttcctaaaggagtctgttatggccagactgatgtacctttgcgagatagttttgaagaagaagcctcaattacggctcaacaactacagaacgacgtatttgatgccgtattcacaagcccgctgagtcgttgcacccgcctggcagaccactgcggttatccggatgccattcgtgatgcccggctgaaagagctgaacttcggtgaatgggagatgcaggagtttgataaaatatgtgatccgcgactggaggagtggtataacgactacttccatgtagcggctacaggcggagagtcttttatgatgcagcttcaacgggtatcggagttcctgaatgaagtgagtggaaaagagtataaacgcatagccgtctttgcacatggaggggtgctgatttgtgcacaaatctatgcagggatactgagaatggaagacgcttttaacgcactgacaccttacggcggagtggtccggctgcaacttaactcaaagacagaagaatag

SEQ ID NO: 687 - DNA, 978 bp, B.fragilis
  unsure (704): Identity of nucleotide sequences at the above locations are unknown.
gatagagaaagtatggatggaatgttcttttggtatattagccttgtgtatttttgcaggttgtttccgttaccgttagcctggttgttcgatcgctggcaaggcgatccgtcctggttgccgcatcctgtggtaggattcggtaaactgatagcttggggagagaagtgtctgaatgcggggagagcccgcgtttggaaagggggaatgatgtcggtagcattgattgtgggagtctacttttttaccttcctcttttttaaagtgatcggagagtattccatcatactgacagcgctgatacaaacactgctgatcttttgttgcctggcaggtacaaccctgatacgtgaggtccggatggtcttcgaagccgtagaccgttcattggacgaggggcgtaaacaagtggcccgcattgtgggacgggatacctctgcactatctgcacaagaggtgcgtaccgcagctttggagactttagccgaaaatctgagtgatggggtaattgcaccacttttttggtatgcagtgttgggagtgcccggcatgatggcgtacaagatggtgaatacacttgactctatgatcggttaccgcaacgagcgttaccgtcaattcggctgtatagctgcccggatcgatgatgttgccaattatattcttgcccgcctgacggctttgttgatgatcctcgtcaccgnacggttttctttgctcaggttcgtgggtaaatatggcagccggcacgccagcccaaactccggtatccccgaagctgctttggccggtattctgaattgccgtttcggcgggccccactattatttcggcgaagaggtgtggaagccttttataggcaacaacgaacgagcattgacaaccgaggatatgaagaaagccgtctgtgtcaatcggcaggcagaggtactgatggttgtgttggtgtggctgactattcttctgtctttgagttaa

SEQ ID NO: 688 - DNA, 399 bp, B.fragilis
tttattatctttgtatttgtactaaaagaaacaagatgtattatgaaagagcctgaaaaatacaagcaaccagaagaggaaaccacccgactgtccgagccgacagtagcttacaatagtatggcttatctcgaattagaagcagaaaaagcagaactgatccggactattgccaacatagacagtaaagaaatcatcgataaagtgaaacagaaacttcacgatgtactcggtttggacaaaaacagggaaaccgaaccggagtgtaaaaaatatattctcgcaaatataaaagaagccttctgcgaacaagaaagagtaagaaccggagaaagcaagtcaagaccggccgaagaactacttgcagaacttatcagagaaagggaaggtaatgattga

SEQ ID NO: 689 - DNA, 3255 bp, B.fragilis
atcaatttaatagataatcacatgaacaagaaactaatcctatctattttcgttctggcaggtgctcctgtgctgctgtcggctgcaggagaagcacggttgttgcgtttccccgctacgaacggaaatgagatcgtattttcgtatgcgggcgatttgtataaagtgcctgcttcgggaggtgaagcacaacgcctgacttcccatgtgggatacgaaatgtttccccggttttctccggacggcaaaacgattgcattcaccgggcagtacgatggaaatacagaagtgtataccatgcctgcaacgggtggcgaaccactacggataacctacacggctaccaatagccgtgacgacttgggtgaccgtatgggacctaacaacattgttatgacatggactccggacggacaacgtatcgtgtatcgtaatcgcatcagcgacggattctccggtaaactctttactgtagacaaagaaggcggattgtcagaagtcattcctcttcccgagggaggcttttgcagctattcaccggacggaaaacaattggcatacaaccgggtgatgcgcgaatttcgtacctggaagtattataaaggcggtatggccgatgacatctgggtgtataatccgggaaacaaaacagtggagaatgttaccaataatgtagctcaggacatttttccgatgtggattggcgatgaaatctttttcctttccgaccgtgaccgtatcatgaatatcttcgcatacaatacgaagaccaaacagactgtaaaggtgacgaacttcactgagtatgatgtgaaattcccaagcgtccatggcaataccatcgtttttgaaaacggcggatatatttataagatggatgctgcggcccggaaagctgaaaaggtaaacattacactggcttctgataatatctatgcccgcaccgatttgaaagagggagcgaattatgtgactgcggccagcctttcaccggatggagcacggatggtagtgacaagccggggtgaagtattcaatctgccggtagagaaaggggttacaaaaaatataactcgttcgccgggagctcacgatcgtgatgcacagtggtcaccggacggaacacagattgcttatatctctgatgccacaggggaaaccgaactttatctgcagaatgcggcaggtggcgagccgatgcagtttactcataagaacgatacatatatccgtgactttaaatggagtccggattctaagaagatagtgtatatggatcgtaagaaccgagttaatctgctggatgtggcttccgggaaagtttctttattattgcaagatccggtgggagtgccgggtggagttactttctctccggacagtgagtggttgacttatacacggatgggtaaaaatgaaatcaatgtcgtatatgtctacaacattgcggaaaagaaagaatatccggtgaccgacaaatggtataactcttcttctccggtgttcagtgccgacggaaagtatctgatattctcttctgcccgtgattttaacccgacttacggatcattggaatggaaccatgtatataataatatgtatggtgtgtacatcgctttgctgtctaaggatacatcgtctcctttcatgcagaaagatgcggaagtggctgtatcgaatgctacccccaaaagcggggataagaaaccggcagataagaaggaagtggccgatgcttcgttggtgaagttcgatccggatggcattaccgatcgcatcgttcgcttgcccttgtctccgtcttattatggtaacttttattcggatggcaacaaggtgtactactggggacgtggtggtacgaaaatgtatgacttggcaagtcagaaagaggaatcgattgccgatggagcttcgatggatgttacttacgatggtaagaaggcacttttctttaaaggccgtcagatttatgtgaccaatcttccttcgggtaagacagaactgaccgctccggtcgatttaagcaatatgaagattactgtggattatccgaaagagtgggcacaaatttttgatgaagcttggcgtgcctatcgtgacggattctatcaggagagcatgcacggtgtagattggaaagcaattaaagaaaaatatgcggtcttgctgccttacgttaaaactcgtttagacctgaattacattatcggtgagatgataggtgaattgaactgtgggcatgcttatgtcaatccgggagaaacggaacagcccaaacggatcaataccggcttgcttggtgcggaaataactcgcgacaagagtggctttttccgtctggagaagatattccccggagcatcttggagcaaagaactgcgctctccgcttacggaaccgggtgttgatgtgaaagtgggagagtacatcgtagctattgacggtgtgccgactaatacggttaaagatatgtattctttactggtgggtaaagcagagatacctactgaaatttcgctgaatgccaaacctcagctttccggagcacgtaaggttgtgatcagtccgcttgccaatgaatatcctttgatacattacaattgggtacaggataatataaagaaggtggaccaggcttccaacggacgtatcggatatatttatattccggatatggggccggaaggcttgaacgagtttgcccgctatttttatccgcaacttgataaagaagggttgattatcgatgatcgtgccaatggtggaggtaatgtttcaccaatgattttggaacgtctttcccgtgaaccttatcgtctgactatgggtagaggtaccagccatgtgggaacagtgcctgatgctgtacaggtgggaccgaaggtttgtttgattaataaatactccgcttcagatggcgacctgttcccgtggggcttccgcgcacttggcttgggtaagttgataggaactcgtacctggggaggcattgtgggtatcagcggatcattgccatacatggatggtacggacatacgtgtgccattctttacgagctatgacccgaagaccgggaaatggattattgagaaccatggagtagatccggatattttgattgacaatgatccggtgaaggagtggaatggagaagaccagcaactgaacagagccatcgaagaggttatgaaacagcttaaagatcgtaaaccgttgcctccggtacctgctccgagagattttagtaaataa

SEQ ID NO: 690 - DNA, 1347 bp, B.fragilis
aaaccgacaataatggaatgtaggatgatttctcaatttctgatagcggctccttcttcgggcagtggaaagacaacggtcagtcgtggattgatggctctgttgattaagaagggactgaaggttcaacctttcaaatgcggtcccgactatatcgacaccaaatatcatacggcagtttgcagacgtccttccatcaatttggatacctttatggcttcggccggacatgtaaaggagctttatgcccgttatgccacaggggccgatgcctgcatcacggagggtatgatggggatgtatgacggttacgaccgtgaccggggttcctcggcagaagtggccggattactgaatttacctgtcatattggtggtcgatgccaaatcggccgcttattcggtggctcctttgctttcgggcttcattcactttcggcccgagatcaggatagcgggtgttatattcaatcgggtagggtctccgcgccattacgaaatgttgcaggaagtctgtaccgagttgggaattacctgtttggggtatttgcccaaacaggagagcttggtacaggaatcacgttatctggggctggatttcagccattcgaaaggaacggacgcactggaagagctgaccggattaatggaaaagtacatcgactataaccgtttgcttgaggaaacgaaacttcctgctccgatacctcctgtttcaaatatttctctacaggaagatttgaagatctccgtggcatgcaattcggaatctttctctttcatttatcaggaacacctggatgtgctttgccgcctgggaaccgttattctctttaatccggaggataatcgcccgttgcctgaaggtacggacttgctttatcttcccggaggctatccggaaaagcattatgagaaattgcgtcaggcttggcaaaggatgcagtctatacgtaactacgcggagtctggcggacgagtacttgccgaatgcggaggaatgatttatctctctaaaggcattctccttgaccggtcggagcactcggacagtgaggtcgggttgcaggcaggggtacttccgttctttatctcgaatcgtaaggctgacaggcgcttgactctggggtaccggcagttcgattataacggacaacatcttcgcggacacgagtttcactatacacaattcgagccgaaaccggaagagtcactggaatcagtcactcaggtatacaatgccaagagaatgcctgtcagtacacctgtgttccgatataaaaacgtgatagccagctatacgcatctatactggggggagatcgatttacttaaattgtttgaatga

SEQ ID NO: 691 - DNA, 2466 bp, B.fragilis
ctgtttcccttccaaaacaaagcaaacatgataattagtaaaaatcctttgggcgacatagccaaactaaacagaatttgtgcttcggcacagatcggatggtgggaagtgaacttcactacaggaaagtgttttatttcggaaaccctgcttaaatcattggaagtcagtagtgtatggttagacattgacgagttgatgtctaccgtacgacaggattatcgtaagcgcattacggatgagtttacctccatacctcggaagggggtgttcgaacagacctttcctgtgacttccggtcgcggtaatgtattctggatacattgtgcgttgagcatggaggaggagaatgaagaagggcaattgattgccaccggatatggccagcggatagagagtccggagacacaaggttatcaatgtgcatggaatcagcgcatcaacaatttgctctattgccagaactccattgccaactcgctcctgaaacttttgagtaatgataccggtgacgaattgtttgaagaaatgctggctgacattctgtacttctttaaaggtgcccgggtctacatcgtgcgctacaactggaaaaacggaaatcaaagctgcctttatgaagtggcggcctgtaacgtgatcaccctgaaagagaaactacagaatatctgttcggaagatgctccctggttctatcagcagatacatgctaatcgtcccgttattttgaactcacccgacgaactgcctccgcttgccgtgcgtgatcgcgaagtactggccgaaaacgggacaaactcgatgatgctggcacctctgatgcgtgaggaaggggtatggggatatatgggtatcgacatcgtagacggataccggaagtggaacagtgaagattatcaatggttctcttcgctggcaaatatcattagtatctgcatggagctgcgcatgatcaaagagcgggtgatgcacagtgagaaattgtttcacgatatattcaccaatattccggtgggtctcgaactatataataaggaaggtatgttgctggactgcaataaccggaacctcgagatattcggtgtcggcgataagaaccggatcatcggactgaacctgtttgaaagtcccaatatgacccgggatatacatgaaagccttcgggcaggccgtcccggtacatttcatctgaaatacgatttcgatgaagaacgcaggctttttcagtcggagcgaagaggagtgatggatctcgacatacggagcctgatgctttatgatgcggaagacaacctgtcaaactacctgttggtcaatatcgataatacggagcgcaacaatgcgctgagtaaggtgcacgactttgagaacttcttctctattatctctgattattccaaagtggggtatgccaaaatcaatctgctggatcacaccggattcgccgttcgccagtggtatcgtaatctgggagaaagccatgatacacctttggcggacattatcggtatcttttcacacatgcatcctgatgaccgtaagtcagtgctcgatttttatgaaaaggcgaaagcgggtacggaacgcttctttgacggtgatctgcgtattcgtccggcagatggtgcggatcggtggaactggatacacaagtcttctatggtgactgcctatcagtcacccaatccacggttggaactggtagaggtgaactatgatataacagtccagaaagagacggaagcggagcttcgggccgcacgggacaaggcggaagagtccaatcggctgaagtctgctttcctggcaaacatcagtcatgaaatacgtacgccgctgaatgccattgtaggcttctccgatcttctgatgacggttgacgatccggcagagcaggaagagttccgccggaccatacagaaaaacaatacattgcttctgcaattgttttcggatatcatcgatctttcaaagatcgatgcgggatcgtttgagtatatgccgaaacctgtctgcctttatcagttctgtgccatgatggtgcagaagatgaggaacaaggtgcccgaaggagtcgaactgcagattgacgaggactcaccgctcgatacctggttcagtgccgacagcggatatctgaatcaggtggttaccaactttatgagcaatgcgattaagtttacgcatcgaggcaccatcactgtcggctatcggatcgacgcccggcagcaacttgaaatgttcgtagaagatacaggtatcggtatttccattgaaaatcaggaagctgttttcgaccgctttatgaaagtggacagttttgtacaaggtaccgggttggggcttcccctgtgcaaaagcattatcgagaagatgggcggacacattggcgtaatctccgagttggggaagggttcacgcttctggttcacgcttccagctttttcttgtatacccacacgctga

SEQ ID NO: 692 - DNA, 870 bp, B.fragilis
cagacaatgattgaaggacacggagacgattcttataaataccgccacccgatacggagcaatttcagttccaacgtatataataaggtgaacctcgacggactgcgtgcacatttgtgcgggcgcatctctgccatatccgcttatcccgaaccggaaccttatacgctggaggcccgtctggcggaccgccacgctctgcctgccgcttcggtttgcgtgacgaatggtgctacggaagccatttatctgatagcgcagacctttcggggaacgaacacggccattctgatgcctacgtttagtgagtatgccgatgcctgccgcatgcatgggcacaaggtcacatcgctgtacacactcgatgcagtgccggaggacgtgcatatggtctggctttgcaatccgaacaacccgaccggagaggtgcgtgataagaagtatctgacggaactgattgcaaagcatccccgggtctgtttcgtgatcgatcagtcatacgagtatttcacgctgaaagagctttttacggcgcaggaagctgccggatttcccaatgtgatccttctacattcgatgaccaaacgctatgccattccgggacttcggttggggtatgtcactgcgcatcccggactgatagggcgtctgcgtacgaaccggatgccctggtcggtcaatcagcttgccatcgaagcaggactctacctgctttccgaaggcatcccggccggtctctccatgaaagattatctggcggaatgtgcccgcctgaaaagttcgcttgaggcgataggcgggttagaggtctggcctaccgatactcactttatgctggtgtgcctgcgtttcggaaaagctgcgctttaa

SEQ ID NO: 693 - DNA, 312 bp, B.fragilis
gcttctccgatgcgctttgaattacggatcacacgggaggtatgcacacctgctcccatcaaatgggccgaatatccggcaatgaacttggatatggaaatcaaagattcatttgtagtcataaaattgctcacttttttaaatcgggcgcaaaagtacaaaaaagaaaggaaagagaaagcacataagtcatttcatttcaccagactctccttgtcacattgcttatctttattattatttagaactcaacctaacgaaagaattaataattgtgccgtaagcacacgcaggaacatcgtcagcggatag

SEQ ID NO: 694 - DNA, 753 bp, B.fragilis
gatttgccgatgaatatattagcagcatttatcttttttacccgcctccccttctggcgtatccgcgaagttccagcagaatgttttaaacacgttgtgccttactggcctttgtccggatggctcacgggcggcatcatggcaggagtactttggttgagcgcacagatcctccccttctccgttgccgtattgttggcacttgccgcccggttattgatcaccggtgccctacacgaagacgggttggcagatttcttcgatggattcggaggaggtacgaaccgggagcggattctctccatcatgaaagattcgcatatcggcagctacggtgtcatcgggttgattttctacttccttcttctatggagtcttttgatgtcgctccccctctccttcgcatgtattacattgattgcaggcgacacgataagcaagctgacctcatcacaaatcatcaacttcctgccttacgcacgaaaagaagaagaaagcaaggccaaagtagtatataacagaatgtcaggcggagaatgtgctttcggtctgttatgcggtatacttccttcagcactcctgctaccgtaccgatactggatggctatcgtatttccgctgatcatgctgtatctgctttgcacactgatgaaacggaagttgcaaggttataccggcgactgttgcggagcactgtttcttctaagcgaactgtctttctacctgggaatagttatactaatgtttatatag

SEQ ID NO: 695 - DNA, 201 bp, B.fragilis
tattttatatttccattcccggatgcaaaatattgtgccattgctatgggtatttcggaaacaatatttatctttgcatggctttacaaaataaaagcaacacatgcggtagtagctcagttggcagagcggcggcttcccaagccgcaggtcacgagttcgaccctcgcctaccgctcaaaagtttatctcctcaactaa

SEQ ID NO: 696 - DNA, 531 bp, B.fragilis
cttaagagttcaaccaacagattttcctatataatcatcttctcaataggcaacaccaaaataccttccgctcccagcgctttcagcttacctatgatctcccaaaaccgtttctcatcgagcactgtatgtacagagcaccaaccatcttgtgccaacggcatcacagtaggactcttcatacccggtagcacagcaataatatcttccagtttatctttaggagcattcatcagtacgtactttttatcttcagcagttttcacagcatccatgcggaaaagcaattcgtccaatatctcttttttctccttactcatattcttgttgcctatcagcaaagcttctgatctcattacgacctccacttctttcaggcgattgctgactagagtagaaccggaactgacaatatcgaaaatagcatccgccaatccgatgccgggagcaacttctacagaaccggtaatgacatgcacttcagccttcaccccgttacttttcataaaagcatctaaaattccgggatag

SEQ ID NO: 697 - DNA, 312 bp, B.fragilis
ctgagttctccgattatattggtaatggtgaatgtaatcaggagaatgaaggcaaatacaagtattattgagaaagaaagtatccggtttttaataaatttaagccagctctttttagggacggcttttattccccaaattgaatttaatgaactttgtatttctgcaaaaatagtggtggcaccaaaaatagagatacctaagctgacaaaggcggccgacctggaggagtctgtattttctgcattttctataatagaacgaagggcctcggtaacttcggggcccacaatcggttgtagttggacataa

SEQ ID NO: 698 - DNA, 195 bp, B.fragilis
ttgaggctgttgtcgatcaggttcagcagcgctgacacgtgccttgttgctttgttatcggcagcatatgtagtgacagagtataaggttactgctattactataagcgctatattgaaagaccttcccacagtaaatgttgttttcccgatgtttgttttatgcttgtttatgatgcatgtagtgcaaagctaa

SEQ ID NO: 699 - DNA, 1305 bp, B.fragilis
actcttaagttaaaaattatgaaactgattaaatatccggaccggtcgcaatggaatgagatcttgaagcgtcctgtgcttgagacagaaaatcttttcgatactgtacgcaatattattaaccgtgtgagagccggaggggactgggtggtcatggaatatgaggctgtgtttgataaagctgaactcacctcattggctgttacttctgcggaaatagaagaagcagaaaaggaggtacccatcgaactgaaggcagctatttatctggctaaacgtaatattgagacatttcattctgcacagcgttttgaggggaaaaaggtggacacgatggaaggtgttacttgctggcaaaaagctgttgctattgaaaaggtcggattgtatatccccggagggacagcccctctattctccactgtgcttatgttggctatacctgctaagattgccggatgtaaagagattgtactttgtacaccgcctgataagaatggaaaggtacatcctgctatcctgtttgccgctcgtctggctggagtcagcaaaatctttaaggttggtggagtacaggccattgccgctatggcttacgggacagagagtattcctaaagtttataagatctttggtcccggcaatcagtatgtcaccgctgccaagcaacttgtcagcctgcgggatgtcgccattgatatgcctgcggggccgtcggaggtagaggttctggctgacgaatctgccaacccggtgtttgtggctgccgatcttctttctcaggcggaacatggagtggatagccaggcgatgctggttacgacttctgagaagctacaaacggaagtcgtttacgaggtcgaacgccaattaggctatctaacccgtcgcgatattgccgaaaaatctttggccaacagtaagttgatattggtgaaggatatggaggaagctttggaacttaccaatgcttacgctcctgagcacctgattattgagacgaaggactatatggaagtagccggacagatagtcaatgccggttcggtatttttgggtgccttctctcccgaaagcgcaggtgattatgcttcgggaactaaccatactttacctaccaacggctatgccaaagcctatagtggagtgagcttggacagtttcatccgtaagatcacttttcaagagatacttcccagtggaatgtcggctattggcccggctatcgaggtgatggctgccaatgaacacctggatgcacataaaaatgcggtaactgttagattggaggagataagaaaatga

SEQ ID NO: 700 - DNA, 360 bp, B.fragilis
aaaaggaagtttaacaggtacatcttccgagaaaggagacatagacaaaattattattaccaatataaaataaaaagaatgaaaaagaaatattatgcagcgttattagctgtagttgttattgcatttacgggatataatgtttatcagagtcaaaaggcggatgcctctttatctgatttggcaatggctaacgtagaagcattggcaaatggagaactttcgaatggaaattgtgaaggttcttggtcacaagaatgttgtaagtgtgattatattcattatacttatgcttgtgcaatagaagtgactggtaatagctgctatacagtaagtggatgtagccattatacaaattaa

SEQ ID NO: 701 - DNA, 207 bp, B.fragilis
tgtatatctacctcattcaaattcataaccgatcaatttttctcagaagaaacaaagaatcagagtaatagttcaacaaaacaaagattatctaaaatgtcatctccacattacaatctaacaaaaccacaaattctatttttctcttttcataaaaaagtaataaaacccgatttgcaaaaacaaataaaacgactacctttgtga

SEQ ID NO: 702 - DNA, 1911 bp, B.fragilis
ctttgcactacatgcatcataaacaagcataaaacaaacatcgggaaaacaacatttactgtgggaaggtctttcaatatagcgcttatagtaatagcagtaaccttatactctgtcactacatatgctgccgataacaaagcaacaaggcacgtgtcagcgctgctgaacctgatcgacaacagcctcaactatagcaaagaagctcccaacgacagtattatccaatggggcaacgaattggctcctctcctgaaaaagcagaaagaatataaaactctatttcagttgaaacaactgattgtgacagcttatgcctcacgaggagacatgaacatggccatcgaccatgcccgccggatgtataaggaagccaaagaattgaactcccccatcggtatagctctttccagccgtgccattggggatgcctacttgaatgccaacatgcagcaacccgccatcgaatcttataaagaagctctggaattgcttgacaaaataccgggtagcgaaatcctcgaacaagagattcttccgaaattcatcctgaccctgattcaggcctcccacatggacgaggtacgcatctatctgcaaaagtttgaaaacctgtatgccgataaccctaatcctacattccactttttcatatgtgcgtgcaatgcctactataacatcgagtccggtgatcccgaaaagggaaaagccgaactggacaaagccaggaaaatccacgaacaactgaattatctctacctgcgtagtatctacaactatatattggcccagtactatcaagctgtcgggaagtatgaactggccctgcaacaatacgaatgcctgacaaaggtccctaaagcacctgcccccaacaaacacatcggtttgcagcttgagtgtgcccaactgctgactcaaatgggacgaacggaagaagcctatcgtatctatcaaaaggctaaccggcaaaaagactctttgaacgctctgagctatgcccggcaaatcaatgacctacggggaatgtaccagatagaccgaatggaaatccggaaccaaattcaacgaaaccaaatcatcttgtggatcatcatagtttccatctttatattgatgcttgttttgctgttgattgtccgcatccggcaggagtccaaccgacttctccgctccaaagaagaattggaaatagcccgtaagtatgccgagaactcgatacgtaccaaaagtctgttcctgtcgaacatgagtcacgaaatacggacaccactgaatgcactttccggattctcatccatcctgaccgacgaatccatcgacaatgacacacggtatcaatgcaatgacatcatccagcaaaactccgaactgctgctaaagctgatcaatgatgtaatagacctgtcaaatctcgatcccggcaagctgactttcaattttaaagaatgtgacgccgtcaatatatgccgtaacgtaatcaacaccgtacagaaagtgaagcagacacaagccggagtcagttttgtcacttcactggatagactgactttgcgtacagacgaggcacgcctgcaacaggtattgatcaacctgctgatcaatgccaccaagttcactactgaaggaagcatcaccctgacattagaaaaagaatcagaaaccatagctctgttcactgtgacagataccggatgtggtatcctccgtgaaaaacaggaccagatattcaatcgttttgagaaactgaacgaaggtgcacagggaacaggtctgggactctcgatttgtcgacttatcatcgaacaaatcggagggagaatatggattgacccggactacaccgaaggtgcgcgattccggtttacacaccccgtccggcccgcaaagggaaaggaggcagaaagatga

SEQ ID NO: 703 - DNA, 1170 bp, B.fragilis
gaatgccaaactgattggagcactgaaaaaatatcaataggaaaaatgaaaaagaaagtactttttattgaccgtgatggcacgcttgtcattgagccgcctgtcgactatcagctcgattcactggagaagcttgaattctatcctaaagttttccgcaatttgggctttattcgcagtaaacttgattttgagtttgtcatggtgaccaatcaggatggtttgggcacctcttctttcccggaagaaactttttggccggcgcacaatctgatgttgaaaactctggccggagaaggtattacgttcgatgatatcctgatagatcgtagtatgcccgaagattgtgcttctacgaggaagccgcgtacaggaatgttgactaagtatatttccaatccggaatatgatctggagggcagctttgtcattggagatcgtccgacagatgtagaattggccaaaaatataggttgccgtgccatttaccttcaggaatccattgatttgctgaaagaaaagggactggaaacttattgtgctcttgccactactgattgggatcgggtggctgagttcctttttgcaggagaacggaaagcagaaatacgcaggacaacgaaagaaaccgatatcctagtagctctcaatctggatggtaagggtacttgtgacatttctaccgggttaggtttctttgaccatatgcttgagcagattggtaaacattccggtatggatttaacgatccgggtgaagggggacctcgaggtagacgaacatcataccatcgaagatacggctatcgcattgggtgagtgtatctatcaggcgctgggtagtaaaagaggaattgaacgttacggttatgctttgcccatggatgattgcctttgcagggtatgcctggatttcggaggacgtccgtggttggtatgggatgccgagtttaagcgtgaaaagataggagaaatgcctaccgagatgtttttacacttttttaagtctctgagtgatgcagccaagatgaatctcaatattaaggctgaggggcagaatgagcatcacaagatagagggaatattcaaagcgctggcccgtgcgttgaagatggcgttgaaaaaggatatctatcatttcgaaatgccgtccagtaaaggagttttgtaa

SEQ ID NO: 704 - DNA, 2817 bp, B.fragilis
aagaaaaagacgaccgtcgtgatatggacaggatgtttaaacgatgataggtttgtacctttagcaatgaaaaaaactattcaacagctggtactcgaacgtatccttatattggatggcgctatgggtacaatgattcagcaatataatcttagagaagaagattttcgtaatgagcgctttgcgcatattcccggtcaactgaaggggaataatgatttactttgtctcacacgccctgatgtgattcgggatatacaccgtaagtatctagaagccggtgcagatatcattgagacgaatacttttagttctactactatttctatggccgattatcatgtacaagagtatgtgcgtgaaatgaatcaagcggctgtaaagctggcacgtgaagtggccgatgaatatacggcactaaatcccgataaaccccgtttcgtagccggttcggtaggtcctaccaataaaacatgttctatgtcgccggatgtgaataatccggcttatcgtgctgtgacttatgatgaaatggctgatgcttatcagcaacagatggaagctatgcttgaaagtggggtagatgctttattgatagaaactatctttgatacgctgaatgccaaagctgctattttggcggcagaacgtgcaatgaaggctacaggagtaaaagtgcctgttatgttatctgtgacggtttccgacaccggaggacgtactctttccggacagacgttggaagctttcctggcttcagtgcaacacgctgatatcttctcagtcgggttaaactgttcgtttggtgccaggcaactgaaacctttcttagagcaattggccgctcgggctccttattatattagtgcttatccgaatgctggtctacctaatagtttaggaaaatatgaccagactccggcagatatggcccatgaagtaaaagagtatgttcatgaaggattgatcaatatcataggcgggtgctgtggtactaccgatgcctatattgcagaatatcctgcattgattgccggagcaaaaccgcatattccggtttgtaaaccggattgtatgtggctttcgggattagaactgttggaagtgaaacctgaaataaatttcgttaacgtgggggaacgttgcaatgtagccggttcgcgcaaatttcttcgtttgattaatgaaaagaaatatgacgaggcattatccattgcccgtaaacaggtagaagacggagcactgattatcgatgtaaatatggacgacggccttctggatgcaaaggaggagatgacaactttccttaatctggtggcttcggaaccggaaattgctcgtgttcctgtaatgattgattcttcgaaatgggaagttatcgaggccggattgaaatgtcttcaaggaaaatcaattgtgaattccatctcgttgaaagagggagaggagaaattccttgaacatgctcgtacggttcgccaatatggtgcggctgtggtagtgatggcttttgatgagaaagggcaagctgatacagccacccgtaaaatagaagtttgcgaacgggcctatcatttgcttgtagataagataggattcaatccgcatgatatcattttcgacccgaatgtattggctgtggcaacagggatcgaggaacataataactatgcggtagattttatagaggcgacggcttggattaaaaagaatcttccgggcgcccatatcagtgggggagtaagtaatctttcgttctcattccgtggaaacaactatattcgtgaagcgatgcatgccgtatttctttaccatgccattcagaaagggatggatatggggattgtgaatccgggtacttctgtattgtatacagatattccggcggatgtactcgagaggattgaagatgtagtattaaaccggagaagtgatgccgcagaacgattgatagaattggctgaccggttaaaggaggcttctgcgggtaatacttcggccgggcaaccggtaaaacatgatgcctggagggacggtacggtagaagaacgcttgcaatatgctttggtaaaaggaatcggggattttctggaagaagatcttgctgaggctttgcctaaatatgataaagcggtggatgtgattgaaggaccattgatgaatggaatgaatcatgtgggcgaattgtttggcgcaggtaagatgtttcttccacaagtggtgaaaacagcccgtacgatgaagaaagccgttgcaatcttacaacctattatagaatcggaaaaggtggaaggtactgcttcggcaggaaaagttttgctggccactgtgaaaggggatgtgcatgacattggcaaaaatatagtctcggttgtgatggcatgtaatggttacgatattattgatttgggagtgatggtaccggctgaatcgattgtccaaaaagccattgaggagaaagtggatatgatcggacttagtgggttgattactccttcactggaagagatggtacatgtggctatggaattagaaaaagccggattggatattccattgttgataggaggagcgactacctctaaactacatacagcattgaagattgctccggtttatcacgctccggttgttcacttgaaggatgcttcgcagaatgcgggtgttgctgctcggctgatgagtccgaaatcgaaagaagagttggcaaaagaattatccggtgaatatgaagcccttcgtgataagagcggcatgatgaagcgtgaaaccgtttcattgaaagaagctcaggaaaacagattgaaacttttttga

SEQ ID NO: 705 - DNA, 2367 bp, B.fragilis
atcaaatggacttcgtttgctgtcataatagttactttttatgcaacaaaggtacacttttatgaagaaaaaaagagtaaacgaagacaaaaaccaaaattatttattatctttgcggcgttgaaacattccgaacccctccaacgggagacaaattcggatttccgattcagccaaacatccctaattcatcatttaaagattattgcgtttgttaagtttccgacctctgcgtcgcagcttcagccgtacgtatttcaacgaataaaattaaaatatttaaataactcactatactgtatgtataacatcattcaattgaacgacaagaatttgtcggaactacaagctattgcccaggaattgggtatcaaaaaaacagactcacttaagaaagaagaacttgtctacaaaatcctcgacgaacaagccatagccggagctactaaaaaggtagctgccgacaaactgaaagaggaacgcaaagaagataagaaaaaacgctctcgggtgacagtaaagaaggaaaacgccgacaaggttttctcttctaccaagaatggagaactaaccaaaacagatgccaaaacacctgcagccaaaacacagccacaacctaaaacaacagaaccgaccccagaaacagctaaagaggcaaatgccgaaacaaacgccactccggccgaatctgtcaaagtgacaccttatgccactccgaaaaagaaaccgggacgtccccgtaaaaatcaggtagaaacagaagctaaacccgcagaagaaactaccgaaaaaccggaaacagtaccatcggcacaagaagaaaagcccgctgcccaaccggaaacagaaaaacgtcccatcagcaaaccgattctcaaacccaaaccggccgttgtagacgaagaaagctcgatcctctcggatatagatgcagacgatgattttatccccatcgaagacctgccttcggaaaaagtagaattgccaaccgaactgttcggcaaatttgaatcgaccaaagccgaagcagcaacagcccccgaacctgtggcacaaccccaacgcccgcgtgtgattcgcccacgagacaacaataacaacaacaattacaacaacaataataataaccaacgcaacaataaccagcgtcagcctgtacaacagcgtcccatgccgcaacaaaatgccgccgaagccgcacccgttcaggaacgccgcgtgattgaacgtgagaaaccttatgaatttgatgatatcctcaccggaaccggtgtattggaaatcatgcaggatggttacggattcctccgttcgtcagattataactacctctcttcaccggacgatatctacgtttcgcaatcccagatcaaactattcggtctgaagaccggtgacgtagtagaaggtgtaatccgtccgcccaaagaaggcgaaaaatacttcccgctggtaaaggtttctaaaatcaacggacgtgatgccgctttcgtacgtgaccgtgtaccgttcgaccatctcactccgctgttcccggacgaaaagttcaagctttgcaagggaggctactccgactcgatgtcggcacgtgtagtcgacctcttttcaccaatcggtaaaggacagcgtgccttgatcgtggctcagcccaagaccggtaaaaccatcctgatgaaagaaatcgccaatgccatcgctgccaaccatccggaagtatatatgatcatgttgttgattgacgaacgtccggaagaagtaaccgacatggcccgcagtgtcaatgcggaagtgattgcttctacattcgacgaacctgccgaacgccatgtgaaaattgccggcatcgtactcgaaaaagctaaaagattggtagagtgcggacacgatgtagtgatcttcctcgactctatcacccgtctggcgcgcgcatacaatactgtatctccggcatcaggaaaggtactctcgggtggtgtggatgccaatgcactacacaaaccgaaacgtttcttcggagcagcccgtaacatagagaacggaggttcgctcaccattatcgctactgccctgatcgacaccggttcgaagatggacgaagtaatctttgaagagttcaagggtacaggtaacatggagttgcagctcgaccgcaacctaagtaacaaacgtatcttccctgctgtcaacattgtggcatcgagcacccgccgcgacgacttgctgctcgacaaacagacactggaccgcatgtggattctacgcaagtatctgtcggatatgaatcctatcgaagcaatggatttcgtaaaagacagattggaaaaaaccaaagacaacgacgagttcctgatgagcatgaacagctaa

SEQ ID NO: 706 - DNA, 1143 bp, B.fragilis
agtaactttgcaacaccaacacaagatctggcaaatatgaataaaagaatatttttagtaattggagtcattatactttttattatgattgccataggtgcctcaacctatacaatcattcactctcttattcaaaaagaaaaagaagcattcaagccacaagttgaaaatatcttgaaggaggcagttgccaacaatacaatccaaaaatgtaaagatatacccttaaatggttttaataactcacctaacaaaataggtacgtatgagactcggaccttctgttcaagagataccttgtttacctatcagcacaaaattcaagacgtggatagtgaaatattattcgctcgccaattggggttacttatgatggatagtttacaaagtagtgatatacaagccctaataattaaagacttaaataaaaatgatataaaaggatatatcaatactggaataattgtctccaaacatctacaaagagaaatatggagtcaaccatcaaatagcatccctcgcaatgcagaaatgattacctatcgtctagaaaatgaaattgttagtgtagattacataatgtatatcgactatagtttctcaactttgtggaagcgaatgcctaaaaccaatatctacatcaatttagtagtcgaagtgattctcatctacaccattactctatttgtactatactataggaaacagcaaaagaacagatctgtatctacagttgatataacatcagatcccaatattatcacggaccccatatcagttgacaatactgtagaaacagaaaagcggactaattctaccataaaagaggagttatcattcaaggatcaatttgtctttgagaaagactttgtcctattcaatgaccgtccgatcaaaatgcctaatcaacaacaaaagatattattatttttcttaaataggcctaattacagagtgaacaaacacgaattgaaggaagaattttggcctaaaaacagtgatccaaccaataatatgacaagcgcaatcaataaattaaagaaaattttagaggaaatcaacagtaagtatacaattatcaccgacaagactaatgaggaatactatgtactaatcagggataaatcagcagaaaaaatatag

SEQ ID NO: 707 - DNA, 402 bp, B.fragilis
atggagattctgtttcctgaactattgtactcaattattgttttaaataaacgtttaagatacagttaccttaatataattatgctgacatttaccgataactttgagaatgataaagagttgatacttcgtgatcatctggcacttgaaagaaccaagctggctaatgaaagaactttgtttgcatatatccgtatggcactttaccttttgactgtggggatagggatatttcaaattgaaagcatttcacgtttggatgggctggcgtggggatgtattatagccggaatctttttgtttttcttgggctttgtccgtttcgaacaaatgagaaagcatttgaaacagtatacgaaaacatgtcgtgatactgagaatgaatcgtcacggaagaagtga

SEQ ID NO: 708 - DNA, 1929 bp, B.fragilis
aaaatgaactacggattcgtaaaagttgcggcggccgttccccgcgtaaaagtagcagattgcaaatttaattctgaaagattggagggtcttattaccatagccgaaggtaaaggagtacagattctcacttttcccgaaatgtgcattaccggatatacttgtggagacttgttcgcccagcaacttttgcttgaacaggcagaaatggctttgatacagattctaaacagtacccgccaactggacatcatttccatactgggcatgccggtagtagtcaactccacagtaattaatgctgcagtagttatccagaaaggcaaaatactgggagtagtgcccaaaacttacctgcctaattataaagagttctacgagcaacgttggtttacatccgccctacaagtctcggaaaacagtgtgcggctttgcggacagattgtcccgatgggcaacaatctgttgttcgaaactgcggaaacaactttcggcatagaaatctgtgaggacctttgggctaccgttccgcccagttcctcactcgcactgcaaggggctgaaatcatctttaacctttccgccgatgacgaaggtattggtaaacacaattatctttgctctctgatcagccagcaatctgcacgctgcatctccggttatgttttttcgtcgagtggcttcggtgaatcgacaacagatgttgtttttgccggaaacggacttatttacgaaaacggatatctactggcacgaagtgaacgtttctgcatggaggaacagttgattatcaatgaaattgatgtggaatgtatccgtgcagagcgtcgggtcaacacaacttttgctgccaacaaggctaattgtccgggcaaagaggctgtcagaatttctacagagtttgtcaacagtaaagatctgaacctgacccgtacattcaatccacatccttttgttccgcaaggaaacgaactcaacagtcgctgtgaagagatcttctcgattcaaatagccggactggcacaacgtctgctacataccggagcaaaaacagccgtaataggtatttccggaggacttgactcaacactcgccttattggtgtgcgtcaagacattcgataaattgggattatcccgcaaagatattctgggtataacaatgccgggattcggaacaaccgaccgcacttatcacaatgccatcgacctgatgaattccttgggagtttcaatacgggaaatcagtatcagggaagcatgtatccaacactttaaagatatcggacacgatctcaatatacacgatgtaacgtacgagaattcacaggcacgcgaacgtacccaaatcttaatggatatagccaaccaaacatggggtatggtgatcggaaccggagacctgtcagaactcgcattgggatgggcaacgtacaacggagatcatatgtcgatgtatggtgtcaacgcaggtattcccaagacactggtgaaacacttagtacagtgggtagccgaaaacggtatggatgaaacatccaaagcaactctgctggatattgtggacactcctatcagtccggaactgataccggcagatgaaaacggagaaatcaaacaaaaaacggaagacctcgtcggtccttacgaactacacgacttcttcctgtattatttcttacggttcggcttccgcccgtcaaaaatctacttcctggcacaaactgcattcagtggagtttatgatgatgaaacaatcaaaaaatggctgcaaactttcttccgccgcttctttaaccagcagtttaaacgctcttgcctgccggacggaccgaaagtaggaagtatatccatcagccccagaggagactggcgcatgccaagtgatgccagttcggctgcatggctgaaagaaatagccgaattgtaa

SEQ ID NO: 709 - DNA, 870 bp, B.fragilis
ccttacattcatcctcctgtaatccggaaacgggatctttgcgtaacgaaaaaaacaaaagttatgcatttacggacgtattatcccacagtagttctctcggatattcatctgggaactcaacactccaagacagaggaagtcactcacttcctgaaatcaataaattgtgatcgcttaattctgaatggtgatatcattgacggatggcatttgcagaaaagcggtttgggtaaatggaaagctaaacatacggatttcttcaaagtaataatgaagatgatggagaatttcgggacacaagtgatttatgttcgtggtaatcatgatgattttctagataatctggcacctctgaatttttataatatccggattgtgaaagactgtatctacgaaagccacggcagacgttattatgtgacacatggagatatttttgatacggtgactactcaaatgaaatggctggctaagttgggcgacacaggatatacttttctgttatggttgaataaggtatacaatctccgcagaatgaagcagggaaaaccttattattccctttcccagtctattaagaatagggtaaagactgccgtttcttatatttctgattttgaaaaagagcttgttggcctggcaagggctaaaaagtgtgatggcgtgatatgcggtcatattcaccatcctgccaatactttttatgaagatatccattatctgaattcaggcgactgggtagaaacactttcggctcttactgaagatgaagatggtaactggactatccgctattttgatagtggattactaaaggaagataatcataaggaaaaacaaactatatccataacaatagcatcatga

SEQ ID NO: 710 - DNA, 579 bp, B.fragilis
cactgcgatctttgcagcaccatattaaaaagaggtaaagttatgaaaagacatcttattttagtatttgctttattggcatccagtgttgccttaaatgcagtcaattcattgccggacgatgataaatccgacaataagaacaaaacagaactcaattctgtcgtcaaaaagacatgggagttctactccaccatcaaacaaccttctgccgatgcactggctaatgcgggtaactacaaattcgggcaagaagccggttatctctataaccaattcatgaagatctatgtagtcagggaagaagtggttcccggagaccctacccgccgtaccgtaattcgcaaacccactatctacaacgcagtacgctccatcgagaaacagctgaacaaagagctcaaaagcaaccaaatgaccagagagcaagtagctgcagagttcacaaatgtactgaaagtagcgatttctgcctatgattccgaaagcgaatcatttgaagacgctttacagataaatcgcaaaaatgcaaccgaccttctctccgtatttcaaaatgtaaaactgacagaaatctaa

SEQ ID NO: 711 - DNA, 597 bp, B.fragilis
aaaacttatcaaaaagcctttctgaaccatatatttccgtatttttgtttcctgatatttataaatatagaattcaccttattatatatagtggaaatgatagaagttacggatgcctctttgcaaaaagctgcgggtgagggaatggatgaatttatccaggtgtttacagacaagtataaagaagtgattggcggggaacttactgccgaaacaatgccactgttgacaggggagcagcactctttgctggcctatcagatttttcgggatgaagtcatgttcggtggcttttgtcaattgattcagaatgggtatggaggttatatctttgataatccttttgcaaaggtaatgcgcctgtggggagccgaggatttctcgaagttggtttataaagctaagaagatatacgatgctcatcgccacgatctggagaaagagcgtacagaggatgaatttatggctatgtacgagcaatacgaggcctttgatgatcttgaagaagaatatctggatattgaggaggaggttacagcactggtagcaagctatgtagacgatcatttagagttgtttgcaaaaatagttaagtaa

SEQ ID NO: 712 - DNA, 2031 bp, B.fragilis
cccggactacaccgaaggtgcgcgattccggtttacacaccccgtccggcccgcaaagggaaaggaggcagaaagatgaagcgactgatacttatcatcatagtatgttgccgggccttaggatggtgtcatgcaaatacacaaacggaaacggacagcctgtatcgggtgacacagtcacttccgcatgactcgactcgtctggaaatgttcaagagactggcacaaatagagcagctgactcccaagtgtatcaccttctcgggtctgttgcgcgaggaagccaccttgcagaagaatgacagatacaacgccatagccgcctatctgcacacagtgtactactataaccaaaacaaccgggacagcgtaaaaaaatggcttgacacaatggagccttatgcccgcaaatcgcaaacctgggatctctattttgatgcgctccgctttcagatagacctctgcacctacgaagagcagtatgaacttgccatcaacgaagcgaaccagatgtacgaaagagcccaaaaagtgaactgtgcccgcggactgatcggagcaaaacaatgcctgggcaacgcctatatcagtacagagcgatgggacgaaggaatgaaagcattggaagctgcctatcagctctcttcacaaacagataatgcggtagtacgaatctcgattctctgtcaactgatttccataaccaaggatcagaaaaacaaccaattactctccgaataccttgcgaagctaaaagaaacactgcatcaccatacctccacgaacccgatgctcaaaaaggcattttatgatgtttacctgttctgcgaagtatattacacctattattatctatatgcaggccagccggaacaagcacataaaaatctggttaacgcaggcaaatttctcaatggcaacaccttctttctctacagggtgctctattacgatgcctatgcagcatacttccgggcttgcaaagcgtatgaccgggcacttgccaagatagactccaccatcatgctgctgcaagaggacttcaacagcaattacatccaccaaaaattgacaaaagccgacatcctggcagaagccggacgaagtgcggaagccattcccctgtacatcgaaacgctccatcttaaagactctatcgaaacgaccgttctcgacaaacagatgcaacagataaaagctaaatacaacatcgacaaagtggcattggaagaggaacagctgaaaagctacatccaactcggcaccttaatagtggtggtcattatcctgataattctggttgctttcatgctccgcatttcacacgtacgcaaggctttggaacgatcggaaaaagaaacacgggaaacaacccgtatggcggaagaagccaacgaaatgaaaaatcgctttttgtcgaacataagctatcacatccgcatcccgctgaacggtgtagtgggtttctcgcaattgatagcctccgaacccaacatgcccgatgagctccgtaaagaatactcttccatcattcagaagaactccgaagaattgatgcgcctggttaatgatgtactcgatttatcacggctcgaagccggtatgatgaagttcaacattcaggagtacggactggcggaactctgcaatgaagctacctatatggcacgcatgcatagtgaagggtgtaccgtcatccggttggaaaacgaaattgaaacagacctgaacatccgggtagacaccgtccgtttcacacaggcgttgctaagtgcactgacgtatccgcagaagtacaaagaaaaacgggaaatcgactttaaggtgacactcgacacggagaagcacttcatcaacttccgcatcaccaactctccgctggctgacgaaagatttacttcgcaagaggtatgcatccgtcacgaaatcaaccgcctgctatttgagtatttcggaggaagctacaaagtacagacaaatccggacggaaagccggccatcctcttcacgtttccctcaggaagaaattga

SEQ ID NO: 713 - DNA, 759 bp, B.fragilis
agtgggtggcagccggataccctttccagtgtagacgaaaagggagaggtgaagtatcataaacccgattgcgctgtgaaaggaagtatggatttgaaccgtaaattcttattgcgacaatatctgaaagattatctcagcgctgtagtgggggataagatagagggagccaatcattcggatttttcggatgcctgtctgttgcatcagatagtggatacacctaaggtaagctatcaggtagcctatccacaatcccggaagagataccggtatatacgttatacttcgacccccgaaaaaacacttcaactggcggaattacagcttttccgaaaagtggatgatcaagagaaaataacggctaaggtcatcgatggcagtaatgcttttattgcagatgaccggtttgatcgttttaaagtgaatgacggtgatggattaaccttttttcttacgaaagagaagggagcattcgttacacttgatttaggtaagccggaaaagattgaaaaaatagtctatatgcctcgtaacgatgataacttcattcggttaggggatcagtatgaactgttttatcaggatggatttcgtggttggatttctttaggcaggcaagtagcctcagaattaacattgcactatgacaatataccccaaaattcagtactttggcttcggaatttatcaagagggagagaagaaaccgtatttcgaaacgaggacggtcggcaggttttctttgtaaagtggtaa

SEQ ID NO: 714 - DNA, 948 bp, B.fragilis
aaaagaattaaaatggaaatccattccgaaagaaagaaaagacttagtttatccctgctcttcaaaataataaaagatacagtttggggattcatagatgacagcgttatgaggttgagcgcttcattagcctatgcgactttgttttcaattattccttttctttcccttctagtcactgtcggtgtctttttccatatggatttggccaatcaactttatgtccaactacaaccgattgtgggccccgaagttaccgaggcccttcgttctattatagaaaatgcagaaaatacagactcctccaggtcggccgcctttgtcagcttaggtatctctatttttggtgccaccactatttttgcagaaatacaaagttcattaaattcaatttggggaataaaagccgtccctaaaaagagctggcttaaatttattaaaaaccggatactttctttctcaataatacttgtatttgccttcattctcctgattacattcaccattaccaatataatcggagaactcagtcaaaaattcatctttaagtatccggaagcagccgattcgttggtaaaagtggtaggaatcatcataaacatgagtgtcactaccatcatctttacactcatatttaaaatattacccgatgccaaaatcaagagcaaagacgtttgcatcggagctgttgtaaccaccatactgctactgataggtcaatggggaatttccttttatataggaatagccaatgtggggaccgtctatggggctgctgcgttcatggtggttttcgtcacctggatttattattcttccatcatcatatataccggtgcagaatttaccaaagcatgggcaaacgaaatgggaagtaaaattttccccgacgaatatgcagtagccaccaaaaccattgaaatacacgaagacaagcctatcgaataa

SEQ ID NO: 715 - DNA, 192 bp, B.fragilis
aaaacatctaacattcattatttatctcttttaaaatatctggctctcgattataaaccgagacagagtccggcagatattcttgctttagtaatgacgacataccatcctcattctcttctaccaaaactgttgtctcccatcggtcttcttaaagatccgttcgtcctttccctccgtatgattctttaa

SEQ ID NO: 716 - DNA, 2181 bp, B.fragilis
tttttttataaactaatgaacagactcaaactttacttactggcgctgactgcgctggccgtttgttccgcaaaggcggacgagggtatgtggttactgcaattaatgcagcagcaacactctatcgatatgatgaaaaaacagggactgaaactcgaggcacaggatttgtataatcctaacggagtctcactgaaagatgccgtaggtatcttcgggggaggatgtaccggcgagattatttcaccggaaggattgatattaaccaaccaccactgcggatacgcttccatccaacaacatagctctgtagagcatgattatctgacagatggattttgggcaacttcaagagacaaagaattgccgactccaggactgaaatttacatttatcgaacgcatagaagacattacggatattgtaaatttaagaattgccgctaaagaaatcactgaatcagaatcattcagcagtacatttcttaataaactggctaaggagttgtttgaaaagagcgacttgaaaggaaaaaaaggaatcgttcctcaagctttgcctttttacgccggaaataaattctatatgttttataagaaggtatatccggacgtacgtatggttgccgctcctccttcatcaatcggtaagttcggtggtgaaacagacaactggatgtggccacgccataccggtgacttttcaatgttccgtatctatgctgacgcgaatggcgaaccggcagaatacagtgcttccaatgtccccctgaaaaccaagaaacacctgaatatctctatcaaagggctgaaagagggagattatgccatgattatgggattcccgggaagcaccagccgttatctcaccgtctcggaagtgaaagaacgcatggaggcaagcaatgccccccgtatccgtatccgcggaacccgtcaggacgtgttgaaagaagcgatgaatgccagcgataaagtacgtattcaatatgccaataaatatgcaggttcaagcaactattggaagaactccatcggcatgaacaaagctatcatcgataacaatgttttgggaacaaaagcagaacaggaagctaaattcgctaagtttgccaaagaaaaaaataataccgactacatgaatgtagtggcaaagatcgacgaggctgtagctaaaacttctccaatcaaatatcaacagacctgtctgacggaaacattcttcggcggtattgaattcggtagcccatttatggtaatggacaaactgaaagaagcattggaacagaaaaacgattcaagtattgaagctaacatcaaagtgctgaaagaggtattcaacgacatccataataaagactatgatcacgaagtagaccgtaaagtggccaaagccctgttgccactatatgcagaaatgattcctgccggacagcgtcctgccatctacgatgtgattgagaaagagtacaaaggcgactacaatgcctacgtagatgcaatgtacgatacttcaattttggccaatcaggcaaactttgataaattcatcaaaaaaccgactgtaaaagcaatcgaaaaagatatagccactcaatattcacgtgccaagtttgacaaatacaccaatctggccgaacaaatgggaaaattgccggaagactggcttttattacacaaaacatatatccgcggactaggtgaaatgaaattgcctgtaccatcttatccggatgccaatttcactatccgcctgacctatggcaatgtgaaaccatacagcccgaaagatggtgtatattacaaatactacacaacaaccgacggaatccttgaaaaagaaaatccggaagaccgtgaattcgtagtacctgccaaactgaaagagttgatcgagaaaaaagatttcggacgctatgcattgcccaatggtgaaatgccggtttgtttcctgtctaccaatgacatcacaggcggtaactccggaagtccggtactgaacgaaaacggcgaattgatcggttgtgcattcgatggtaactgggaatcactgagcggtgacatcaatttcgataataacctgcaacgctgtatcaacctggacatccgttatgtactctttattctcgaaaagctgggaggatgcggacatttgattaacgaaatgacgattgttgaataa

SEQ ID NO: 717 - DNA, 1044 bp, B.fragilis
gagttaatcctgattttgcattggcgaaatatgatttatagaaattggcttgggattattggggtagcttgtatactttttgtctcatgcaaacccacggaggttgacgtgcctattacttattattcgtcttttctcttgaaagatactactgttatgctttctaaagtagaaatggatcctatgcaggtaaatgcacggtgtatggtgtgggatggcgataagcgggtattggttcgtacgtcaactacagattctatttatgctgtgtttgcttatccggaaatgaaatttttgagctataccggtagtttgtcagaatataaacagatattagccaaatgcaatgaaggcttttacttggtaaaagatgattcgttatatttatatcatttaacagataaggatttgttgcagaaaacgacaactcatttcctttataatagcaataagattcgattatctaaaattaagaaattgaatgataaaatgtatacagctcatgcatatacggatccttcttataatgatattaggttaaatgagttctacatgcttgatgctgagaataatatcttatatcctaaagggcattatccggagcgtactgaggtaagatttaaaacgatatttgactttaagtttgcctatgcgcacgaagtatggccaaaaccggacggaagtcgcatcttagttaattatgtgaggactcgccgttttcggatttatgatttgagtgcccgattattgcacgatgtatgtcttgattatgcatctaataaatatgttgtggatgcagatcctaaacgttggacaacgtttattagagattgttttgttactgataaatacatttatttgctatgtccggagggtgagcaatccagtttggttatagtagattgggacggtagaccaatagcgcgttatcgattggatgaaaagatttttttcttttttatagatccggatagaaatcttttttgtggtattaactcaaataatgggcagtctttttatttccttgatttagatataaattag

SEQ ID NO: 718 - DNA, 798 bp, B.fragilis
atattgataaaatgtttcatttgcatacgaatccgttgtacctttgtcgtcgaaaaagttgtgtatcctatgaataaagtattgccttttttacttttgctttttgtttttacctcttgtagtcgcaagtataagattgaaggcgcctcttctgtaaccagtctggacggtaaaatgctttttattaaagtacttcagaatggcgagtggctcaatattgattctgccgaagtggtgcatggactattttcgatgaaaggtaaagtcgattcggtagtaatggctacactctatatcggcgacgaaagcatcatgcctttagtgattgaaaaaggtaatattcaggtttcaattacaaatacagaattggtagcaaaaggaaccgctctgaacaatgccctctacgcttttattgataaaaagaattcattggatgttcagatagaagaattgcaacgtaaagaagcccgcatggtgatggatggtgccgacttggctgatattcatgagcaattgactcacgagggcgattcgttaatgcaagatatgaatggctttatcaaaaaatttatctcagataactacgaaacagttttaggtccaagtgtatttatgatgctttgcagcacactaccttatcctgttatgactccccaaatagaggacatcatgaaagatgctccttattcgtttaagaataacaaattagtgaaggattttattacaaaagcgaaatcgaatatggagctgattgaagagcatcagcgcatggaacaaaatgcgaccttgaaccattag

SEQ ID NO: 719 - DNA, 1158 bp, B.fragilis
ggaaaaacaaactatatccataacaatagcatcatgaaatttctgtttattgtgcaaggagaggggagagggcatttcacccaagccattacccttgaagacatgttattacgtaatgggcaccaggtagtggaggttcttgtcggcaaaagttcgtcacgtaccttgcccggctttttcaaccggagtatccaggcaccggtaaagcgtttcaccagtccgaattttttgcctacagccgaaaataaacgggctgatctgaaaaagagttttgcatacaatctgatacacgtaccggaatattttcgcagtatgtgttatatcaatcagcgcattaaggaaacaggggcggaagttgtgatcaacttctacgaacttctgaccggacttacctacgcactcttccgtccctccgttccttatgtttgcatcggacaccaatatctgtttttacacaaccactttgagtttcctcgaaaaagtgtgattcaactctccatgttgcgctttttcacacggatgacgagtctgcgcgctagcaggcggttggcactctcttttcgtaaaatggaatcggaccggactgaacggatatccgttgttcctcctctgcttcgcagggaagtgaccgctatgcagtcggcacagggtaactacattcacggatatatggttaactcaggttttgcagatagtgtagaggctttccatgccttgcatcctgaaattcctatgcactttttctgggataaacaggatgctgacgaggtgactaaagtggatgccacactgagttttcatcagattgatgatgtgaaatttcttaatagaatggccggttgcagagcatatgccagtacggccggttttgagtctatctgtgaagcgatgtatctgggcaaacctgtactgatggttcctgctcatattgagcaggattgcaatgcttatgatgcccggcaggccggtgccggaattattggagaatctttcgatttggagtcgttgcttcgttttgccggaacgtatgttcccaaccgggaatttattcgttgggttcgtagctgtgaacgacagatcattggagaacttgaacgacttgctgatcagcattcggctgtcactgtacctacattaactaattattttccgatatga

SEQ ID NO: 720 - DNA, 282 bp, B.fragilis
agtggtaaaaacaggaaagaaacagatcaaaaaaagaggaatttcttttatttattttgtaaaatagactgtaaatcgctgaatggtctgattttgttgttttttgaccggatattagcttccttaatcttattttttctcaaactttgtaaggtaaatcaatgtagaaagtatgactataatgaagttgagactgggagttcgtgggatgatgtggctaaccttggtaattatgatgtggggcatcatatcttgtcgaactcaagaagagaaatgtcttga

SEQ ID NO: 721 - DNA, 873 bp, B.fragilis
atatttatgaaatacttatatgtgttattagctttttcttttttgttttcttgtaaagatgagaataaaaaacatgcggaatctgttttgagggaatggatgaataaggaaattgttttcccgaataaaatgtattttagtattcagggtaaagagaatgttgattttcgtataaaagataccgaatataagattgtcgcctatgttgattctgccggttgcaccagttgtaaattacacttgtctaaatggaaagagttaatccattatgtggattctattcagtctgagcgtgtacagtttttgttttttttctttcccaagaatggaagagacatatatcatacaatgagaatggataaatttacctatccggtttgtgttgacacactcgattcttttaataagttaaatcattttcctgacgatgtaagattccagacttttttgctgaataaggagaataaggttgtagcagtaggtaaccccattcataacccgaatatcagagatttatttttgaatataatttccggtggcacttctcttccagatgaaaaacgtcctcaaacagaggtgaagatagaggctctgtctatggacttgggtatgtttgattggaaaaaagaacagaaatgtatttttaccgttgagaatacgggaaaagagttgcttgtgattgatgatgtcaatacttcgtgcggatgtactacagtggagtattcgagagaaccggttcagtccggaaagacgatagatattaccgtcgtttataaggctgaatatccggagcattttaacaagacgattactgtctactgtaactcgcctgtttcacctttgcaattgaaaataaaaggagatgctaaataa

SEQ ID NO: 722 - DNA, 411 bp, B.fragilis
tcggttatgaatttgaatgaggtagatatacattatttaattgcagccattagtgtgataacttcggcattggtgttttacacaataggagtgtggggagagcgattgcagaagaggttgaaattttggcatctggtattttttttgttgggactgctggctgattctgtgggaacggctttaatggagaatattgcgcgactcacacacttgcatgatgaaatacatactgtgaccggcattatcgctatcctgttgatgtttattcacgctatgtgggctatctggacgtatgtgaaagggagtgaaagagccaaggaacatttcaaccgtttcagtattgtggtgtggtgcatttggttgataccttactgcataggcgtatatcttggtatgtcattgcatcattga

SEQ ID NO: 723 - DNA, 1068 bp, B.fragilis
aatctcatgaaatactgtctgacatttctctttcttttggtaatctttactgggtgcacttcagatttgccgaaagatcggatgttgtatgcttcttttcctaaggaggagacactacattctaaggtaattcagcttgattcggtttatatgcgttatccgtttcgggtacatgtgtccggtgatcaggctgttgtcctggatttacatggtactgatgtgtattgccatctttttcattatcctgatttccattatctgtcttcgtttggcaggagaggagattcaccggaagagatgctttcagtagaaacagtgaaatgtatagatggttcattttggactttagatgccaacaaaggcgagttaactaggtttgagtttgtttcggatagagattcgcttctgcgtgcagaagcgatctctttcgataaagacagcattctgcgtgctcttgattttgtggcattcaatgatacgacttttctgatacctgactattcgggagatagccgattctgttgggtgaaccgacaagggaagtttttgaagaaaagtggagtgattccttcattgaacgaagaagcattgaaagaggcgcgtcctgccttagcacaagcttggcgcagttttattgattataatcctcataacggagtgttggttgctgctactcaattaggtgaagttcttgagatttataatcttcaaaacggttttcatagggtctgtttaggtcctaaaggggaaccggaattcaaacttgcgggcgggtatgctattccggatgggatcatgggattctcggatgtgcaggttacggatgaggctatttatgctgttttccatggtcacacttttaaagagattatggcacagcaccaaaaagagggaagagctacagatggtggacaatatatttatgttttcaacttacaaggggaacctttatgtaaatataccttagatcgttatatcacaggtttccatgttgatgaaagaaataagactattacagcaacagatgttaataacgaccaacccattgtggagttccgctttggctaa

SEQ ID NO: 724 - DNA, 564 bp, B.fragilis
gacgaaatgaaaaagtttagatgtactgtctgcggttatgtttatgaaggtgacgcagctcctgagaaatgtcctttgtgtaaagctcctgcaagcaaattcgtagaagttgttgaagaagaaggtggtgcactcacttttgttgacgaacacgtaatcggtgtagctaaaggttgtgacgaagaaatgattaaagacctgaacaatcacttcatgggcgaatgtactgaagttggtatgtatttggctatgagccgtcaggccgatcgcgaaggctatcctgaagtagctgaagctttcaaacgttatgcttgggaagaagcagaacatgcttctaagtttgctgaactgttgggtgattgcgtatgggatactaaaacaaaccttgaaaagagaatgaatgctgaagccggtgcttgcgaagacaaaaaacgtatcgctacacgtgctaaagctttgaatctggatgctatccacgataccgtacacgaaatgtgtaaagacgaagctcgtcatggtaaaggtttcgaaggactttataaccgctatttcggtaagaaataa

SEQ ID NO: 725 - DNA, 2172 bp, B.fragilis
ataatgatgaaaagaaacttattatctgctgcgtttgcactgatggcactggccgtcagtgctgacgaaggaatgtggatgctgactgacctgaaagcacagaatgaagctgccatgatggatctcgggttacaaatccctatagaggaagtctacaatccggatggaatagctttaaaagatgctgttgtacatttcggaggcggatgtaccggtgaaatcatctcggcggagggattggtattgactaatcaccactgcggatatggagcaattcaacaacatagcagtgtagatcacgattatctgacaaatggattctgggcaatgaaccggaacgaagagttaccctgcaaagggttgacagtaaccttcatcgaccgtatcctggacgtgacaacctatgtaaacgagcaacttaaaaaagatgacgatcccaacggcatcaattatttgtctcccaaatatctggcaacggttgccgaccggtttgcaaaagcagaaaatatccaaatcactccggcaacacgtttggagctgaaaccattttacggaggcaacaaatactatctatttgtaaagacagtctacaatgacattcgcatggtaggtgcccctccttcttcgatcggcaaatttggagctgataccgacaactggatgtggccacgccacacaggagacttttctttgttccgcatctatgcagacaagaacggtcagccggctgaatactctaaagacaatgttcctttacaagtaaagaaacatttgacaatcagcctggcaggagttaaagaaggtgattttacatttgtcatgggatttcccggacgcaactggcgctacatgatttccgacgaagtgaaagaacgaatgcaaacaaccaacttcatgcgccaccacgtacgtgaggcacggcaggccgtactgatggatcaaatgctgaaagatccggcagtacgcatacattatgcaagcaaatatgcttcctccgctaattactggaaaaatgccatcggtatgaacgaaggtttggtccgactgaaagtgttggataccaaagaaaagcaacaagaacaactgttggcaatgggacgtgagaaaggcgatgactcttatcaaaaggcttttgatgagatacgctcgattgtggcgcatcgtcatgatgccatgtatcatcagcaagccatcagcgaagcattggtaacggcactcgatttcatgaaaattccttcaaccgacggattgaaaaaagcacttgaaagcaaaaatgccacaaagattaaagaagaaaccgataagctgaaagcagaagcagataaatatttcgcatctgttccgtttccggaagtagaacgactcgtaggaaagaaaatgctggaaacctatgccggatatattccggaagatcagcaaatcggtattttcaaagtaatagacagccgttttaaagggaacaaggatgcctttatcgatgcttgcttcaagtactcgatctttggttcgaaagagaacttcaacaagtttatcgctcaccccactcttaacaaactggataaagactggatgatcctctttaaatattccatcacggacggactgttgaaaacggcactcgccatgaaggatgccaataagaactatgatgcagctcataaagtatgggtaaaaggtatgatggatatgcgtcaagttgccggtacgcctatctatccggatgcaaactcaaccctgaggttaacttatggtcaggtattgccgtacgagcccgccgacgggacagtatacaattactatacaacactgaaaggggtaatgcaaaaagaagatccggataattgggagttcgtagtgcctcaaaaactaaaacaactgtatcatgcaaaagacttcggacattacgcgatggaaaacggagaaatgcctgtttgcttcattgtcaatacagacaatacaggaggaaattccggaagcccggtattcaatggaaaagggcaattgatcgggaccggattcgatcgtaattatgaaggcctgacaggagacattgctttccggccttcttcacaacgtgccgcagtagtagacatccgctatactctatttattattgataagtatgcaggtgcctcacacatcatcaaggagctggatattgtagaagaataa

SEQ ID NO: 726 - DNA, 1560 bp, B.fragilis
aacacgatgaatacatttacacttggactgattgtgatagcctatctgctgtcactggcctatcttggttttttaggttataagaaaacatcctccgccagtgattacctggtaggaggtcgacagatgaatccgtttgtcatggcactctcttatggtgccacttttatatcagcctctgctattgtcggctttggtggggtagcagcagcttttggtatgggtattcagtggctttgctttttgaatatgtttataggtgtagtgattgcctttatttttttcggactccagacgcggcgaatgggtgctaaattgaatgtaagtacatttcctcaattgttaggcaggcattatcgttcacggggaatacaagtctttgttgccgcagtgattttcctcggaatgcctttgtatgccgcagtggttatgaaaggtggtgctgtctttatcgaacagattttccagattgattttaatatttcacttttaatatttacattggtaatagctgcctatgtgatcgcaggaggtatgaaaggagtaatgtatacagatgctttacaggcagttattatgtttggctgtatgctgtttctgcttttttcgttgtatcgggtactggatatgggctttactgaagccaatcaggctctgacggacatagctcccttagttcctgaaaaatttaaggcgttgggacatcaagggtggacggctatgcctgttaccggttcacctcaatggtatacattagtcacttcacttatcttgggagttggaatcggttgtcttgcgcagcctcagttggttgtgcgttttatgacggttgaaagtagcaaacaactaaaccgtggggtttttatcgggtgtttttttctgattattaccgtaggtgctatttatcatgcaggtgcattgagcaatcttttctttcttaagaccgaaggtgttgtagctacggaagcagtcaaagatatggataaaatcatcccatactttataaataaggcaatgccggattggtttgccgctctttttatgctctgtatcctttctgccagcatgtctacactgagttcacagtttcatacgatgggagcttcggttggttccgatatttatggtacttacaagcctcgttcacgtggtaaattgactaatgtgatccgtttgggagttttattttcaattttagtgagttatattatctgctatatgttgcccaacgatattatagcccgtggaacttctatttttatgggtatttgcgctgcagctttcctgccggcctatttttgtgctttatattggagacgtgctacccgtcagggagtgatggcaagcctttggatagggactataggtagtttgtttgcgctggcctttctgcaccagaaagaggctgcggcaatgggggtatgcaggtggcttttcggtaaggatgtgttgatcgaagcctatccttttccgatgatagatccgatattgtttgcattgccattatcggtagcagccgttattattgtgagtttgttaacagagaaagggaaaaaataa

SEQ ID NO: 727 - DNA, 1503 bp, B.fragilis
acgaataagaaactaataagaaattataaaatgaaaaagataatattactcatcgtatctgtgtggatgtgcgtttcctgtggaaatctggaagagatgaacattgatccggacaatgccacccagacccaccccaaactcctgcttacccaaatctgcatgaatgcttttaaaagagggactgacggaatgtatgctaccaaaaaagtaattcaagccgacggagagagtgcagatcaatattacaaatggacccgcggaagttttggctactatgacaatctccgcaatgtacaaaagatgggtgaagaggcagaacgtgtaaatgctccggtgtatacggcactcactaagttcttccgcgcctactacttctatgaactgactctccgtttcggagacatcccctacagtcaggccttgaaaggagaaaaagaagaaatatacactcccgaatatgatgcacaagaggatgtttttgcaggaatcctccaagaattgagagaagcagacgaaatactggcaaatgacgcatctgtcattgacggagacatcatttataacggaaatagcacccagtggaggaaactgatcaactcttttcgtctgaaagtgctgatgaccctctccaatcatacaacagtagggaatataaatatcgcttctgagtttaaaaacattgcgacaaacagcccgttgatgaatagcctggcagacaatggacagttggtttacctggatcagcagggcaaccgatatcctcaattcaatgcccaatggtccggctattatatggatgatacatttatccaacgtatgcgcgaacgtcgggacccacgcttgttcatcttcagcgcacagaccaacaaaggaaagactgaaggaaaacctatcgacgacttcagctcttacgaaggaggagaccctgccgccccttatagcgatgctattatcaaagttagtgagggtaccatatcgcccatcaacgaccgtttccgtacagatccgattgtagagcccaccatgctgatgggatatgccgaattacaacaaattcttgctgaagctgttgtacggggatggatcagtggcaatgcacaaacgtattacgagaaaggtatccgcgcctcattctctttctacgaaacccatgcaaaagattatgccggctatctgaacgagaacgcagtggcccaatatctgaaagaaccattggtcgacttcacccaagcatcgggtactgaagagcagatagaacgcattatcatgcagaaatacctggttacattttaccaaggcaactgggattccttttacgaacaactacgtaccggctacccggacttccgtcgcccagccggaacagaaatccccaaacgatggatgtatccgcaaggagaatatgataacaacggtactaacgtagaaacggctattacacgccaattcggtgcaggaaatgacaaaataaaccaagctacctggtggcaaaaaaaatcatag

SEQ ID NO: 728 - DNA, 2013 bp, B.fragilis
agaatgaagaaattatcctcttttctgcttttgttgctggtcgtatttacggcgcaggcacagatacaagagcctgtgaagtttaaaacggagctgaaaaccctgtcgggagccgaagcggaaatcgtttttacaggtacgatcgatgccggttggcatgtatattctaccgatttaggtgatggtggtcctatctccgctacttttaatgtagagaagatgtcaggtgccgaagttgttggtaaattaacccctcggggaaaagaagtttcggactttgacaaactgttcgaaatgaaagtacgctattttgaaaaaacggctcaatttatacagaagataaagtttaccggcagtgactattcaatagaagggtatctggaatatggtgcatgcaacgatgaaaattgtctgcctcctacacaagttccctttaaattttcgggtaaagccgctgctactgccgaagtctcggcaaaagaaacccctgcaactccggtaaaagagccagtcgccactgttacagacagtattgtagaaccgacagctacaactgttaccactgcgataggcagtgttgacttatggaagcctgtaattaatgatttgaagaaattcggtgaggcaaactctcaggaagatatgtcatggatctatatttttattacaggatttttaggaggtttgctggccttgttcactccttgtgtatggcctattattccgatgactgtaagtttcttcctgaagcgaagcaaggacaaaaagaaaggtatccgggatgcatggacttatggggcatccatcgtggtaatctatgtagcgcttggccttgccattaccttgatatttggtgccagtgctttgaatgccctttccactaatgctgttttcaatatcttgttctgtctgatgttgatcgtatttgctgcttctttcttcggagctttcgaactgacacttcccgcaaaatggagtacggcagtggatagcaaggcggaagctacaagcggattactgagtatttttttgatggcgtttacattatcgcttgtatctttttcttgtacaggtcctattatcggatttttgttggtacaggtttctactacaggtagtgtagtcgctcccgcgattggtatgttgggctttgccattgcattggctctgccatttactttattcgctttatttccgtcttggctgaagtcaatgcctaagtctggcggttggatgaatgtgattaaagtgacattgggtttcctggaattagcttttgctttaaaattcctgtctgttgccgatttggcttatggatggagaattctggatcgtgagactttccttgctttgtggattgttatttttgctctgcttggtttctatctgttgggtaagattaaatttcctcatgatgacgatgatacgaaagtaagtgtatctcgtttcttcatggcactggtttcattagcttttgctgtttatatggttccgggcttatggggagcacccttgaaagcggttagtgcttttgcaccgcctatgaaaacccaggattttaatctttataccaatgaggtacatgccaagttcgatgattatgatttaggtatggaatatgcccgtcagcataacaagccggtaatgctcgactttacaggatatggttgtgtgaactgtcgtaaaatggagcttgccgtatggaccgatccgaaggttagcagcatcattaataatgactacgtactgattactctttatgttgacaataagactccgcttactgaaccggtgaagatcatggaaaatggtacagaacgcactttgcgtacggtaggtgataaatggagttatctgcagcgtgtgaagtttggtgccaatgcccagcctttctatgttctgatagacaatgagggtaatccgctgaacaagtcgtatgcttatgatgaggatatatccaagtatatcaatttcttgcaaacaggacttgaaaattatcggaaagagaaatag

SEQ ID NO: 729 - DNA, 1032 bp, B.fragilis
tatatgtggaagaagttgtcgctgtatgtttgtttaataactattttgtgttcttgtcagaaacaacgtagtgcttatgcacctcctacgtttccggaagtaaagaaaatacatgctcatcgtttgtcggacgaactcctgatcagctatcttttggatatggctgttagtgaggactatatctttatattggctttggcagataatgcctggttgcaggtatatgataagactacagggcaactgcttggaagttttgtaacaagagggcagggaccgggtgaagcgactactgcgaacatgtgctattataatgcacgtgaaaagaaaatttctgtgtatgacgaatcttctatgaagttattgacttatcagtttgataaagacgctgataattggggagcgttgatagaagaatggtctttttatgatttaggaggtacactacgccgggtgtgggaacttcggaatggtaggtttttggtagatggtcagttgggaacaaagtcggatcagcaaaaacgttttcagatgttggcagatgcaaaagtggtggctgattacaatgattttcctatagatactccgaaagaacgttccgtttggtcatcgccagcaattgcgatatctccggattgtaaaaagatggccgtaggaactttatatggaggaatccttgaattatttgatttatcacaaaacatagaattaagagcaatccgaaaattttatcctccggtcgtgcaatatttatccggaactatccaaaacacagaggagactgtttggggcttttctgcgttatgtgctacagatgaaaggatttatagtgtatttataggtgacaagaatcccaatttatttaataacttatctgtttttgattgggatggccgggaattaatcaaatataatactgattgcctcgttttgagaatttgtgcttcaactcaggaaccaaataaactgtatgggattgctttttctgaaactcatgaattttatctggtctctttttccttgggttcttga

SEQ ID NO: 730 - DNA, 777 bp, B.fragilis
aacgactacctttgtgagcgatttgagaatcgtgactacgtatttttaattatatcacttaaaaaagagctaattatgacttattcacacgaagtggaacacatgtgtgttgtaaagaagggtcctaaccacggaccggctcccatacccgaagaaggaaaatgggtaaaatcaaaagaaattgttgatatttcaggtctgacacacggtgtgggttggtgtgctcctcagcagggtgcatgtaagctgactctgaacgtaaaagaaggtatcatccaggaagctctggttgaaactatcggctgttcaggtatgactcactcagctgctatggctgctgaaatcctcccgggaaaaactatcctcgaagcattgaacacagacttagtttgtgacgccatcaacactgctatgcgcgaactcttcttacagatcgtttacggacgtactcagtcagctttctcagaaggtggtctgatcatcggtgcaggtcttgaagacttaggtaaaggtctgcgtagccaggtaggtacattgtacggtactttggctaaaggtcctcgttaccttgaaatggcagaaggttacatcaagacaattgctcttgacaaaaacgatgaaatctgcggatacgaattcgttcacatgggcaaattcatggatgaaatcaagaagggtactgatgcgaatgaagcattgaagaaagttaccggtacttacggacgcttcactgcagaacagggagctgttaaacacattgatccacgtcacgaataa

SEQ ID NO: 731 - DNA, 195 bp, B.fragilis
ttattttccgatatgaaattgaataagactgattatatgcttgagcgcacatccgatggcggttattatgcttggcttactgtaaatatgcagtgtaatgcgtatggggattcacccgaagaagcggtaaaaaacctggaacagaccatggaagacctggttgaagaaatgtatttggtagaggattttatatag

SEQ ID NO: 732 - DNA, 582 bp, B.fragilis
atcaatgtagaaagtatgactataatgaagttgagactgggagttcgtgggatgatgtggctaaccttggtaattatgatgtggggcatcatatcttgtcgaactcaagaagagaaatgtcttgaagaggttttatctcttccgctcgccaataaagaagaactacaaaaagtactggatcattataaagatgacagcctgaagtatcaggccgtttgctttctaatcaggaatatgccttttcatgcaggatacgagggaaatgctttgaagtattattaccaatattttgatatttacgcgcaaggaaaattaggaccgcacgaagtgattgattctttaaaagaaaattcgttttctgtttcgcaattaaaacggatagaggatattgccaatattgattcttctttactggtgcagaacgtggattgggcttttaaggtgtggagagagcagccttggggcaagaatgtaagttttgataatttttgtgagtttgttctaccttatcgattgggagatgaaccacttggattctggagagaagatatttataaacgctataatccaatattagattag

SEQ ID NO: 733 - DNA, 1026 bp, B.fragilis
ggaggaaaagaaattatgattagagaagtaaaatttgaaagtcaggaccgccgtatcaaaggtatcatcgaagccttgaacgctaacggcatcaaagacatcgaagaagctaacgctatctgcgaagctgctggagttgatccttataaaacgtgtgaagaaactcaaccgatctgttttgaaaatgctaagtgggcttacgtagtaggtgctgctatcgctatcaagaaaggttgcaaaaacgctgctgatgctgccgaagctatcggtataggtctgcaggcattctgtatcccgggttctgtagctgacgaccgtaaggttggtatcggtcatggaaatctggctgctatgttgttacgtgaagaaaccaaatgtttcgctttcttggcaggtcacgaatctttcgctgctgccgaaggtgctatcaaaatcgctgcaaaagcagacaaagtacgtaaagaacctctgcgttgtatcttgaacggtcttggaaaagatgctgctcagatcatctctcgtatcaacggctttacttatgttcaaacacagtttgactatttcacaggtgaactgaaagtagtacgtgaaattgcttactctgacggtcctcgtgcaaaagtaaaatgctatggtgcagatgatgtacgtgaaggcgtagctatcatgtggaaagaaggtgtagatgtatctatcacaggtaactctactaacccgacgcgtttccaacacccggttgcaggtacttacaagaaagaacgtgtactggcaggtaagccatacttctcagtagcttcaggtggtggtacaggtcgtactcttcacccggataacatggctgccggtcctgcttcatacggtatgactgacactatgggtcgtatgcactcagacgctcagttcgccggttcttcatccgttcctgctcacgtagaaatgatgggattcctgggaattggtaacaacccaatggtaggctgtactgtggcttgtgcggtagatgtagctcaggcattggcaaagtaa

SEQ ID NO: 734 - DNA, 351 bp, B.fragilis
aagatgaaagagtacattgatgttttaaagaagtggaaagatttcgacggtagagccagaagacgtgaatactggatgtttgtcttgttcatggctatttttgctattgtcgcaagtattattgacgctattttgggtacgatttgcgtatttgtaggtatttattatttggctatgcttctgcctatgattgctgttagtatacgtcgtatgcacgatattggcaaaagcggatggtggttatttatcactttcgtaccggtgatcggcagcctttggtatctcttcctgactattcaggacggacagccgggtagcaaccaatacggtgaaaaccctaaaggaatttaa

SEQ ID NO: 735 - DNA, 1056 bp, B.fragilis
attggaggagataagaaaatgaaaacattgcaagaattaacccgtccgaatatctggagactaaaaccctattcttcggcccgtgatgaatatagtggggcggcagcatctgtttttctggatgctaacgaaaacccgtataacctgccgcacaatcgctatccggatccgatgcaacgggatctgaagttggaattgtccaagataaaaaaagtagctcctgcccatatctttctgggaaatggcagtgatgaggctattgatttggtgtttcgtgctttctgtgagccgggcagagacaatgtagttgctatcgatcctacgtacggcatgtatcaggtttgcgccgatgtcaatgatgtggaataccgcaaagtgctgcttcacgatgattttcagttttctgccgatgagttgttggcagttgcggatgaacggactaagatgattttcctttgttcacccaataatccgacgggaaatgatctgcttcggtctgagataataaaggtgatcaatgatttcgaaggattggtcattctggacgaggcttataatgatttttccgatgaaccctcatttttgtcagagttggataagtatccgaatctgattatcttacagactttctcaaaagcgtttggttgtgcagctattcgtttggggatggcttttgcctccgaggggattatcggtgttttgaataaaatcaagtatccgtataatgtgaatcagctgactcagcaacaagctatagaaatgctccacaaatactacgagatagaacgctgggtaaaaacattgaaggaggagagggggtatctggaagaagctttcgttgagttgccttgggtattacaggtatttccatcgaatgccaacttctttctggcacgtgtgaccgatgctgtgaaaatttataattatctggtgggagagggtattattgtacgtaatcgaaattccatatcattgtgtggcaactgccttcgtgtgactgtaggtacacgggctgagaatgccaaactgattggagcactgaaaaaatatcaatag

SEQ ID NO: 736 - DNA, 594 bp, B.fragilis
aatataaaactgcggaataatttgaattacaaagcattatttcaaatagcaatgtcattgatttcctctccggccaaggcctgggaggaaattcgtttagaggatagacgggcagttcttactgtttttgtctatcctatgattggtttatgtggtttatccgtattcattggtgctttgtggactaatggttggggaggaccacaaagtttccagttggccatgacgcagtgttgtgcggtggcggtagctttgttcggaggttattttctggcggcttatgctatcaatcagatggggataaaaatgtttggtatgaccaatgatatccctttggcacagcagtttgcaggttatgcgttagttgtcacttttttgttacatatagtaaccggattgcttcctgatttcagtattatcggttggctgctccaattttatatcgtttatgtggtatgggaaggagcaagggttgtgatgctggtagaagaaaagaatcggttgcgttacaccattttctcgtcgattttgttaatactatgtccggcggtaatacaagttgtgttcaacaagctaacagctatattaaattaa

SEQ ID NO: 737 - DNA, 2175 bp, B.fragilis
tcgaatctttgtatttttgtcaaaattgaattgatacattatattattaaatcgcacaaaaacatgaagaagatgcttatggctgccggaatggctgccgtgatgactgcttgcggcacagccggacagaaagcagccaccgatgccggaaacccttttctggcagagtattcaactcctttcggtgttccaccgttcgacctgattaaagtagagcattacaaagaagctttcctgaaaggaatggaagaacagaaaaaagaaatagatgctattgtcaatcagcgttcggttcccgatttcgataataccatcgctgcattcgatcagagtggagagttgttaaataaggtgagtactgtgtttagtggtctgaacagttgtaacacgaacgatgaaatgcaggcttttaataaagagattactccgttgctttcggcacatcgggacgatattagtctgaatccggctctttttgcccgtgtgaaagaagtttatgaacgtcgggagaaactgggattggataaggagcagaataagttactggaagaaacttacaagaagtttgttcgtggaggtgccaatcttgattctgtggatcaggcgaagttgcgtcaactcaatagtgagatttcgatgttgcaattgacttttggacagaatctgctgaaagaaaccaacgcttttgagttggtgattgataagaaggaagatctcgccggattacccgaaagtcttgtggcatccgcagccgaagcggctaaaggggcaggtatggaagagaagtggcttttcactttgcacaatccgagtgtaatgcccttcttgcaatatgcagataatcgcgagttgcgtgagaaaatctttaaaggatacatcaatcgcggcaacaatggcaatgaggccgataataatgaaatcgtgaaaaaattggttgctttgcgtctggagaaagccaaattgatgggatatgccgattatgcttcttatattttggaagaccgcatggcaaagaacgaggaaaatgtatatcgtttactgaatcagatctggactcctgcagtggcgaaagccaaggaggaattgtctgatattcagtctgaaataaagaaggaaggcgctaactttacccccgaaggatgggattggcgctattattttgagaaagcgaagaaagccaagttcagtttagacgagaatgaagtgcgtccttatcttgaattgaataatgtgcgtgaaggtgctttctatgtagctaacagactttatggcattactttcaccgaaattaaagacattccgaaaccgcatgaagaggcacaggcttttgagtgtaaagataaagacggaacccatcttggtgtgctgtatatggactttttccctcgtaatagtaagcggggaggcgcatggtgtggaacttatcgttctcaaacctatcgtgacggtaaacgtttggcgccggtagttacgattgtgtgtaactttaccaagccttcttcgggacagcctgccctgcttagtgccgatgaggccggtactttattccatgaatttggtcatgcactccacaatttgtttaaagatgtacactttcatgccgtatccggtgtaccgcgtgattttgtggaattaccttctcaggttatggagcattgggtattcgaaccggaggtgctgaaaatatatgccaaacattatcggaccggtgaagtgattcctgctgcattgattgagaaactcgataagagtggaaagtatggccaggggtttgccacaaccgaatatcttgccgcttctctgcttgatatggattaccatgtactgaaagagattccccggaatatggatgtcactgaatttgaggctgctgtgctgaaagagcgtggcttgctaagtcagatacctcctcgttatcgtactacatacttcaatcacatcatgaacagcggctatacggctggttattacagttatatttgggccgaagtgttagatagcgatgcttttgaagcatataaggaaaccggtgatctgtttaatcaggaagtggcttcccgtttccgtcgttatattctcactcccggaggcatcgacgatgcgatggatatgtataagaactttcggggtaaagaaccgggcatagaacctttgttgaggaataggggactatag

SEQ ID NO: 738 - DNA, 738 bp, B.fragilis
ataatacaatgtgttttaccattacgttgttattttaattatttgtttttatatttgtcagccaaagctgttttttacagttgcaaaattactctatttgtttcaaatatacactataaaaggatgttaataataggaatagcaggcggaacaggctcgggaaagaccaccgtcgtacggaaaatcattgagagtctaccagctggtgaagtagtattgctacctcaggattcatactataaagacagtagccacgtaccggttgaagaacgccagaatatcaattttgaccatcccgatgcttttgaatggagccttttgtctaaacatgttgccctccttaaagaaggcaagtgtatcgaacaacccacctattcttatttgacttgtacccgccaacccgaaacgatccatattgaaccacgtgaagtggtcataatcgaaggtatcctggctttatgtgacaaaaagctgcgcaatatgatggatctgaaaatatttgtagatgccgatccggacgaacggttgatccgtgtgatccaacgtgacgtagtggaaaggggccgcactgcagaggctgtaatggagcgatatacgcgtgtgctgaaacctatgcatttacagttcatcgaaccatgtaaacgctacgcagatttgattgttcccgaaggagggagcaatcaagtagccatcaatatattgaccatgtatataaaaaaacacatcggtaggccatga

SEQ ID NO: 739 - DNA, 1395 bp, B.fragilis
gccatgaaacggcatctgataatttactccctgctttttcttcttttctgtgtattgtcttgccgcaacaaacaagcagtagctatagaggagtcctctgcacacgatctggaacaaatcaaagatagcggagaactcgttgttctgactctttatagttctacttcttatttcatctatcgtgggcaagacatgggtttccaatacgaactcagtgaacaatttgccaaaagtttaggagtgaaattgcgaatagaagtagccaaaaacgtaccggaactcatccgaaagttactaaatggcgaaggagatattatcgcatacaatattccgattactaaagaattaaaagacagcctgatctattgtggcgaagaagtaatcacccaccaggtaattgtccaacgaaccaatgggaaaacaaaaccgctaaaagatgtaaccgagttggtcggaaaaaacatatatgtgaaaccgggcaaatattacgaacgattggttaacttgaataaagagctgggaggaggcattctgattcatcaagtaaccaatgacagcattaccgccgaggatttgataacccaagttgcacaaggtaaaattccttatacagtggctgataatgatgtcgctaagttgaatgcgacttattatcctaatctgaataccagtctgtctatcagttttgaccaacgcgcttcctgggctgtacgtaaagattgtccgcaactggcagcagcagcagacgaatggcataaacagaatatgacttcgccggcatataccgcaagtatgaaacgatattttgagatcagtaaagcaatgcctcattctcccattttatccttaaaagagggtaaaatctctcattatgacaacttattcaagaaatatgcgcaagagataggttgggactggcgtctgttggcatccttggcctataccgaatcgaacttcgatacaactgccgtatcatgggccggagcaaagggactgatgcaattaatgcctgccaccgcccgtgcaatgggggttccaccgggcaaagagcaaaacccggaagaaagtatcaaagctgcggtgaaatacattgcagcgacagatcgcagcctaagcatggtgccggataaacaggaacggattaagtttatactcgcttcatataatgccgggctgggacatatttttgacgcaattgcactggcagataaatacggtaagaataaaaccgtatggacagacaatgtggaaaattacatcctactaaaaagcaatgaagaatatttcactgatccggtatgcaaaaacggatatttccgtggaatagagacctacaatttcgtcagagacattaactcaagatatgaatcatataagaagaaaataaaaagttga

SEQ ID NO: 740 - DNA, 1431 bp, B.fragilis
tccaatattagattagtatcccggtttgttgcctcaaagctccaggattccgttgggttgctgcaaaaggtgttgatggatttcgcttgtttgtggaacaatcccattttcccgttttgttttcccgcgggtcctcatttaggtccttcagtagtgtcatggcgtgcggggagctgtcgcgagttcgccgatttggtagtgtatgtaatgcgtgctttgggtattccttgcgggacagactatatgccgatgcgtggagataataacgtgccgcatttctggaattttacattggataaagatggaaaaacgtatattacggaatttcccgatcctaattggaaacgggctgtgagtatgtataatcctaaggcaaaggtataccggaatacgtatggcttaaactggaaagatgtaaagagacaacagggaaaaatgatgcatccggcgtttcgaaaacctctatatcaggatgtcacggctgtgtatgccgacagcttgaatcgtgatctggtagtgtcttctgatattttgtgtaaggaagttcacaaaggagatattgtctatttttgcctttccacaaggatggattgggtacctatagcatggactgtttttgaagaagactcattgcgctttcaagatacggaaggtagtgtgattggttgtttggctacatggaatggaaaacgtcttgtgatgcagtccgagccgtttacctatgataaaatgtcaggaacgattgctttgctcactcctcaaagtgaaaaagaagatataaccttgtattttaagtttccgctgttctgcgacttaggtatccttcgtatgcccggaggagtttttgaaggaagtaatgattcgcagtttcgctctgcagatacattgtattatgtaaaacaatggcctttccgcttgaacaacactatttttccggagaaagaaaagtcttatcgctatgttcggtacaaggggccgaaggggagttattgcaatatagcagagatggctttctttgaagatacctcggatacgttggcgttgaaagggcggatcatcggaactccgggttgttttcagaaagacggctcgcatgattattacaaagtatatgatggcaatccctatacttatatggattataagactcctgatgaggggtgggtcggattagattttggcattcctcgccggataaagaaatttacttatattcctcgtaattcggataattttatccataaaggagatgtatatgaattattctattggcatgacaagaaatggaattcgttaggtcggcaagtggcaaaagcagattctttaaattatgtaattccgaaaggggtagccttatttttaaagaatcatacggagggaaaggacgaacggatctttaagaagaccgatgggagacaacagttttggtag

SEQ ID NO: 741 - DNA, 720 bp, B.fragilis
gaaaggaaaagtatgaaaacagtagtagacaaagcctcttcaaggggttatttcaatcatggttggctgaaaacccaccatacatttagttttgcaaactattataacccgtcaagaatgcatttcggcgtattgagggtactgaatgatgatagcgttgaccctgaaatgggattcgatacacaccctcaccagaatatggaagtcatttctatccccctgaaggggtatctgagacatggcgacagcgtaaaaaacacccggacaatcacacccggcgatatccaggttatgagtacggggaaaggtatcttccacagtgaatataatggaagtgacaaagagcaattggaatttttgcaaatatgggtattcccgagaattgaaaatacagagccggaatataacaactacgatattcgtcctttactgaaaagaaacgaacttgctctaattatttcaccggacggtaaagtacccgcttccattaagcaagatgcatggttttctatgggaacatttgacgcaggaaagagtttcgaatacaagttgcatcaggaaggtaacggagtttatctttttatcatcgaaggagatgtggaagttgcaggcaaccgattgtcacgacgtgacggcatcggtctttgggatacaaagagctttaaagtggaaataacccaagaagcgaccttattgctaatggaagtaccaatgcgataa

SEQ ID NO: 742 - DNA, 1482 bp, B.fragilis
gtatttcggaggaagctacaaagtacagacaaatccggacggaaagccggccatcctcttcacgtttccctcaggaagaaattgacttcttcccctatccgctcgtctacttctacagaaagttgtatctttgcaacctgcaaacttaaacccttctttatgtataccaacaaacagatctggagtgtcagttacccgattctcctgagcttgcttgcgcaaaatgtcatcaacgtcaccgacactgcctttctgggacgtgtcagtgagatagccctcggtgcttctgccatgggtgggcttttctatatttgtattttcaccattgccttcggattcagcaccggttcccagatcgtcattgcccgccgcaacggtgaagcacgttacggcgatgtaggtccggtcatgattcagggagtcttgttcctgttggtcatggctctcctgctcttcggattcaccaaagcgttcggcggaaacatcatgcgcctgctggtctcttccgaaagcatttatgatgccacgatggagtttctcgactggcgcatcttcgggttcttcttctcatttgtcaacgtgatgttccgggcactctacatcggaatcacccgcaccaaggtgctcaccatcaatgcagtggttatggcgctgaccaatgtggtactggactatgccctgatattcggacacttcgggcttccggaaatgggcatcaaaggagcagccattgcttccgtaatcgccgaagcggcttctctgctctttttcctgatttatacgtacatcaccgtcaacctgaaaaagtatggtctcaaccgcttgcggtcgttcgacccggttttgttgatgcgcattctcagtatatcgtgcttcaccatgcttcagtatttcctgtcgatggccacctggtttgttttctttgtggcagtggagaggttgggacagcgcgaactcgctattgccaacatcgtgagaagcatctacatcgttatgctgattccggtaaatgcactggccaccacgaccaacagcctggtgagcaacgccatcggcgcgggaggcatcaactacgtgatgccgttgataaacaaaatcgggcgcttctctttcctgatcatgctgggactggtcatcataaccgccctgttcccacaagcattgctctcggtatacaccaacgaaacggcattgatcaatgaatcggtatcatcggtatatgtcatctgcgtggccatgctgattgcctctgttgctaacgtcgtcttcaacggaatatcgggtacaggcaatactcaagcagccctgatgctcgaagccatcacgattgcaatctacggatcgtacatcattttcatcggaatgtgggtgaaagctcccatcgaatggtgctttacgattgagattctgtactatacactgttgctcgccacaagctatatttatttcaaaaaagcaaaatggcagaacaaaaagatataa

SEQ ID NO: 743 - DNA, 1269 bp, B.fragilis
tatatgacaggagtagcggaaaagaaaaaaagaatgataaagatttacctattatgggtgctgttagtcggtagcttgtgctgttcttgtacaggaaataaacgattggaatatgcgttggagtttgccggggagaataggggagagcttgaaaaagttttggaacactataatgatagcggactgaaacaggatgccgcacgctttttgattgaaaatatgccccgctattttagttatgaaggatggcaattggatacgttaaaagcaattcatgcagccacagaacatacggatggatgggtgaataaaaaagatcgcaaaaaatgggaacatttttcttttcggactttaaagaaagtttatgatgctaaagtgattaaagctgagttcttgattcatcacatagatcaagcctttgaagtttttgaaaaaagatcctggaataaatatttgccatttgatgatttctgtgaattgattttgccatatcggattggtgatgaacccttggaggaatggcgtggttggtatagggagcgttatgaatctatattggattcgctctatcaagggacagatgtggtagaagccaccgatcgtttaggggcttatttgcgtcaggaaaaagacttcaggtatagtgttgagctggacttaccccatttaggtgcaggttttttgctagctaacagggttggaagctgtgaggcgtcttgtgattttacggtctatgtgttacgtgcgcttggtattcccgctgcaacggatatttatcattatggacccggtaagggagccggtcatgtctggaatgtattgagggatacaaccggtggctatgttcctttctggtttattcagactaaagtggagcggggcggaagtgataaacgagaaaaagggaaggtatacaggcggtgttttggagcacagcaggagaaagtatcaggtatccgccgcgatcggtctgttccgtttccgctgaaagatccatatttaaaagatgttacaagtgactatttcccggcaaatcaggttacaatagaaattgatcctcaggttgataaaaagtatatctgcctgggtgtgtttacattggaaggatgtatgcccatagatataactgtgcagaaaggaaataaagcaacctttatgaatgtagaacccggaattttgtttcaaccgctatatgataacgggatgaagtgggtggcagccggataccctttccagtgtagacgaaaagggagaggtgaagtatcataa

SEQ ID NO: 744 - DNA, 504 bp, B.fragilis
aacgaaaaaggtatgaaaaagattattaacccgtggaaggggatggaaggatataattgctttggttgtgcccctaacaatgaagccggtgtgaaaatggaattttatgaggataacgatgaagtgattagcatctggcgtccccgtcccgaataccagggatggattgatacactacatggaggtatccaggccgtacttttggatgaaatctgtgcatgggttattctccggaagttacagactacgggggtgacatcaaaaatggagacacgttatcgtaagtcgatcagtactaatgattcacatgtagtgctcaaagcgcatattaaagaagtgaagcgtaacattgtgataattgaggcacgtctttataataaagatgaggaattgtgtacagaagctctctgcacttacttcacttttccgaaggagaaagccagagaagagatgcattttttgtcatgcgaagtagaagatgaagagattcttcctttaatttga

SEQ ID NO: 745 - DNA, 1017 bp, B.fragilis
cccatatttataatgaaaaagattattttaagcagcgtattattgctatccggcttctttatccaagcgcaacaagctcccgagaaaatcagctttaattccaatggtgaatttaagatagcacaatttaccgatatgcacttgggacatgatcaggagaaagaccgaatagtgggagatatgatcaaagaagtacttgattctgaaaagcctgacctcgtgatatttacaggagacaatactactatggatgaagtccggcaagcttgggaagccatatctgccgaactgtcggcccgccggatcccttggacagccgtattgggaaatcatgatgacgaatatgccgtaaagcgtgatgaaatcattcgtatcatccgggaacaaccgtattgtatgatgaaacaagtggcagaaggaataaaaggagaaggtaaccatattctccctatttacagttcgaaagacggaaataaaacagccgcattgctttattgcctggacacaaatgcttattcgaagataaaaacagtaaaaggatatgactggatcggacgatctcaaatagactggtactcccgcgaaagccggaagtacacagaacggaatgagggacaaccattacctgcattgaccttcctccatattccgctaccggagtacacccaagcatgggaatcgttcgaaaccaaacgttacggagaccgtaacgaaaaagaatgcagtccccatataaacagcggtatgtttgccaatatgctggaatgcggtgatgttatgggtgtttttgccggacacgaccacgtaaacgattacatcgctactctctataacatcgctttaggatatggacgagcttcgggcggaaaaaatacttacggagataaaacaccaggcagtcgtatcatcgtattgaaagaaggtaaacgtgaattcgatacttggcttcgggaaaaaggaaatatggcaaaactgaatgtatgtacatatcccggctcttttgtaaaagagaaatag

SEQ ID NO: 746 - DNA, 3165 bp, B.fragilis
ttagtacttatgaacagtaaatttctcctgctactctgtagtatgttattgtgcacatcacttgcattcgcacaatcagtcaaagtaacaggtacagtcacagacaaaatgggggcagtaattggtgccactatcatggtgaaaaactcatcaaacggaactgtcaccgatatagatggtcgttacagcatcgaagttcctaaaaacgcaacactactattctctttcgtaggttacagcacagtagagaaagaggtaggtaacaacactgtaatcaatgttgaactgtccgatgacattcaggccatcgacgaggtagtggtcactgcaatcggtatcaagcagcaaaagaagaagatcggttacacaacccaacaaatcaacagtgaggtattgaatgccactcccagtctgaatgtgggctcggccctttccggacaagtagccggtctgttggtagccaaccctaccggtattttccaggcaccgagtttcaaactgcgcggcaacgcaccattggttgtactggacggagttccggtagaaaccgactttttcgacatctcaagtgagaatattgaaagtgtcaatgtactaaaaggtacggcagcctcagctttatacggttcacgcgggaaaaacggagcaattctgatcaccagtaaaacggccaaaaaagaaggcttggaaatcaacttctctaccaacaacatgatcacagccggctttgcagtgcttcccgagacacaacatcaatacggtagcggttcaaatggtaaatatgaattctgggacggtgcagatggcggcatttcggacggtgacatgacttggggacccaaattaaatgtaggaaccaaagtagctcagtggaacagcccgatcagggataaagtgactggaaaagagattccctggtggggagatgtaaaaggtactcagtatgatgacaaatcgcgctatgaacgtatacctatcgactgggtatcccatgacaacctgaaagactttctgcaaaccggactagtaaccaacaataatatctcaatagcttataaaggagaaaaagcacgctacttcgtcaccggacaatatgcttaccaaaagggacaggtgccttctactgaaatgcacagtggaggtatcaacttcaactctacctttgatctggctaaaaacttgcagctggatgccaatctggcctacaacaaaatagttgccccgagttatccgcgctacggatacggacctaaaaaccacatgtacaccatcgttgtatggatgggagacgatgtgaacggtaaagaactccaaaaacacaaatacgttcccggacaggaagggtatcggcaggcaagttacaattatgcatggtataataatccttactttgcagccgaagagctccagcaatccgaaagtcgggatgtggtgaacgggcaagtccgcctgaattatcaaatcctccccaatctgaacatacagggacgtgccgccttacgccagaaaacaattcttcaggaaatgaaagtacccaaaacttacatgaactacggtgactcccgggaaggtgactacaaagtatggaatgaccgtcaaactaatgtagacgctgatgtactggctacctacactcaagatctgactccggatatcctcttcaccctgaatgccggaacttcggtattctaccgtaattaccgtcaggaatatcagtctaccgacggtttgattgttccattcgtatacagtatcaaaaacacacaaggtccttccattaccgatgccaaccgaaatgaaaaatcaatccgtagtatttatggatcaatcaaccttgatctttacaaatatgcctatctgacgttgacaggacgtaatgactggtcatctactctggcaaaaggcagtaactcttacttctatccttctgtcgcactgagtactatggtatccgaatacatcaaattgccaacatttatggactatctcaaaatgtatggttcatgggcggttgtctctaccgacctgtctccctaccagatcatgtccacttatacaaaagattccaattacggttcaaatccatctatttcctacccttcttctctggtcaactactacattaaacctcagaaaacgacatcctgggaagccggattgtcaactgcattcttccgtaaccggttatctttcgacctgacttattatcatacgatcgatgaaaaccagattatcgacctgaatatttcgaatgcatcaggtttcaccagccgtaaagtgaacggtaaccaatataccaccaacggatgggaaatcatggccaatgtacaggctatcaaaaataaagattttcaatgggatttctccttgaactggagtaagagtgtaaaaaaattgacggaaatatatggcggacagaaaaagttcggtgacctgaaagtgggcgaccgtgccgatgcattttacggttcacaatggcagaaaagtgctgatggagaattgattctggatgaaaacggtatgcctactaaagacgcatataaacaatatctgggacatctggatccgaacttccgaatgggtatgcaaaatactttccgctacaaagacttcacactgtctgtcgatctggacggcgcttataaaggagtaatctattctgtattgagcgaaaagttatggtggggaggaaagcatccggaatcagtggagtacagggatgcacaatatgccgtcggacacccgatatatgtacccaatggggtagtcgtaaccggaggagagctgaaacgtgacatcgacggtaatgtaatctctgacacacgcacctacaaacgtaacacgacagcggtcgattggcaacaatggtgccagaactatccttatcaagcttatgtatcttcgaaagaaaatgccaaatttgccaatgtattcgaccgtagctacattaagctccgccgagtggcactgacttacaacttcaccaaactactttcgaaacaaagccccgtgaaaggacttacagctacagtgtttggcaacaacctagctgtctggaaaaaagtcccctttgtcgatccggactacaccggagacagcaacgacggaggtgccaacgatccaaccgcacgctatatcggcatgggcgtcaacataaaattctaa

SEQ ID NO: 747 - DNA, 1251 bp, B.fragilis
ccgtatattatagaaatgtctacctacgcaccctttgccaagccgctatacgtaatgctcaagcccgtaggggctgtatgcaaccttgcatgtgattattgttattatctggaaaagtcccggctttatcaagaaaatcccaaacatgtgatgagcgatgaactgcttgaaaagtttatcgagcaatacatcaattcgcaaaccatgccgcaagtactcttcacctggcacggaggagagacattgatgcgtccactctctttctacaaaaaagcaatggagttgcagaagaaatatgcccgtggaagaagcatagacaactgcatacagactaacggaaccctgttgaccgacgagtggtgtgagttttttcgtgaaaacaactggctggtaggagtctcgatagacggtcctcaagagtttcatgatgaataccggaaaaacaagcttggcaaaccctcgtttgtgaaagtcacgaatggcatcaatcttttgaaaaagcatggagtagaatggaatgccatggcggtagtgaatgactttaatgctgattatccgttggacttttatcactttttcaaagaattaggttgccattatattcagttcgctcccattgtggaacggatcttcccgcatcaggacggacgtcatctggcctcactggcacagcgcgaaggaggagaactggcagaattttccgtaacaccggagcaatggggaaactttctctgtacactcttcgatgaatgggtgaaagaagatgtaggcgactattatatccaactcttcgattctacccttgccaactgggtaggcgaacaaccgggagtatgctccatggcaaaaacatgcggacacgccggcgtaatggaattcaacggagacgtctactcatgtgaccatttcgtgtttccggaattcaaactgggcaacatttacaatcaaactttggtagagatgatgtatagtgaacgccagactgctttcggacaaatgaaacaaaagtcacttcccacccagtgcaaagagtgcgaatttttatttgcctgcaatggtgaatgccccaaaaatcgtttttgtcgcacagcaaatggtgaaccgggactaaactatctgtgcaaaggatatcatcaatttttcaagcatgtggctccttatatggatttcatgaaaaacgaattgatgaaccagcggccgccggccaatgtgatggacgctatcaaagaaaacaaattgatcatagattaa

SEQ ID NO: 748 - DNA, 615 bp, B.fragilis
aaagagattatggtaataaagaaagcggtttatgtatgggtgatcgggatactgggaatgatttcattcgcagcttgttcatctgcttctcaaggagaagtcccttcgacatccaatgctgcgttggataatatttttgcacgtaaaagtgtgcgggcttatttagacaaggaagtagaaaaagaaaaaatagattggatgctacgtgccggtatggctgcaccatccggaaaagatattcgtccgtgggagtttgtattggtcaccgaccgggttgctcttgattcgatggccgctgctttaccttatgcaaagatgctgactcaagctcgctatgccattgttgtatgtggagatgtagctcaatcttcctattggtatctggattgttcggctgctgcacagaatatattattggctgccgaagcacaggggctgggtgcggtatggacagctgcttatccttatgaagaccgtatcagggttgttcgtaaatatacggagcttccggggaatatagtgcccctgtgtgtgattccgtttggttatccggcaactgcccaagagcctaaacagaaatttgatgagaaaaaaattcattacgataagttttaa

SEQ ID NO: 749 - DNA, 849 bp, B.fragilis
aaagtaactattatgacagcaaacgaagtccatttgatttatttctcgcctacccacacctctaaacaagttggagaggcaattgttcgtggaaccggaataacaaatgtgataaacacgaatttaacacaacaggcaactcaggatttagtgattgccgaatctgcattagctattattgtcgtgccggtatatggaggtcgtgtagcccctttggccatggatcgtctggcaagtgtgcgcggaagtaatactccggcggttatcgtggtggtatacggtaaccgtgcttacgaaaaatcgttgatggaacttgattattgggctattcaacaggggtttaaagtgattgccggtgctactttcataggagaacactcttatagtacagaaaaatatcccgtagctgccggacgtcctgacgaacgtgaccttgctgtggcagccgattttggaaagcagatttcagataaaatagcatctgctaccgaaccggaaaaattatatgcggtcgatgtccgtaaaatccggcgtccgcgtcagcctttttttccattgtttcgctttttgcggaaagtgattgccttgcgtaaaagtggagttccccttccccgtactccttgggtggaagatgaatctttgtgtactcactgcggtacgtgtgcgaaaatgtgtcctgtaagcgccatagccaaaggtgacgagttgaatacggatgccgaacgctgcattaaatgttgtgcctgtgtaaagggatgcccacagaaagccagagtatatgataccccgtttgccgtactactgtcgcaatgttttgttaagcagaaagatccctgtacgttggtttaa

SEQ ID NO: 750 - DNA, 906 bp, B.fragilis
aatgtatatatatatatgaagaaagaggtttggataaaactggtgaaacgaatcggaaactggattgtgaatatctgtttctattcttgtgtggcttttgttgcctggatggtattgcaggtgttttgcctgacttctttcaaaattccctccaattcaatggaaccggcattgctttcgggagacaaaatactggtggataaatggaccggtggggcacgtctgtttaatatctttgcgtcattgcgaggagaagaagtggatatctatcgtctaccgggtttcggatcgtttcagcgggacgatgtgcttgtttttaatttcccttatcaggatgggagcgacagcatcggatttgatataatgaagtattatgtgaaacggtgtattgccttgccgggtgatactttggaaatacgtaagggctattatcatataaaaggaatcacagacagtgtggggaatgtgcaggcgcaacatcggattgcacgtgtcagaagggaagattcacatgggatcgtgatggatgcttttccgtgggacggacgtctgggatggaccattcaggaattcggacctcttccggtaccggccaaagggcaggtggtgaaaatagatacattgtcttgtttgctttacggaagattgatccattgggagcagaagaagagactgcggcaaaaaggagaggcggtatgtctgggcgatagtgcaataacggaatataagttcacagagaattactatttcgtatcgggagataatatggaaaattccaaggattcacgttattggggaatgttgcccgaatcatatattgtaggtagggcatttacaatatggcggtcggacgatcctttacgtggaaagattcgttggaaccgggtatttaaaagaataaaatga

SEQ ID NO: 751 - DNA, 1278 bp, B.fragilis
  unsure (524),(1246),(1269),(1270),(1271): Identity of nucleotide sequences at the above locations are unknown.
ttcaaagatatgttcgacaatttaagcgaaagactcgaaaggtcgtttaagattctgaaaggtgaaggcaaaatcaccgagatcaacgtagcagaaaccctgaaagacgtgcgcaaggcactgctcgatgccgacgttaactataaagtagccaaaggattcactgatacggtgaaggaaaaggcactgggacagaacgtgctcacagccgtaaaaccgagccagttgatggtgaagattgttcatgacgaactgacccagctgatgggtggagaaactgtcgaaatcgacaccaaaggtcagccggcagtcatcctgatgtccggtttgcaaggttcgggtaagaccactttctcgggtaagctggcccgcatgctgaaaaccaagaagaacaaacgcccgttgctcgttgcatgtgacgtttaccgtccggcagctatcgagcagcttcgcgtattggccgaacagattgacgtaccgatgtactcggagatcgacagcaaagatccggtttccatcgccangaatgccatcaaagaagcacgtgccaagggatacgatctggtaattgtcgatacggccggacgtctggcagtcgacgaacagatgatgaatgagatcgctgccatcaaagaagccatccagcccaacgaaattctgttcgtggtagactctatgaccggacaagatgcggtcaacacagccaaagagttcaacgaacgcctcgactttgacggcgtggtgctgaccaagctcgacggtgatacccgcggtggtgcggccctctctatccgttcggtagtgaacaaacctatcaagtttgtaggtacgggcgagaaactcgatgccatcgaccagttccaccctgcccgtatggccgaccgtatcctgggtatgggtgacatcgtttcgttggtggaacgcgcacaggaacaatatgacgaagaagaagctaaacgcctccaaaagaagattgccaagaaccagttcgacttcaacgacttcctcagccagatgtcccagattaagaaaatgggtaatctgaaagagctcgcttcaatgattccgggtgtgggcaaggccatcaaagatatcgatatcgacgacaacgctttcaaaagcatcgaagccatcatctactccatgactccggaggaacgcagcaatccgggcatcctgaacggttcgcgccgtacacgtatcgccaaaggtagcggtacgactagtcttcaccgcgggttccagnggcgctctattggcatcagtttnnnagatcac

SEQ ID NO: 752 - DNA, 651 bp, B.fragilis
aaaagatacataattatgaaaaagttacagtttttagtgtgtttcctgcttttgtcggtggcaagttatgctgccgagcggacgattcagttacctaagcccgacatgaatcgtgccggactgctaatgaaagcgttatccgaacgtcattctactcgtgaatatgcttcgaaggctttgagtaataccgatttatccgatttactctgggctgccaatggcattaaccggtcatctgaaggcaaacgtacagctccgtcagccatgaatcgtcaggatatcgacatatatgtggtgcttccgcaaggaacttacctgtatgatgctaaagggcataagctcaatctgatttctgagggagatcaccgttctgcggttgctggcggtcaggcctttgtcaacaatgcgccggtatcgttggtgctggtcagtgatctgtctaagctgggtgatgcgaagagtaatcatgttcaattgatgggagctatggatgcagggattgtttcgcaaaacatctcgttgttctgttcggctgcacgtctggccacagtcccgcgtgcatcgatggatctggtacggctcaaagctgctttgaaattaaaggatactcaaatgccgatgatgaatcatccggttggatattttaaatga

SEQ ID NO: 753 - DNA, 600 bp, B.fragilis
aggaatttaatacgtacatattattgtcataagaaacggcatacgaaagcaattttgtatgcccgttttctgtttaatcaaaaaaatattcgtattttgtttgcgaaaataaaaagaactctttatctttgcatcagatttaaaatggtaatgaatacatttttggaaagaagaaagaaaatggaatcatacaaccgattactagagcacaacatcaaaccgtccatgcagcgaattgctatcatgaattatttgatggaacataagacacacccatcggctgatgaaatatatacggagttatcttcctctatgccaacactttcaaagactacagtctataataccttgaggctgttttctgagcagggagcggcacaaatgcttactattgacgagcggaacaccaattttgatgcggacacttcacaacatgcccattttctgtgcaagcgttgcgggcgtatttatgatttgaaatgccaggttgagatgaaacaagtggaaggtcttcaaatggatggacatgaagtaagcgaagtgcactactattataaaggtgtttgtaagaaatgtttaaataatatacgtattgactaa

SEQ ID NO: 754 - DNA, 1023 bp, B.fragilis
acaaagttaatgaaacaaatcaatgcagtaattacaggagttggaggatatgtgcccgattatatcctgactaatgatgagatatccagaattgtagataccaccgatgaatggatcatgggacgtatcggaatcaaagaaagacgcatcctgaatgaagaaggactcggcacctcatacatggcacgaaaagctgtcaaacaactgatgcaacgtactcaaagtaatccggatgatattgacctggtaattgtagctaccaccactcccgattatcggcttccttcaacggcttccattttatgcgaaagagtggggttgaaaaatgcatttgccttcgacatgcaagcggtctgcagcggtttcttatatgcattagaaaccggggctaactttatccgttcgggaaaatacaaaaaagtcattattgttggtgccgataaaatgtcgtctgtgatagactataccgatcgtgccacctgtcctattttcgctgatggtgcagcagctttcttgttggaacccacaacagatcatttaggagttatcgattccgttttaagaacagacggcaaaggacttccttttttacacatgaaagccggtggttcagtttgttccccttcttattttacagttgacaaccacatgcattaccttcaccaagaaggacgtacagtatttaaatatgctgtagccaatatgtcagatgcatgtgagtcgatcatcgaaagaaaccaactgacaaaagatgaaatagactgggtcgttcctcaccaggccaatcaacgtatcatcagtgctgttgcccaacgtctggatgtaccattagaaaaggttatgatcaatatcgaacactacggcaataccagtgcaggtacgcttccattatgcatttgggatttcgaaaataaactcaaaaaaggtgataatttgattttcaccgctttcggagccggatttgcctggggagctgtttacgttaaatggggatatgatggcaagacaaataacgcatgttag

SEQ ID NO: 755 - DNA, 864 bp, B.fragilis
gatattgtaattatgttaagaatcgcagtacaagccaaagggcgtctttttgaagaaacgatggcccttcttgaagaatcagacatcaaactgagcacaaccaaacgtactttactcgtacaatcgtccaactttccggttgaggtactttttctccgtgacgatgatattccccaatctgtagctacaggagttgccgacttgggtatagtaggagaaaacgaatttgtagagaggcaggaagatgccgaaatcattaagcgtctcgggttcagcaaatgccgtttgtctttggctatgcccaaagacattgaatatcccggtttgagttggtttaacggaaagaagatagctacttcctatcccggaattttagatgcttttatgaaaagtaacggggtgaaggctgaagtgcatgtcattaccggttctgtagaagttgctcccggcatcggattggcggatgctattttcgatattgtcagttccggttctactctagtcagcaatcgcctgaaagaagtggaggtcgtaatgagatcagaagctttgctgataggcaacaagaatatgagtaaggagaaaaaagagatattggacgaattgcttttccgcatggatgctgtgaaaactgctgaagataaaaagtacgtactgatgaatgctcctaaagataaactggaagatattattgctgtgctaccgggtatgaagagtcctactgtgatgccgttggcacaagatggttggtgctctgtacatacagtgctcgatgagaaacggttttgggagatcataggtaagctgaaagcgctgggagcggaaggtattttggtgttgcctattgagaagatgattatatag

SEQ ID NO: 756 - DNA, 462 bp, B.fragilis
gaaaataaaatgaaactggctcctataaatataaagaataaacgtgctactttcgactatgagttgatcgatacttatacagcaggtattgtgttgaccgggacggagattaagtccatccgtctgggtaaggcaagcttggtagatacgttttgctattttgcgaaaggcgagttgtgggtgaagaatatgcacattgccgaatatttttatggctcgtataataatcatgcggcccgacgtgaccgtaagttgctattgagcaaaaaggagctgaataaattggaaagagggacgaaagacgccggattcaccattgtccctgtgcgtttgtttattaatgaaagaggtttggccaaagtggttgtagctttggctaaaggtaaaaagcaatatgataaacgggaggctttgaaagaaaaagacgaccgtcgtgatatggacaggatgtttaaacgatga

SEQ ID NO: 757 - DNA, 477 bp, B.fragilis
aaacaaagaatgaagaaagtattatcattagtagctttggccatgatcagcaccattatgtttgctgtaaacgatggagtcaaagcagatcaaaacaaaaaagaggcaaagagcggtgaggttatcgtgatgaataaagagatgtttatcaacgatgtctttgattaccagaattcaaaagagtggaaatataaaggtgataaacctgccattatcgacctgtatgcagattggtgcggtccctgccgcatgacagccccgattatgaaatcgcttgctaaagaatatgacggaaaaatcgtaatatataaggtgaacgtggataaagaaaaggaactggctgcactattcaatgcaacaagtattcccctctttgtatttatcccaatggagggcgaaccccaactgtttcgtggagcagcagataaagccacttataaaaaagcaatcgacgagttcctgttgaaacagaaatag

SEQ ID NO: 758 - DNA, 579 bp, B.fragilis
tttaccccgattatgaaatggatgattttgatttttttgaattttttgttttgtgcccaacttgttgggcaagtatcacgacccgatagaaaccttttgcgtggtgagacgtatgtgattgaggtgccgaaaggatggaaacgtccttctgctgtgcattcttgcaatgatgaacctttgaaacgcgttaatgggaaatacgaaactacaaagtttatgagagtatattcaaaacgtaaagatcgttgtggtgcggtattgaccattatggaaatacaaaaatgtgcatcttttcaggaaatatttaaggaagacagtatttgggcatcgacggatactacgcaggtgaaggtgatatataagtctgtcaatagtaagaatggggttaaaaagatggcttttacttcgtataaggcagagcgtcatccggaaactaacgaattatctgctttgcaaaaggctgaatggtatttgcaggggcgtgaaaatgtatattatatcagttttacgtcttgctcattgtttttagaactgctaccgcagattaaagatattgtggcgtcgttaaaggaactttaa

SEQ ID NO: 759 - DNA, 1458 bp, B.fragilis
atgcattggataatggaaaatggtgtaatgatgcagtattttgaatggaatctgccaaatgacggaaatttatggaaacaattaaaagaagatgcgtcacatttacatgagattggtgtgacagcagtatggattccccccgcttacaaagccgacgaacaacaagacgaaggttatgcaacctacgatttgtatgatctcggcgagttcgatcaaaaaggaaccgtaagaacgaaatatggtacgaaagaagaactgaaagaaatgatcgatgaattacataaaaatcatatttccgtttatctggatgtagtactgaatcataaggcaggaggtgatttcactgaaaagttcatagttgtagaagtcgatcccaatgatagaacccaagcattaggaaaaccgttcgaaatacagggctggaccggatacagcttccatggacgtaaggataaatattcagacttcaaatggcattggtatcatttttcaggaaccggttttgacgatgccaaaaagcggagtggcatcttccagatacagggtgaaggcaaagcgtggagcgaaggggttgacaatgaaaatggcaactacgatttcttattatgcaatgatatagacctggatcatcctgaagtagtcaccgaattgaatcgttggggaaaatgggtttccaaagagctgaacctcgacggaatgcgtctggatgccatcaaacacatgaaagacaagttcattgcacaattcctggatgcggtaagaagcgaaagaggagacaaattctacgctgttggcgaatattggaatggtgatttgaacacactcgatgcatacataaaatccgtgggtcacaaagtcaacctatttgatgttccattacattataatttattccaagcatcacaagaaggcaagaattatgatctgcagaatatcctaaaaaacacattagtcgagcactactgtgatctggcagtcacttttgtcgacaatcacgattcgcaatcaggcagttccttggaatcacaaatagaagactggttcaaaccattggcctatggtctgatattattaatgaaagacggttatccttgtttgttctacggagattattatggtgtcaaaggagaaaactcacctcatacccaaatcattaatattcttctggataccagaagaaaatatgcttatggcgatcagattgagtatttcgatcatccttccgccatcggctttattcgtacgggagatgaagaacatgtcggttccggtttagtctttttaatgtctaatgatgaagccggcagtaaaaagatggatttgggcgaagaacataaaggtgaaatatggcatgaaataaccggaaatattcagcaagaaatcacattagacgaaaaaggaagtggagaattttctgttaatacccgtaatattgctgtttggataaaaaagaattaa

SEQ ID NO: 760 - DNA, 477 bp, B.fragilis
atgcataacttttgtttttttcgttacgcaaagatcccgtttccggattacaggaggatgaatgtaaggttactatatgatgaacaaaatcgggacttctctgttattataataaaacaaataactatatttgccccctgtaaacgagggctctatatttatcaaaagaaaggaaaaattatggaaaaatttgaagatttaatacagtcacaaagtcccgttttagtagattttttcgcagaatggtgcggcccctgtaaagcaatgaaaccgattcttgaggatctgaaacagcaggtaggcgagaaagcccgtattgtaaaaatcgatgtggacacacacgaagaactagctgtaaaatacagaattcaggctgtgccgacttttatccttttcaaaaagggagaagctgtctggcgccattccggtatgattcaagccagcgaactgaaaggagttattgaacaatacacataa

SEQ ID NO: 761 - DNA, 1014 bp, B.fragilis
ataatgaatgttagatgttttttatgggggattttgtttataactgtatcaagttgtatagaatctgataggattatgcattatgctcaatttgagcataccataaatttgaaatccgatagaatacaggttccttcggtgttattgtatccacggagtttagttttatgtgatagtaatctgatagtattcaatgaaaaaatggatactatgtttcaatgcttccatttgccggatttgacttttcaatatggttttggaacacaggggcagggaccgaatgatttcgttctcccttctattacccctgtgaaatatcaaaagaacggttttgtcatgttagacggaattaacctgaaacatattagtgtcaagaaagacaaagctatcgtacagacttcgactttaaattatggatttaattgttttaatgacttgataagtatttccgatagcagttattgttgtaatggaggttttgagaatgaaaaagaatttaggtttctttatcctgacggaaatcatgaatcatggggagaatatcctgaaacagaggaacgtttcggatctgttttggacaggaatcaggcgtatataaagatgaccgtcgctaagcctgataagagttgttttgtttcgttctaccaacatatacgccgtttcagaatttatggtaaagatggagaattaaaaagagatgttattttagatattcttcccgggcaagaacgtcctgaagtggatgattatttgagattcatacatcctataagtgtctatgcaacggacagttatatttatacattaaatctggatatgacaacagaggaaattgagaatcggaaaactactcctaacatccaagtattcgattgggaaggaaagccacttacacaatataaactcgattgttttattaacacttttgtcgttgatgaagttgcaaataagatttatggagcttttgttgaagacgaagatcatatttatgtatttaatttaccccgattatga

SEQ ID NO: 762 - DNA, 1050 bp, B.fragilis
aaaggatgtgtcagttgtaatatttgtgacacatctttttgtaactttattaaagttatgcataagataattctatatattatttctgttttaacagtgtttacttcttgcacaactactgatgtacctgataaggtgagtttacaaccccaggtaatgaatgatagtcttttgacaactatgcctggtgatttattgctgattgacgattatttagtttggtctgatcctttctctgataacaaatttctgcatgtacatcgttcttccgatggaaaatatatcggttctatggggcaaaaaggagaaggtccacaggaatttgtaagtcctttaatcaatcgtttttccattaatcgctgtattgctgctcatgatgctaacgggaaaaccagaggctatttatctattgacagtttaattgtcggaaaagaaccttttatgtctttatcagattttgatcggaatatacgaatggctaaattggacgaacaactgtatctgactgaaaccgaaaatggtgagaacgattattttaaagtgagttcaaatgggaaaaaatctacatttggggtttatccgattcgtgaagtgaaacaccatatgggtacatataaaacttacgataaagatcgtggactccttgcttttggtccttttaatttttcttatttggctttgtataaaaaggaaggggataattttaagttattatgggaacgcatgcctgaaaaagaaaactattctgttgttgatggggcgattaggtttgatcgtagcgtgatgggagtgagagatatatgcatgactaaagattatattgttactctggagcgtgaccgggaagttgatccgttggatgaaaggactgtcggacgtaatgcaagtaaatgtccccgtacggtttttgtgtatgattatgatggtaaattactgaaaattgtaaatttgggcatgcctgtaatgcgcattgctgctgacggacgaagtaatgctctgtatgtgataggagttaatcctgattttgcattggcgaaatatgatttatag

SEQ ID NO: 763 - DNA, 1797 bp, B.fragilis
gtttttttcgtatttttgcgaaaaaacttaatgaaaatgaacacgcactcactatttggttacctttttattgctttatttagtcttttagttgtatcatgttattcgacgccggatggagtcatgtcatctctgtctcaagctgagaaaataatggaatctcgcccggatagtgcaatggctattttgcaacatatcccaactccggaaactcttcatggtaaagcgcaggcggactatagcctattgatgacacaggctatggataaaaactacataaattttacttcagattcgctgattaaatttgctgttggttattatggaggccatactgaagatcttgtagctaaaggaaaatctttttattattatggaagggtgatggaaagccttgataaagtagaggatgcaatgacgttttatttaaaggcgaaagatgtacttcaaagcagtgatcagtttaaattattgggactaatatcagagggaataggaactcttaataggaaacagaaattatttgatactgcattaaatagctataaggagtctttaacttattattctctagtaccagactctctctgtatgacatatgctaataggaatattggtagagtgtttttatataaaaataggcttgatagcgcctactattattatgataaagcaatttatatttctaatgcaaataaatatgtagctgtagggtcgttgttattggaattaggagtgattcatcgttcagaaaaagattacattggtgctgaacgatattttttgacatttcttgagaaagaaaaaactccaaataaattgtattctgggtatttggcattaggaaatttgtatttatacatgaatcgttttgaagatgcagaacattttcttatgttatgtttggatagccctgatccagttgttaagagagatgcgtgtgagtgtttatatgatttagagaaagaatcaaataaatttaaagaagctgtgatctataaagatatagcggattccttacgaatgatgacacaagatattgatactcaaaatgccatagcagatttgcagggtagatataataacgaaaaatggcagagggaaagtctacaatccagtattgagaagaagaatattcttttaataagttcgtttgtgggttttattgcagtaatggttattatttatatttattataaatatagaaccaatcaaaaactggttaaggatatcaatgaaagaattcgtaaaaatgatgttgacataaagatgtatcaaaggcaaatactcaattatcaagatttgcaaaaggaaacattgcaggattatcgaaatcagataggagaattgcatgggaaaatgtctgtccttgaagatcagaataaagcattatctcttcgtttaacagagaagaagcatgatataccggaaagtgaagccgatgatctctatgctatttatatgcaagcacttcatatactaataatgttaagagggaaaaatatagagaatacttcaggtcagaaattgcttttggatgccgattgggataagttatttcatctatctaatgctatacatggtgattttattacgcgtattaagaatgattttcctactcttaccaaacatgatattgaaatttgctgtctattaagatttggtattgaacatgaggtcttaggaagtatttttctgacggagactgattcagtgacaaaagctaaaagacgtatgaaaaaacgactgaatctatctgcttcggatgatttggacgtttttttgctaaaatattag

SEQ ID NO: 764 - DNA, 312 bp, B.fragilis
aataacaacgtaatggtaaaacacattgtattatttaagttaagagacgacgttcctgtagaagagaaactcgttgtgatgaatagttttaaggaggctattgaagcattacctgctaaaatctctgtgatccgcaaaattgaagtcggattgaatatgaatccgggagaaacctggaatattgcgttgtatagtgaatttgataatctggatgatgtgaagttctatgctacccatcccgagcatgtggctgccggtaagattttggcagagacaaaagaaagtcgggcttgtgtagattatgaattttag

SEQ ID NO: 765 - DNA, 213 bp, B.fragilis
agaaatgtatttggtagaggattttatataggacaagagtttatagcatatcagatgctgaaactgagaaaaaacttcattgataatcaaaagagacagggtacgccgtttgaacggaagtgtaccctgtctttttattattcttctacaatatccagctccttgatgatgtgtgaggcacctgcatacttatcaataataaatagagtatag

SEQ ID NO: 766 - DNA, 864 bp, B.fragilis
gtctctgcatttacttattgtgaattagaatttatatctttgcaaactctaaaaaatagatttatgaaacaattgaaattaatggtgttgaccttaaccctgttgatgggtactatgtttacttcatgtatggattccggagaaagcggtcctcagcagtgggccggtgtggtgaaagtgaatgatagaatgggttatgttacattcacagatgctgccggtacagagctgatccctactaacacgattcctgtaactttgaatgcaagaatggcttacatttattgccaggttgatgaaggtcaggacctctcaacaaatcctaagtcaattaaaattacacttttagcagatcctacaggaattgatgctacagcaataaccactccgaaagtagaatcaagtgatgtgactactaatgcacctgttggttcgttgagttttgcatcaggatattcaactgtggccccatttcagtttagtgaaaatacgattgtattaccagtactttatcgtgtgaaaaatgtgactactacagaagatattaaaaatgagcttgctaaacatacttttactcttgtctgctatacagatgatattaaatctggtgataccattttgaaactttatttacgctataaagttgaggatgaacctgctgctattgctgagcgtgcaacacgtacttccagctttaaggcttatgaaatcagccaaatcttaagagaatatactctgaagagtggacaaactaaacctgctaaaataactatagtagcacagcaaaatgagtacaacaataagttggaagatacttctactatagagaaggtatatgaaatagaatataaaactgcggaataa

SEQ ID NO: 767 - DNA, 393 bp, B.fragilis
aatatgaaattgcgtgttattttatcgttaattgtggtattgttcattggacagtccatgtgtgctatgtcaactcaaattcttcgtagacccattattttagatggtgaaattattgaagaagaagcgagtcgttccatcaacccgttgattcctatttctgcagatattgatggcactactttatttattgaatttacaaaggttataggtaatgtggatattacagtgaaagatgataccaaaaaagaagtttattcatcttctgtggatgtaactgctgctaatcaagctacttcgttctctattgccgatttagcaccgggaacttacctgcttgaatttaccaattcgaatggcggttatgtatatggacaatttattgtagaataa

SEQ ID NO: 768 - DNA, 714 bp, B.fragilis
  unsure (613): Identity of nucleotide sequences at the above locations are unknown.
atgatggcttcgatgcttttgaaagcgttgtcgtcgatatcgatatctttgatggccttgcccacacccggaatcattgaagcgagctctttcagattacccattttcttaatctgggacatctggctgaggaagtcgttgaagtcgaactggttcttggcaatcttcttttggaggcgtttagcttcttcttcgtcatattgttcctgtgcgcgttccaccaacgaaacgatgtcacccatacccaggatacggtcggccatacgggcagggtggaactggtcgatggcatcgagtttctcgcccgtacctacaaacttgataggtttgttcactaccgaacggatagagagggccgcaccaccgcgggtatcaccgtcgagcttggtcagcaccacgccgtcaaagtcgaggcgttcgttgaactctttggctgtgttgaccgcatcttgtccggtcatagagtctaccacgaacagaatttcgttgggctggatggcttctttgatggcagcgatctcattcatcatctgttcgtcgactgccagacgtccggccgtatcgacaattaccagatcgtatcccttggcacgtgcttctttgatggcattcntggcgatggaaaccggatctttgctgtcgatctccgagtacatcggtacgtcaatctgttcggccaatacgcgaagctgctcgatagctgccggacggtaa

SEQ ID NO: 769 - DNA, 237 bp, B.fragilis
tgcggttttccgggtgttttctttttgttggcaaagaagaagtgttttgtgtttaaaagacttgttctttgcaaacaaaacacttgttttaacactctgttaaatcaagcattttatatactgaaagtgaagtcgtttaagttgttgatacagagtggatcgttgttgtttctagtttttctgctatcctgcttgtccgggtgtgatgatagatggtatttatcaaaaccacaatga

SEQ ID NO: 770 - DNA, 1149 bp, B.fragilis
tattcatcgttaaataaacgaattatgataaagagaataaagatattagctacaggtgcactgctattggcaggattgggtgcttgttcaccttccggaaagaaaacaggagcggattcgactgtcgacactctgcgaacggcggaaacagtgaatttactgaataatctacggaaggttcccacacaggggattatgtttggtcatcatgacgatccgctttacggtgtcggctgggaaggtgacgaagatcgcagtgacgtgaaaagtgtgtgtggtgattatccggctgtcatgtcgtttgatctgggccacattgaactggaaagagagaaaagtctggataacgtgccgtttcgcaaaatacgtcaggagacgattaatcaatataaaaggggaggagtggtttcttttagctggcatctcgataaccccttgaccggtaaagatgcgtgggatgtgagtgatacgacggttgtagcttccatactgcccggtggtgtacatcatgcgaaatttataagttggctcgatgctgttgcagcctttatgaatactttggagacggaagaaggtacaaaaataccggttattttccgtccctggcacgagcataccggcagttggttctggtggggacaaaatctttgcacggccgaccagtataaggctctttggcggatgacgcatgatcgtatgcatgcccggggagtaaagaacctgctttatgcttattcaccgggatcggaacccaaagattcgactgcttatctggagcgttatccgggagatgatatcatcgatctggtgggctttgacacctatcagttcgaccggacacaatatatggagcaattggataagtcgcttgctatcctgactgaagtaggtaaggcgcacgataagcctatagccattaccgaaaccggtttcgaggctattcccgattctgtctggtggacacagactctctatccggtaatcagcaagtatcctatcagttatgtgttggtgtggcgcaatgcacgtgaaagggtaaaccactattatgctccttatcccggacaggtgtccgccgatgactttgtgaagttctaccgtgaaccgaaaactctgtttgtgtcggacgtgaagaacctttataaatag

SEQ ID NO: 771 - DNA, 1560 bp, B.fragilis
tctcaaagacctttggctacaatcgtggaccgacctgatcatctatctgatagtcctgtttgccgccgccgaatgtctgttcagtacgtttgcacgcatccgtgcggtcggagagcaaaaacagccccgttggctgacttctatctccctgctgatttacggaatccttttcctcggaactctattttttatcggagatttcttaataaacaagttatgacaaagaaaaatctactcaaaggaatctgcctgctatggctattgctggcagtaactcctgtattgcaagcccaggatcgtgcgcaacaggcatccgaacttctcgaccgactgattgcaggccaaggagacagtgtgtatgtacatctggacgataacatccggaaaatgctttccgtagagatgttgaacggactgttcaagcaattggaacaacaagcaggtaagtatcagtcgcatggagagtggaacaccgaaccaataaacggaatgactatttattattgcgacgttaagttcgaacgcttaccattgcgttttctcacagcgttcaatccggacggaaaggtgaataccattcgtttcgtacctgttccggctgaaaagaccactcccccgacgacatcggtacaagataaaataaaagagacagacatacaggtttgtacggggaatttcaagcttcccggcacactgactcttcctaaaaacggcaaagatctgccggtagtcattttggtacatggctcgggggccagcgaccgggacgaaacggtaggggccaataaaccttttcgggacctcgcgtatggactggccgagcgtggaatagccgtgatccgttatgacaagcgtaccaaagtatatggagccgacagcgcacctgcaggcaaagaaattactttcgatgaagaatcagtggatgacgccctttcggcaattaaacttgcccgttccataccgacaataaatcccgaacggatctacattctcggacatagcctgggaggcaccttggctccccgcatcgcccaacgtagcgataaagttccggcagggattattctgcttgccggtgcagcccgtccactcgaagatctgtttataagtcaggtgaagtttctcgcctctgcactcccatcggctaaagatattgaaaaggaaatagccgaattacagaaacaagtggacaacgtgaaaaggctgggtacagacacattcgacattacaactcctttgcccatgaatctctctcaagcttactggatgcttgccaatcaatataaacctttggaagtggtccgaaaactgactctccccatacttgtccttcaaggcgaacgtgattatcaggtcaccatgcaagatttcgaattatggcaatccgccctggcaaagcatccgaatgcgatatttaaatcttatccccgactcaatcatctgtttcaggaaggagaagggaagtcaacccctcttgaatacagccgtccctcctctattccttcttacgtgacggatgacatcgcagctttcatcaaccgacccaagcccggtaactga

SEQ ID NO: 772 - DNA, 1569 bp, B.fragilis
tatataattacgatgaataagaaaataattatccccctcgcactggctccattggctgccccggctctgcaagcccagcaccagcagccgaacggacgtacggacacacgccccaacatcattctcttcatggtagacgacatgggctggcaagatacatccctgcctttctggacccaaaagacacactacaacgaggtatacgaaactcctaatatggagcgccttgccaaacaaggtatgatgttcacccaagcctatgccagcagcatcagttcgcccacccgctgtagcctgattacaggaactaacgccgcgcgtcaccgggtgaccaactggacatatcccaaaggccagcaaacagaccgcccgagcgatgtattcaatgtagcggactggaatgtaaacggggtttgccaggttcccaatatcgaccacacgtttcaggcaacctcactggcagaaatcctgaaagacaatggctaccacacgattcattgtgggaaagcacatttcggcgccgtcaacactccgggagaaagtccttatcacatgggctttgaagtcaacatagccggacatgcaggaggcggattggcaagctacctgggtgaaaataattacggaaaccggacggacggtaaaccgaatccctggtttgccgttccgggattagagaaatactggggaaccgatactttcgtcagtgaagctctgacgctcgaagctatcaaagcactcgatcatgccaaagaatacaatcagcctttcttcctctacatggctcactacgctatccatgttccgatcgataaagacaaacgcttctatcaaaaatatatcaataaaggattgactcccaaagaagctgcttatgcggccctgatcgaaggtatggacaaaagtctgggtgacctgatggactggctggataaaaacggagaagcagacaataccatcgtcatctttatgagcgacaacggcggtctgtcgagcgaaccggaatggcgtgacggaaaactgcacacgcagaactctcctctcaacagtgggaaaggatcggcttacgaaggcggtgtacgcgaaccgatgatcgtccgctggccgggagttgtaaaaccggataccaaatgtgataaatatttaattatcgaggacttctatccgaccatactcgagatggcacaaatcaaacattataagacggtacagccgatcgatggaattagttttatgcctctgctgacacataccggtgatccgtccaaaggacgcagcctgcactggaacttccctaatcattggggaaacgacggtcccggcatcggcccgacctgtaccgtacgcaaaggtgactggaagttgatttactactatgacagcggtaaaaaagagttgttcaatattccggaagatataggagaaaagaatgacctggcagccctacatccggacattgtgaaaagtttatctaaagagctgggtgactatttgcgcaaagtaggcggccaacgcccttcattcaaagcaaccggaaagccatgcccatggccggacgaaatcaaataa

SEQ ID NO: 773 - DNA, 321 bp, B.fragilis
  unsure (304): Identity of nucleotide sequences at the above locations are unknown.
aaacgaattacgaatggatgctcctgtggaaagctgcatggctacccattcttaatcccccaatacgcaatagaaccgcaatttgcaatcacaatgaagataattattgctggtgccggagctgtaggcacccatttggctaaattactctcacgcgagaaacaggacatcatcctgatggacgatgacgaagagaaactaagtacgtttagttctaacttcgacctgatgactgttacggcctctccttcgtccatatcaggactgaaagaggtaggcatcaaagaggcagacctctttattngcggtcactcccgatga

SEQ ID NO: 774 - DNA, 1410 bp, B.fragilis
aataagaaaaccaagaatagaatgactgccatgattacactgaaagagaagatcggttacggactgggcgatatggcttcgtccatgttctggaaactgttcgggtcctatctgatgattttttataccgatgtattcggcttgcctgctgccgtggtaggaaccatgtttctgattacccgggtatgggattcggctttcgatccgatcgtgggagtgattgccgatcgcacacagacccgctgggggaaatttcgtccttatctgctgtatcttgccgttccttttgcactgattggtatttttactttcaccactccggagttgaatgataccggaaaactggtctatgcctacatcacctattctttgatgatgatggtatattcggctatcaatgtgccttatgcttcactgctgggagtgataagtcctgacccgaaagaacggaataccctgtccacttaccgtatgacttttgcctatatcggcagttttattgctttgctgctcttcatgccgatggtcaacctgtttggtggtgcagaagacgagcaacggggatggatgttgagtgtggtggtgattgctgtgatgtgtgcggctctgttttatctttgtttcgccttgacacgtgaacgggtaaaaccgatcagggaagtacaaaactccctgaaagacgatttgaaagatttgcttcacaaccgtccgtggtggattctgctcggagccggagtggcagctttggtattcaattctattcgtgacggagctacggtttattacttcaagtactttgttgtggaagaggattactccacggtttccttctttggcgtttcttttgtgctgagcggcctttatctggcagtgggacaggctgccaatattgtgggagtgattcttgcagctccggtcagtaaccgtattggcaaaaaaaacacatacatgggagccatgagtctggctactctcctttccgttatcttttattggtttgggaaaggagacatcaccctgatttttgtttttcaggtgctgatcagtatctgtgccggaagtattttccctttgctctggtccatgtacgccgactgtgctgactattcggaactgaagaccggcaaccgggctacaggtctgatcttttcgtcttcgtccatgagccagaagttcggttgggctatcggaagtgcactgaccggttggttgttggcttacttcggctttcgtgccaacgaagtgcagagtgtagaggctattcatgggattaagatgtttctcagctggttgcccgctgtcggaacagttctgtccgtcgttttcatcagtatgtatccgctgtcggagaagaagatgagagaggtgacttcagagttggagaagagaagaaaggctattcaatcataa

SEQ ID NO: 775 - DNA, 1995 bp, B.fragilis
aaagcaagaacaatgaaaaagaatctattatatatttttagtttagcaagtgttttatgctcttgcaatgactttctcgacaaagagccactagatgccgtacctaccgacaaatatcttttggcagaaagcgatttagcagcctattcggctaatctatatgatcaacttccatcccacactccaggccaatacagtatgggagtatttgcaacagacaataatagtgacaaccaagcagcaagtaatccaaacggttcatttgtaaagggagaaacacgtgtggctcaaagtggaggtgcttgggattttgggaaaatccggaatgtcaattatttcatcaataaggtacgtccccgactggaagccggcgaacttagtggagtagaagctaacaatatgcactatctgggagagatgtatttctttcgcgcttatatttactttactaaattagttgcactcggtgatttccctatcttaaaacattggatttcggaagattatgaaacagttagagaggcaagtaaacggcgcccacgcaatgaagtagcacgtttcatcatacaagatttagattctgcttactattatatgaaagcaaccccaccaatgagcaatcgcctaaccaaagactgtgctgccctcatgaaaagtcgtgtggcattatttgaaggtacttgggaaaaataccacaaagggaccgcacgtgtaccaggaggtccgggatggccaggagcaaacaaagattatttaaaggacttcactatcaatattgattctgaaattaaatacttcctgacagaagctaaaactgccgctcaaatagtagctgataaatacactttatttaacgattatccgtcgttattcaacagccaatcattagctaacgcttcggaagtgttattgtggagagcctacgacgccagtttaactccggcagtcaaccattttgttgtcggttacatccaacgcaatggaggtgggaataccggatggactcgtagtatgatgcaaagttatttgatggaaaatggcttgccaatatacgcaaacaattctggttatcaaggagataaaacttatgaagcagttgcaaccaatcgtgatccacgactgatttataatactttattacctggagatctcttatctgaaggaggaagtaacattgaatatctagtcaaaggatatggttattattatcgtgcaccaattgtacttggacaggacgaaaacaaatgtcccaccggctattcagtaaaaaagggattagcaacagatgccgcacaaggacctacactcccatcaactacagcctgtgtcatattccgtgcagcagaggcatacttgaattatatggaagctgattatgaactgaataactcgcttgatgccaacagttccaaatactggaaagctttacgaaatcgagcaggaatggataccgattttcaaaaaacaatagacgctacagatctgagtaaagagatcgattttgcccgctattcaggttctgaatttgtttcaaccactttgtataatattcgtcgggaacgtcgcatcgaatttgcggccgaaggattacgcctaaatgatctgaaacgctggcgtgcattagacatgatgcaaggttatcacgtagaaggattcgatttatggagtgaaaattatcaacgttacaaaactcctagcccaataccagttgcagacgtcactctctctgtcattaatctgattgaatcaggtaacaataatgctaatgtatcagctaaatcagaaagtcggtacttacgtccttaccggatcaatacaaacaacattgcatacaatggctataattggaaccaaaataaatatttaaatccaattgcttttgaccacttccgtctgacgacagcagaagaaggatcaaccgactatacaacctctacgatttatcaaaatccaggatggaagatagaaacgagcagtctccctgaaggagattag

SEQ ID NO: 776 - DNA, 651 bp, B.fragilis
atgataaaagctatgaacaacctcaatgaattatatgaagccattttggccggtaaattggaacaggcagtcagtgttacccgggaagctgttgccggaggagcagcaccccaggaaatcattaatgaatatatgattaaagccatggaagccattggagcacgttttgaatcgggacaagtgtttgttccgaacctcttgatgagtgcccgtgccatgcgtggtgccctcgatatactcaaaccactgatgcaagggcaggtcaattcgtatatcggtcggattgtgattggtacggtaaaaggggatttgcatgatataggtaaaaacttggttgcttcgatgtttgaaggatgtgggtttgaagtcatcaatctgggagtggatgtatcgagtgataaattcatttctgcggcattggaaaataaggcagatattatttgcatgtccgcactgctcaccactaccatgaattacatgaaggaagtgatcgatgcccttgaaacctccgggttgaggggaaaagtaaaagtaatggtaggaggagcacctgtcagcgatgcctttgccaaatctatcggtgccgatgcctataccagtaatgccaatgcagccgtaataatggccaagaagttgataaacgcctgttga

SEQ ID NO: 777 - DNA, 1914 bp, B.fragilis
attatggaatatacaattctgatccttcttctccccttcctctccttcctggcattagggataggaggcaagtggatgagccaccgaacagcgggcaccataggcacgctggtattggcagcagtgacagtactctcgtacgtcacggccgtacattacttctcggcaccccgtctggcagacggaacgtttgccacactcattccttataactttgaatggcttccgttcacggaaacactaacgttcaacctgggcattttgctcgaccccatctcggtgatgatgctgatcgtaatttctacagtcagcctgatggtacatatctactctttcggctatatgaaaggcgaacggggattccagcgctactacgcattcttatccttattcaccatgtctatgctcggactggtagtggcaaccaacattttccagatgtacttattctgggagttggtaggtgtatcttcttacctcctgatcggtttctactatacccgtccggctgctattgccgccagtaaaaaagcattcatcgtgactcgctttgccgacctgggcttcctgatcggtatcctgatatacggatactacggaggtactttcggatttacccccgacacagtttcaatgttgagcggtggcgccggtatgttgcctctggcactcgggctgatgtttgtcggtggtgccggcaagagtgccatgttcccgctgcatatctggttaccggatgccatggaaggtccgactcccgtcagtgcactgattcatgccgctaccatggtagtagccggcgtttacctggtggcacgcatgttcccgcttttcatcgaatatgctccggacgtactccacctgattggttgggtaggtgctttcaccgctttttatgctgccagcgtggcttgcgtgcagagtgacatcaagcgtgtacttgctttctcgaccatctcacaaatcggatttatgatcgtggcactgggtgtttgtacctcttccgatccgcatcacggagggttgggatacatggccggcatgttccaccttttcacacacgccatgttcaaggccttgctcttcctgggtgcaggcagcattatccatgccgttcactccaacgagatgtcggctatgggaggattacgcaaatacatgccgatcacgcatatcaccttcctgatagcttgtctcgccattgcaggtattcctccgttctcgggtttcttctccaaagatgaaattctggcagcttgcttccagtatagcccgacgatgggttgggtgatgaccgtcatcgcagctatgaccgccttttatatgttccgtctctactacggcatcttctggggtggcacagcaccggggcaaaagtcgacaagcgatggtacaagccacgtacatactccccacgaatctcccctgaccatgactgttccgttaatcttcctggccgccgtcacttgcgtggccggtttcattcctttcggacatttcatcagctccaacggtgaatcgtataccatccatcttgagacatcagtagccgtcacaagtgtagtgattgctgtggcgtccatcgtcctggccacttgcatgtacctgcgtcagcagcaacctctggcagataaacttgccaaacgttttgccggactgcaccgtgcagcctatcatcgtttctacatcgacgaggtgtatcagttcatcacacaccggattatcttccgttgtatctctacaccgatcgcctggttcgaccgccacgtggtagacggattcttcaacttcatagcctggggtacccatgctacaagcgatgagatacggggattgcaaagcggacgtgtacagcaatacgcttatgtattcctgctcggagcgctgatacttatcttaatattaatcttataa

SEQ ID NO: 778 - DNA, 1320 bp, B.fragilis
ataaaatatctgatgattatgaaaatcctatcgactatcctattaaccttgttgattgtgtttggggcgtgcacttctcctcaggtttctcctgatccctttgtccgtgtgtcaaacggacgtctgacggtgaatggaaacccctattattatataggaactaatttttggtatggagctattttggggtcacagggacagggaggtaaccgggagagattacttcgtgaactggattatttgaaggctcttggtattaacaatttgcgtgttcttgttggagcagacggaaaagatgggattccgacgaaagctgagcctgcacttcaggtggaagccggtgtgtataatgatactatttttgacgggctcgatttcttcctgtcggaagttgataaacgggatatgtatgccgtacttttcctgaataacagctgggagtggtcgggcggatattcccagtatctttattgggcgggacatggtgaagtgcctatgccgaatgtagccggatgggatgctttttcgaattatgtggcacaatatgctaagtcggaaaaagcacaccatttgttccgggatcatattactcacgttgtaaatcgtgtcaatcggtatactggaaaaaaatatagtgaagatcctgcaattatgtcttggcagataggtaatgaaccccgttcgttcggtgaggacaataaaaagagttttgcagcctggattgccgattgcgctgctcttattaaatctatggattctaaccatctggtttctattggatcggaaggaatggccggttgtgagggggatttgtcactttggacttctatccatgccgatgcgaatgttgattatactacgattcatatttggccgaataattggggatggatcgataagaaagatattccgggtaccatcgggcaggcaatagaaaacacctgctcttatatcgatatgcatgtgcaggaagcttttaagataaacaagccgctggtacttgaagagtttggtttaccgagagacagtgtgaagtttacttcgaatacttccactgttcagcgggatcggtattacagagctgtgtttgatatcgtcgaaaagcatgctgccgaaaagggtgttttccaaggatgtaacttctgggcatggggtggatttgcggaacctcaacatctcttttggcaaaggggagatgactatatgggagatcccgggcaggaggaacaagggctgaattcggtttatgcaacagattcgacgataaatatgataaaggaggcggtaagtgatattaaccagataattcagaaacaatga

SEQ ID NO: 779 - DNA, 1191 bp, B.fragilis
ttcagacatcatatggacgagattcttaaacaagaaatgcagaaagagcttactacccgtattcttccttactggatggaacggatggtagatcaggagaacggtggattttacggacgcatcaccggacaggaggaattaataccccgggccgataaaggggctattctgaatgcgcgtattttatggacctattctgctgcctatcgtctgctgggtagagaggagtacaaagagatggcaaaccgtgccaaacgataccttatcgaccacttttatgattccgagttcggaggggtctactggtcactcaattatagaggtgagccgctggataccaagaaacagatttatgccatcggctttgccatttacggactgagcgagttccatcgggctaccggagatccggaagcattgatgtatgccgtccgtttattcaatgatatagagtcccacagctttgatgggctgaagaacggttattgtgaagcgcttacccgtgaatggaacgaaatagccgatatgcgcctcagcgagaaagatgcgaatgaacgcaagaccatgaatacccatctgcatatcctcgaaccttacaccaacctgtaccgggtctggaaagatgcacggctggaacgtcagctctacaacctgataggactttttacagagaagatactggataaggacacatcccatttacaactctttttcgataacgactggcaaagcaaatacccggtcgtctcttatggacatgatatcgaagcctcatggttgttgcatgaagccgcccgggtattgggagacgccggactcattgcggagatagaacctgttgtaaagaagatagctgcggctgcatccgaaggacttacctccgacggaggaatgatatacgaaaagaatctcactaccggacacatcgacggcgactaccattggtgggtacaggccgaaaccgtagtcggatactataacctgttccgatatttcggtgatcgcggggctttgcaacattccatcgactgctgggagtttattaaacgacatttgactgacgatgtgcatggcgaatggttctggagccttcgtgccgacggtagcctgaaccgggatgatgataaggccggcttctggaaatgtccttatcataacggacgtatgtgcatcgagctgttgggcgaataa

SEQ ID NO: 780 - DNA, 1809 bp, B.fragilis
  unsure (1138): Identity of nucleotide sequences at the above locations are unknown.
attgttttccaaactttttgtacttttgggcacaatttaccgaatatgaaaaacaagcacgtcaaaagaataaacctgcttttgtccatcttattgggagcaggtgtcttcattttcttcggagtatactactcctaccatctgcattatcaggaacagttccagatgtttctctttacatccgactattttgtcgaacaagtatcccatcccgggggaatggcggactatctgggaggctttctcacccaattctattattattcgtgggcgggagccgctatcttgaccggtgcaatagggggtattcacaggttgatggtttggattgcaaatcgcctgggcggacacccggcatggtatccgcttactctgttaccttctttatgtttctttattctgttctgcgacgaaaattttcttctttccggagccatctctgtgggaatggtgctgggagcactcatcggatatacatttattgagaataggcagatacgcctgatttattggggagtcggcattccgctgctttatctgctggcgggaggatgtgcatggcttttcattccattgatatggataactgagttttgccggtttgccggtaggcgtctgccttggtggattctggtgggaggtacattgggaattgccggagtgacctattggatatccttggctgtatttccatatccggccgaccgcctgttgtgggcgatcggaagttatcgttttccattagtctttccacaaatgcaggtgatagcctggctggctgtgattctggtaccgttattggtagctcgtttgcccgagaagatgacttggagatactactcgggagcatgggttctgcaatttatcctgatgttgtttgttttgaatctgtatggcaaatacggtatcgggttgaataaagaggaagtgatggggtatgattatcatgtgcgcatgcaagaatgggatgaagtgattgcgatggcggaaaagaaagcacccgatacaccgatgtcggtttcttgtctcaatttggctttagcaatgaaagggcagctgcgggaacgtatgtttagtttttaccagcgggggaaggaaggactactgatgtcatttgtcaacgacttcaccattcttntggtagccggtgaaccttattattacctgggattggtcaatgtggcgcagcagtttgtcttcgaggctatggaggccgttccggattaccggaagagtgtgcgttgttttaaaaggcttgctgagaccaatttgattaatggcaggtacgaagtggcccggaagtatctgcgtatcttgcagcataccctcttttataaagattgggctactgaaactctggcttgcctgaatgatgaagaccgggtcaatgcacatccggaatacgggagattgaggaggcttactccgcgaaccgatttcttctttaaccctgacctgccggagatgacattggagttcctgcttcatgcaaatccccgcaaccggatggcgtatgagtatttgatggcttgtacactcttgaagaaggatgtgggacgttttgtgcattattatcctttgggagccgatctgggatattcttccgttcccaagggctatcaggaagcgttgttgttctattggcttatgagcaaacacactgcaacagatacaattccctggaagatagacccgcagacagagaatagattgagagaatacgcgcagattttcacatctgcccgttcggcagatgcattgtctgcccgattcggagatacatattggttttatgcagactttagataa

SEQ ID NO: 781 - DNA, 777 bp, B.fragilis
atttacttacaggaaaaattccatgttgcatataatcggggaaatgttatgacgttctgtcggcattattataatccggtgaccggaggaaatttttatgatactacgcaagtggttcgtcatatcttgccgggaggttcttatcatgctaccttcaaagccgatttgaagatcattgctgattttgcacacaatgcaaagggcgatgacgcagagttgattccgatcatattccgtccttggcatgagtttgatggtaattggttttggtgggcaaaaaatcattgttcggttgaagaatttaaaaagttgtatcggtttacagtcacttatctcagagattctttagaggtgcataactttttatatgcattttctccggactgtggtttcactactgaggccgaatatctgaaacgttatccgggagacaaatatgtagatgttgtaggtatggataattattgggattttcgtccgtatgggggagatacctccctggtagttctgaaagcccgtatccttacgcaatatgcgcaaaagcatggaaacctttctgccattactgagtcaggtacgcagacacgtgattcattgtggtatacacaattgttatctattctgcgttcggaaggggtagccttgaattatgtatgcacttggtcggggttttctccttataaaggacatccggcagcagccgatttttgtcggtttaagagggacactttggtgctcttcgctgatgaaattcctaatttttatacttggcactga

SEQ ID NO: 782 - DNA, 1197 bp, B.fragilis
agcaccggacagtcctgctggcccggtgctttacctgtttttcaaactatggacagatacagactaaagattatcgcattgacagcactggtgtgcctgaccggcagcagctgtacggacgacgagaacaacggacagggcaataacattatttatggtgagaatatcatcggaaacggagaacagaccttcgagataaaagatcatcaatacctgaaacggggcacttacctgatgaagggatggtgttacgtcacttacggttcgacgctgaccattgaagcgggcaccgttatcaaaggagacaaggaaacccgcgccgccctgattgtagaaccgggcgggaaactgattgccaggggaacggtagatgctcccatcgtattcacctccgaaatgcccgccgggaaacggaaaccgggtgactggggaggattgattttatgtggttatgcccggaacaatgaagacatcatgcagatagagggaggcccgcgtaccatgcacggaggtccgaacaacgcggataattcgggcgtcctgagctacgtccgtgtagagtttgcgggatatccgttcaagaaaaaccaggagatcaacggcatcaccttcggttcggtaggaaacggcacgcaaatagaccacctgcaagtatcgtatgccaacgacgatgccttcgaatggttcggcggaacggttcatgcggaatatctggtggcctatcactgctgggacgacgatttcgacatagacaacggctatagcggcacatgccggcatctgctgggcatccgccatccgcgaatagcggacatcacaggttctcatgccttcgaatgcagcaataatggcacgaacactcctgcgacacctaccacagccgccacctttgaagatgtcacgatctatggccctgcctcaggggatgcctcattcgtaaatcatcccgactttatcaatggcggcggcctccggcctgagaatgaaagcatgctcgggctattcggcgcggcactgtatatgggcaacaacacatcggtgactttccggaactgccggatcagcggatatccgtcggacatggagggcacaccggcctcagcggataacgtagtattcagcgaaagggaagaaaccggttatccggagtggacccaaggatggtgcaacttcaacccgcaagagacagagtattga

SEQ ID NO: 783 - DNA, 1134 bp, B.fragilis
aagatgagtaagaatatggaatacagaaaacatagaatagagtatttaaggactactgttgaatattccctttttgggggtgagggaggaacgagagaggcacatttgatgtttcatgtcgatccggaagcggggagttatgaagagcagctgacggccattcgtaaagcataccataggatactgagcaggaaggtgaaaatcaggggaatggtacccgtgttttgccgttacttcctgagtgatgccgccaatcagtgggaggctttgcaggctgtcttgcagaaagagccgtcgtgcgctgtctctgtcgtgcaacagcccccgttggatggaagtaagattgctttgtgggtctatctgacctccgaaccgaatgccgcttacaagcattactggacagccggtgcgggtgtgtcttgcggcaaatcggaacggcaaatgaaaaccttgttgaaatcttatgaagccgatctggtaggaaaaggctgtacgctggcttccgattgcatccgtacttggatctttgtgcagaacgtggatgtgaattatgccggcattgtcaaggcacgccgtgaaaactttctggggcagggactgaccgaatcgacccattatgtagccagtaccggcatagagggacggcatgccgatccgaagatacatgtgctgtttgatgcctatgcggtaaaaggattgcagccgggacaggtgacttacctgcatgcgctgtctcatctcagcccgacagccttgtatggagtgactttcgaacggggaacttccgtggagtatggcgaccgtcgtcatctctttatcagcggtacggcgagtatcgatcatcgcggtgaagtggttcatgtaggtgatgtccgggaacagacccggcggatgtgggaaaatgtagagaagttgctcgaagagggcaaagccggttttgaggatgtggcgcagatgattgtttatctgcgggacgcttcggattatccggttgtgcgcgctttgtttgccaaacgctttcctgatacaccgatacagtttgttgttgctgctgtatgccggcctgcttggctgatcgagatggagtgtatagcgatcgtcgctaacagtaactcctcttatgaatcattctga

SEQ ID NO: 784 - DNA, 1197 bp, B.fragilis
ataacgataaaaacactgtccattatgagtctgtttaatgataaagttgctaaattgcttgccgggcatgaagcactgctgatgcgtaagaatgaaccggtagaagagggaaacggagtgattacgcgttaccgttaccctgtactgactgcagcgcatactcctgtcttctggcgatacgacctgaacgaggagacgaatccttttttgatggaacgtatcggtatgaatgcgacgttgaatgccggagccattaagtgggatgggaagtacctgatgttggtgagagtggagggagcagaccgcaaatctttttttgctgttgccgaaagcccgaacggtattgataatttccgcttctgggagtatccggtgaccttacccgaagatgtggttcctgcaaccaatgtatacgatatgcgtctcactgcccatgaagatgggtggatatatggcatcttttgtgccgaacggcacgatgacaatgctcccataggtgatttatcgtcagctacagccactgccggcattgcccgtaccaaagacctgaaaaattgggaacgtctgccggatctgaaaacaaagagtcagcaacgtaatgtggtgctgcatcccgagtttgtggatggaaagtatgcactttatacccgtccgcaagacggatttatcgataccggtagcggaggtggtatcggatgggcattgattgacgatataacccatgccgaggttggagaagagaagatcatcgacaaacgatattatcataccatcaaggaggtgaagaacggtgaaggaccgcatcctatcaagactcctcagggatggcttcatctggcacacggagtacgcaattgtgctgccgggctcaggtatgtattgtatatgtatatgacatcgttggatgatcccacccggctgatagcttctccggcggggtactttatggctccggtaggagaagagcgcattggggatgtgtcgaatgtgcttttttcgaatggttggatagccgacgatgacggaaaagtatttatctactatgcttcgtcggacacccgtatgcatgtagctacctcaactatcgaacggttggtggattactgcctgcacactcctcaggacggcttttcttcctcagcttcggtagagatactgaaaaacctgattgaacgaaatctgagattgatgaaataa

SEQ ID NO: 785 - DNA, 423 bp, B.fragilis
ggcatcaaaaatcattcaaatagattattaatgaaaagaattggaatatatattgttattgtagtatgcatcctgtcttgcatatcttcgcgaaggaacctcttgacagaaaccagattgatgttggttgatacgagagcaactgaacatacggcggcattgttctataacttgcggcaactgaccggaaaacgggtggtttatggacaacataattatgaaatggatgggttcgattcggatagtacacgctgggaggatgaggcaaaccgatgtgatgcgtatgatgtgacgggggcttatcctgccttggctagttttgaattccttcattttacgaatcctcgtagttggggaaacaaaagaattgaatttacttacaggaaaaattccatgttgcatataatcggggaaatgttatga

SEQ ID NO: 786 - DNA, 483 bp, B.fragilis
aagatgaaaaatgaagaatatacatatctaggcggcctgatgcaaggcatcggctccctgctgacgggtatgaaaaccaccatcaaggtatattttcgaaagaaagtgaccgaacaatacccggagaaccgcgccgaactcaaaatgttcgaccgctttcgcggtacattgaacatgcctcacaacgaaaacaatgagcaccgttgtgtagcctgtgggttgtgtcagatggcatgtcccaatgataccattaaagtgaccagcgaaaccattgaaaccgaagagggcaaaaagaagaaaatactggcaaagtatgaatacgaccttggttcgtgtatcttctgccagctctgtgtcaacgcttgcccacacgacgcaatcaccttcgaccaggtatttgagcatgccgtattcgaccggaccaaacttgtcctgcaactcaaccgcgaaggaagtaaagtaatcgaaaagaaaaaagaataa

SEQ ID NO: 787 - DNA, 3228 bp, B.fragilis
aataaaagaaaaatgaaacgaatggcatatcacctgctggctatcttaatttgggggatggcagcatcggctgtcaaagcacagattttgttaacagcttctgctacgccgattgaagaatatgcggcggtagaacttcagcggtattattatcagctgtccggacgcttgttgtccatcgatcatgaagaagtaccggacaggaaaacggaatttgttctgacaagactggatcatccgttagtgaagtcttggagagacaaaggagtattacctctgaagtccatgccgggagagcagggatatgtcattcggacagtaaaagaaaaaggcagggaattggttgtcattgcaggtgttgatgccaatggattgctttatggtgtatatgggttgctggaagatcacttaggaatgcgtttctatatgaatggagatgtatatcctgataagaaagaggttcagacgagaataccgttgattcaagatgaacgaactccgacagtggctatccgtggatttcttccctggactaattttccgcaatcggctaccatttattcttgggatgattggcgttacatcatagatcaggcagcacggatgcgtatgaacttcattatgattcataactataacgggttttgcggacataatgaactgtttcataattttgaatacaaagggcatttatcgcgtggatggatgcctactataaagacaggacacggatggggctgtcccggatggaatatcaacgaatatcttttcggggcatctgaagtttatgatgattatgatttcggggcagactatggcttgcataatgaaacgttgacgaatggtcagatcaaagagaagggagcaactatattccgtaaggtgattgcttatgcacacttacgtggtgtaaaaataggtttagggttagatattgatgtcgttttgccggaatatcagtctgaaccggataacaaagacttgataaaggtacaggtcgcagaaatagctcgtgagtatccggaattggactatctgctttgttttcaatccgaaggtcagaaaaatgaggctttttatgcccgttggcgaagagtctttgatggattttatgaagagatgaagcggaagtcgccttctacccatatagctgtatcgggctgggggctaactgcggaatcggtgaatagtctgcctgaagatgtcatttgtgcccctatatcttactattcggccgcttttgagccgggaagtgtttatggaaatcgtgaatactggggatgtccctggctggaacgtgattttaacagttctgagtattactatccttataatgtagatctttcggaaacaatccgggcctttggagatgcttctgccaatatgaacggattttatgcgctgacatggagattggcggatgctatttctccaaagatgtggtatatcagtaaggctccttggtataatcatgaagtgctggactcttcggagaaagtgtatcgggattttgcacttgccaattatggagaaaatgcagtggatgccattactgacattatcgatcaaaacgaaccttttgctaccgatttcggtgagtgtcaggaaacacccggatttaatcagatggtacatacttatccgttgatgaatctttattcgatgacttttgggggaaagaatggaaaggatgtggagataaaagccaccgtatatgcagagaaaaaaggtacaaaaaatgctccttgtgatgaaggaggagagtgcgtgggatatattatggctgatgactggttgcagtatccggcagttgattttagtaatagtcccgaacgaatgtccatacggattgcttctgcatcttcgggtggtgttgctactgtttatctggatcgattgggaggacctgttatcgctcggtttgaagtaaagaacacggaaggttggcaatcctggaaatcattgaccgttccggtgaaagggttaaaaggtgttcatacgctttatgttcgttttcaaccttttaatgtaatagccaaagctgggaaattagctgataaacagctgaaaacaattgatagttgtatggccgttacttcggatgtacttcaacaattgcgtctctcccgattacgagcacgtattcagggagcagcatgccatatagctttgaatactgattttgaaaattatcaatggaatgatttaccggggaaaatggatgaatgggcgcgtagctttttgtatcgtattgaagatatttcttcctatggaaacattatgagtactcagaatcggtttgtgaaacagaactatgtagagaagatcaaccagctacgtaaacagcaacgggtacaggctccttcgcatattatagctaaaggtactcttgagggagcacagattagttggcgtaatgaagagccggcagtaagttccttcgtggtttgtcgtaatggagaagagattgatacattggcgtctgatgtgaattgttatcaggataagtttcatggagcagcttcgtatacggtatatgcagtggatattgaagggcataaaagccctttgggaatacctgccgattgtctggccgggagtgctgaccgggaagctccggttattgtgattaattccccgttgacttcaataatggagggaactccgttgcacattcggttttcagtcgttgaaaatcggttaccggaatttgtatccgggatatttcactatcggagaacaggagagaaagtgtggaaaaaaataccatttaagcaccggaccagaggtgtcttcacattaaccttacccgcttctgagattacgcgtcagggaatagaatactacatttcggtttcagattctgacaatgtattttgctatccgggttcggctccggctcggaatcatacggtggtagtaactgaggtaccgggagatgataaacccgaagttccgatgataaaaccaatttgtggtaaacgtatgttttggagtcgtgtgccaaatgtggaaatgtatcgcatctatcgtagcagaactcctgattttaaaatcggagcagatacgtttgtgacgtttgtagcgggaaatacacagagttttgccgataatggatttgatttcgacgggacttctctgaaaggaacttattattattgcgtgacttccgtatccttttgggatcatgaaagtgaggcatcaaaaatcattcaaatagattattaa

SEQ ID NO: 788 - DNA, 1281 bp, B.fragilis
aacagtatgaatatgaaaacgaattatctaaaactcaactcttgggccgtagcagccctgatgggaatgtgttcacttgcagcttgtagtgacgacaacagcggcgaaggcggcggaaacggcgacagcgaagaggtgatcgccaacaacggaacactgaaaggaagcgtagacggatcgaaaaccgtcatcctgaccaaaggctacaacttctccctcgacggagaatatatcgtcaaagccggttccaccctgaagatcggcgaaggtgtgacaatcagcgccaaaagcgatgatgccaccatcgactacatcctcgtggagcagggagccaagatcgaagcggtaggtactgcctccgcaccgattgtcatgactgccgataccaaagaaccgggagcatggggcggcatccacatttgcggcaaagccccgatcaatatcggatcgaccggtaaatcggaagtcggagatgccgcttacggtggttccgatccggcggacaactcgggtatcctgaagtacattcgcctggaatacgccggatacaagttcactacggaaaaggagtgtaacggcttcaccttctatggtgtaggaaacggtacgaccctcgaatacctcgaagcatacaaaggtaccgacgacggcttcgaatggttcggaggtacggtcaatgccaaatatctggtatcggtgagcaacagcgacgattcattcgactggacagagggatggagcggaaaagggcaattctttgtcgcctaccaggaagatcccgccactttgggatatacatgcgactgcctgatcgaggccgacaactatgacaagaatatggatgccgctccgatctcatgcccgacactggccaacctgacactgataggcgccaacaacgacgaaggcaaaagaggcatccgcctgcgtgccggaactcaggccaagatctacaatgcactcgttacaggcaaggccaataacctgactaccgaaacagaacagaccgagaaattcctgatcgacggtccttcggtactgaactacatcgctatcgcgagagatatcaaggcaagcggtgacggcggttactcttctgccctgttcacagccgaaggcaatcacaatgccatcaaccagactttgagcttcagcaatatctttatcggaacacaggacggaggagccgacctgtcagcagacagcttctttgaaaaagcggcttataaaggtgcagtgaaagcagacaatgaatggaccaaaggttggaccaagttataa

SEQ ID NO: 789 - DNA, 1218 bp, B.fragilis
ataatcatgaacagaatcaacaccaccctactcttacttttttgctcagtctattgcttggcgcaacaggctactatccccgttcccaagccctttcagttgaaatggcatcaagcggaaatgggagccgtattccattatgatctgcatgtgttcgatggagtacgctacggacaaggcaacaaccgcatcaatccgatagaagattacaacatattcaaccctacggaactaaacacagaccagtgggtgctggcagccaaagcagccggatgtaagtttgccgtactgactgccactcatgaaaccggtttcggtctctggcagagtgacgtaaatccttattgcctcaaagccgtaaaatggagagacggcaaaggggatatcgtccgtgactttgtcaactcttgccgcaaatacggcttacaaccgggtatctacatcggtatccggtggaattctcttttgggcatacataactttaaggcagaaggagaaggagaatttgctcacaaccggcaagcatggtacaaacgactgtgtgaaaagatggtgaccgaactttgtacccgttatggagatctatacatgatttggtttgacggcggcgccgatgatcctcgtggagacggaccggacgtagagcctattgtgaataaatatcagcctaattgcctgttctatcataatatagatcgtgcagatttccgttggggtggttccgagaccggtaccgtaggttatccctgctggtccaccttccccgctccctgttcacatcacaaacggatagaaagcaatgtcgatcaaatcgaactgttgaagcatggcgacaaagatggaaaatactgggtaccggccatggcagatactcctttacgtggagccaacggacgtcacgaatggttctgggaaccggatgacgaaaacaacatctatccattgaacgaactaatggataaatatgaaaaatcagtaggacggaacgctaccctgattttaggcctgacacccgacccgaacggattaatacctacaggagacgaacaacgcctgaaagaattcggtacagaaatcaatcgtcgcttctcttctccattagcccagatatcgggacaggaaaaaaagtgcgaccttgaaactggacaaaaagcgaccggtgaactactgcgtcattcaagaagacatacagaacggagaacgtatccgccaatataa

SEQ ID NO: 790 - DNA, 2706 bp, B.fragilis
aaagacatgaaacaacaaatcgggagacttctctccactcttcttctcgcaacattttccttaggaatcacagcaggggtcatccagggaaccatcattgataaacagaccaaagaacccctgaccggagctaccgtacagattgccggaaccacgaccggaaccgtagccgatgtagacggtaactacacactgacgctaagcaacggcacctataccattgaagtgaaatatataggatataaaacactccggatgaatgaagtgaaagtgaaagccaatgcgacactgaactttgaactggaagtagacgcgcaaacgctggacgccgtcaccgtagtggcccggaaaaacctggaaggcgaaaaggctttactgcaagagagacagaaagcaacgcttgccatcgaaaacatgggagccaaagagatgaccctgaaaggtatatcgaacgtacaggacggagtcaagaaaataaccggtatctccattgcaagcgccggacaactgatagtacgcggactgggtgaccggtacagcacgaccaccctgaacggtttgcccatcgcctcgcccaacccggacaacaagttgattccgctcgacctcttcccggcctctaccgtaaagaacatcaccgtcagtaaagtatatgccgccggagcctttgccgactattcgggcgcacatatcgacatcagcaccaaggagaacacgggaagtgactttttctccatcggcttcaacgtaggcggacgcttcaacactgtcggaaaagatttctattatagcgaccggaaaggcggactcttcagtacgggaaacctcaggaataaagaccggattctggctatgggtaaaagcgagttccgcgattacgcccgcaacaatgacccgttcggcacaaacttcgctatcagcaagcaccgttcactacccgaattcggtggtaacctgggaggaggcaagagctggacactccccaacggaaaccgtctgagcgtgcttgcctcggtaggtgtcagcaacgaaaaccaaatcttgaaagacgcctacgtgaccactatgaccgctcagggcacacacctcgacaagttcaattatgacagttattccagcgcactgaaaatagccggattgggcaacatcggctactcgttccggcaggcggaccacatcaacttcaccgtgttctatgcacgcaatgccatcaacgattacatgtcccgcgaggggatcgatgccgaaaagaacaacatcacatcgagcaacagcgttttccatgcctactcactactgaacaaccagttgctgggacaccacgaactgacttctcagtgggatgtaaactggagtgcttcgtacggactgaccaacagtgacgaaccggatcgccggcaggtggtcttcttccgtaacgaaggcagcgataagctgaacctctttaaactcaaccagactaccaaccgctacttcggagaactgcaagagaaagagattgtaggagatctgcgcacctcgtacaaatggggagatgcgaacctgattcgtgtgggaggtacttacaaaagcaaaaaacgtgactttgaaagcgtgaacttctactacgatatcaatgccttgaacgctgacgtcaccaacatttatgataccaacggatatctgaatcaggaaaacatagccaacgggacgataaaagccaacatcgatgcacagccccgttacaactactacgccggaatggatgtgtgggcagggtttgcagaaatagagtactacccgatggaatctctgctggtcaacgtgggactgcgctacgagcaggccaaacaatgggtacgctattggacggacggcggacaggagaagaaaacgaacctggacaaaggcgacttcttcccggcactgaacctgaagtacagcctgaacgaaaccaacagcctgcgcctctccgtatcacgcactgtcacccgcccttcatttatcgaaatggctccgttcctctaccaggaatcttacggaagtgcctatatccgcggtaacaacgaactgaaaaacgcttataattataacatcgacctgcgctatgatttctttccgaaacgcaacaacggggatatgttctctgtcacgggttatttcaaaaaactgaaatcgccgattgaacagactcaggagtcttcgggcggcacagtgatccgctctttccgcaacgccgaagatggaatagccacaggagtggaaatagaattccgcaaagaactgttcaagaacttccgtatcggagccaacggttcatacatgtacacaaacgtcgtattgcccgaaggcggggtatataccgactcggaacgcgctctgcaaggagcctctccgttcctgatcaatgcagatctcagctacactcctcaactgagaggagaaagcgacctgacactggcactggtttacaatgtgcaaggcccgcgcatcgagacagtaggtatctacggaacaggtaacatcaagcaacaaaccctgcacacgatggacttcatagcaagctatgccatcaacaaacacctgagcctgcgcctgcagatgaaagacttgctgaacagtaccatccgcttcaagcaggagctgccggcaacgggacaaaaggtggaagtagaatcattccgtccgggaacccatgcagaaataggagtctcgtacagattctaa

SEQ ID NO: 791 - DNA, 716 bp, B.fragilis
  unsure (695),(706),(707): Identity of nucleotide sequences at the above locations are unknown.
gataaaatgaaaaacaaccgattgatcattacccttattgccttgtttctcctaggattcgggctgaaagcccaaactgcttctactgaagaaactgctgctcagaaagagaaaagaatggaatggtttgcccaggccaagttaggaatctttatccattggggaatctatgccgtgaacggagtatcagagagctggtcattcttcaataactatcttccttatgaagagtatatggctcaggaaaaaggctttacggcatcggcctataatcctcaggagtgggtgaaactgattaaagaaagtggtgcacgttatacggtcattaccaccaagcatcatgatggcgtagctctttgggatacgaaggcgggtgacctcagtactgtgaaaagtactcctgccgggcgtgacctgattgctccttttgtgaaggaagtacgtaaacaagggctgaagctcgggttctactattcgctgcttgactggtcacatccggactatcccaacaaaacccgtacggaagtacgttacaaaaacgatccggatcgttgggctaagtttgttaagtttaattttggacagctttccgagttaaacaaaacttggaaacctgatctttactggtttgacggagactgggaacaaactgctgaggcttgggattcgaagtcttcaccacggggctggaagantgcgcgtcatnnggagctcaa

SEQ ID NO: 792 - DNA, 840 bp, B.fragilis
tatatgtttgactttagtataataacaagttggatacaccagacattaacctccgtcatgccggagggattggctgtattcatagaatgtgtcgttatcggggtgtgcattgtggctttgtacgccatacttgccattctccttatttatatggaacgcaaggtgtgcggtttcttccagtgccgactgggtccgaaccgcgtaggaaagtggggaagcatccaggtgctctgcgatgtgctcaagatgctgaccaaagagatcatcgaactgaagcattcggacaaattcctttataacctggctccgttcatggtgattatcgcctcatttctcaccttttcgtgcctgcctatcagtaaagggctggaagtgctggacttcaacgtaggtgtcttcttcctgttggcagcttcgagcataggcgtagtgggtatcctgctggccggctggggttcgaacaataagttctcactgatcggtgctatgcgaagcggtgcacaaatcatcagttatgaattgtctgtcggacttagtattctcacaatggtggtcctgatgggtaccatgcaggtttctgagattgtggaaagtcaggctaacggatggtttatcttcaaaggacacatcccggccctgatcgctttcgttatctatctgatagccggcaacgcagaatgtaaccgaggtccgttcgaccttcccgaagcggaaagtgaactgacggcaggataccataccgagtattcgggtatgcacttcggcttcttttatctggccgaatatctgaatatgttcatcgtagctgccgtagccgccaccatcttcctgggaggctga

SEQ ID NO: 793 - DNA, 2511 bp, B.fragilis
ccccgcatcgacaattacgaatacctgctgccaaagaacaaagagttcttccagaaactgggtgtcgactcccttatttacccggaaatgctggctgccaaggagatcgtatcgtccatgcgtatgagttgggtgcgccaatggtgggaattttgcggaggatcacttatcctgatcggtacaaagatgcgtgaaaaagccgaaatactgaatgtcacgctggccgaactaggtgcgccggatattccctatcacgtagtagccatcaaacggggtaccgaaaccattatcccccgtggagacgataccatcaaactgcacgatatcgtatacttcaccactacccggaaatacatcccttacatccgaaaaattgccggaaaggaagaatatgccgacgtacgcaatgtgatgattatgggcggcagccgcatcgcagtccgtacagcacaatatgtaccggattacatgcaggtaaaaattgtggacaacgacataaaccgctgtaaccgcctgacagagttgctcgatgataagaccatgattatcaacggagacggacgggatatggacctgttgattgaagagggactgaagaacacggaagctttcgtagccttgaccggtaactctgagaccaatatcctggcctgccttgccgccaaacgcatgggagtgagcaaaacagtggcggaagtggaaaatatcgattacatcggtatggcggaaagcctggacatcggcacggtaatcaataaaaaaatgattgccgccagccacatctaccagatgatgctcgatgcagacgtttcgaatgtgaagtgcctgacctttgccaatgcggacgtagcagaattcacagtacccgaaaacgccaaaattaccaaaaacaaagtgaaagacctgggactgcccaaagggaccactatcggtggcctgatccgcaacggagaaggtatactggttacgggtgatacccttattcaggcaggtgaccacgtcgtcctattctgcctcagcatgatgatcaagaagatagaaaagtccttaattgatggtatgataaactctaaaatgatatatcgcatcacaggtttcctcttactgatagagacaggcctgttactttgctgtgcaggtgtttcgctgatataccgcgaggatgacctgagcagtttcctgttgtcggcaggattgactactttagtcgccatccttctgctggctcttggcaaaggagccgaaaaacaacttaaccgccgagacggatatgtcattgtcagtgtagcatgggtcgtgttttccttattcggaatgctcccgttctacctcagccattatataccaagcataaccaatgccttcttcgaaacgatgtccggattcagtagtaccggagccaccattctcgacgatatcgaagcactgccccacggacttctcttctggcgaagcatgacacagtggataggcggattgggcattgtcttttttaccattgccgtactgcccattttcggtgtgagcggcgtacaactctttgccgccgaagccagcgggcctacctacgataaagtacatccccgtatcggtgtgacggccaaatggatatggactatctatgccggactgacagccattgaagtgattctcctgttattcggaggcatgggactgttcgacagtatctgccactcgtttgccacgaccggtacaggaggttattctaccaagcaagacagcatagcctattacaattcaccttatatagaatatgtgataggtgtttttatgtttctctccggaatcaactttacgctacttctcctgctatttaccggtaaactgaagaaagtatctcaaaatgccgagttaaagtggtacgtgatgtcagtgattctctttaccgcattcattgcggcagtgctctaccgcaccaccccgatgggagctgaggaatctttccgcaaagccttttttcaagtagcttcgctgcatacttccaccggatttgtaacagccgactacatgcaatgggtaccggtactttggggtaccctgactgtcatcatgctgataggtgcctgtgccggaagcaccacaggaggtatgaaatgcatccgaatggtgattctggccaaagtgtcacgaaatgaatttaaacacatcgtacatccgaacgccgtacttccggtgcgggtgaacaaacaggtcatttctcctgccatcctgtcgacggtactggcattctcattcatctatgccgtcatcatcattgtcagtgtactgttgatgctggcaatgggcgtaggtttcacagaatctatcgggacggtgatttcaagtatcggaaatatgggaccgggattggggagctgcggtccggcctattcatgggacggactccctgatctggccaaatggttattgtcgttcctgatgttactgggacgtctggaactattcaccgtcttacttttattcagttctgacttttggaaaaggaattag

SEQ ID NO: 794 - DNA, 1878 bp, B.fragilis
tgtagggtagagttggtaaaagagggaagtttttatggaactatccctctttttaactcagcttgcaatataaatctaacaaaaatgataatgcgaaaaattcaatatctgtttattgctttgtttatctgcctggaaatccaggcacaagacaaatttaatatcaggggagtgttgccctggcataattttctatcgggacctacttcctggaatctgtcggattaccggatttatctggatgaatgccggaagaatggtatcaattttattggttttcataattatactggtggtggagaacgctatgccacctatgtggaacctatgataaaaatagaatataaaaatattcttccgcaagcttgttttgataattcgatgacagcccgttggggatatcttccgatggctgtgaaagactttgcttttgatacgggaaagatatttcaattgcctgttggtgcagaagcttttggcaataatggttcgataacatcacattcttctcgggaacattatgaaaaagctcagtccttgatgagggatgttctgaagatggcacatgaacggggaatccgaatggctatgggatttgaatttggagtgatcccttccgaatatttttctttgaatgtagccggagattgtttttattgggcaggtgaatcgaatatgatccccaatccgaaaagtcagatagctgccgagatacattatgcggcaattgatgatatcctaaacacttatccggatatcgattatatctggatgtggctgaatgaacattcatttatgggtgtcgatgttcagaaagcacttagagataaaccctttgcccgggcttatcaagagaatcaggcactctttaaagaggctgccgattcatcggctcgttttgtcggggtatgggcattggaatacatgaaattgacttataaacatttgaaatcaaaaggctctcgtgcaaagttaatccttggtggttggggagggggacatcagttgccttctttattgaagggactggatagggccttaccccaagatattattttcagttgccttaatccggatttaggaaaaagtccgcaacctgatttcttggaagagattgcccgaaaccgtagtgtttgggctgtaccctggttggagggggatcatcaactctggcattttcagccgagagtcaatatgatgcgtgaacaggtaaagcttgctgccgaacaaaatctggacggagtaattgctattcactggcgtacagaggaaccccgttttaattttcgaacgtttgcccgttttgcttcggataagggtgctgacgagagtgtagatcaattgtatgaccgatatctgacagaggaatttggggaagaagccgcaaaagaaatgactcctttacttgccagaatggatcgtgaacagattcaatggaatgtaccgtcaccggaattttatgcatatactccggaatggggattattagatgaaaataatgtgcgaatacgacaagagttggtgtcttcgggagaatcgttattgaaaaagttaagaggagagaaacgggagaatctgaaacgtttcatagcaatgttccgttttgagctgttgttgggtgaggtagatcgggctatgatgcctgcttttatcttaaaaaagaaggaagtgcaaggtgagaaaataaatggttcgcaggagtatatggacgcatatcggctgttagtttcagcccctgttaaagaaatgtttgatacttatatggaacgtgttcattctcgtggagaattgggagtacttagctctttgaatcaacgtgtgtggcgcgaatataatgatcttaaaatttatctggaaaataaaataaaagaaaaatga

SEQ ID NO: 795 - DNA, 660 bp, B.fragilis
aggtataaagatatgaagaaactgataatattcgatttggatggtactttattgaataccattgccgatttggcacatagtacgaatcatgctctgcaaactttgggatatccgactcatgaagtcgcttcctataacttcatggtgggtaacggcatcaacaaattgtttgagcgtgcattgcccgaaggagagaaaaccgaggagaatgtgctccgcgttcgtaaagaatttcttttgcattatgaccggcataatgccgacgagagtcgcccttatccgggaattccggaattgttggaaacattgcagcataaaggttataaattggccgtggcttccaataaatatcaggcagccaccgagaagctgatagcacattatttcccgggaatccggtttgttgctgtatttgggcagcgtgagggagtgaaggtgaagccggatcctgctgtggtgcatgatattttgcagattgccgatgtttcgaaagacgaagtgctgtatgtcggcgattcgggagtggatatgcagacggctatcaatagcggagttacttcctgtggagttacgtggggattccgcccccgtacggagcttgaatcgttctgtccggattatatagtagacaaggcggaaactattttgtctattgtttga

SEQ ID NO: 796 - DNA, 1497 bp, B.fragilis
agcacaaaagatatgaactttttatccttattcgtactcattcctctgctgatgcttggcgggttataccttgccaaaagcattaaggccatccgcggagtgatggtagcgggaagtacggcgttgctgatcctgagtgttgtgctgacgttcctctatttgggcgagcgccaggcaggagctacagccgagatgttgttccgtgccgatacggtatggtatgcaccgcttcacatagcctactcggtgggagtagacggaatatcggtagcgatgctgctgcttagcgctgtcattgtgttcaccggcacctttgcctcctggaagttgcggccgctgacaaaagaatatttcctgtggttcaccctcctgtcgatgggagtattcggtttctttatctccatcgacttattcaccatgttcatgttctacgaaatcgcattgataccgatgtacttactcatcggcgtatggggttcgggacgcaaagaatatgcagccatgaagctgaccctgatgctaatgggtggttcagcattcttgctgatcggtattctgggtatcttcttcggtgccggcggaacaaccatgaacattcttgaaatagctcaactgcataacattccgtttgcgcagcaatgcatctggtttccgctcactttcctgggattcggtgtgctgggagcactctttcccttccatacctggagtcctgacggtcatgcctcggcaccgactgctgtctctatgctgcatgccggcgtattgatgaagctcggaggctacggttgtttccgcatcgccatgtacctgatgccggaagctgcaaacgaactgggctggatcttcctgatcctgacaggtatctccgttgtatacggtgctttcagtgcttgcgtacagacagacctgaagtacatcaacgcatactcttccgtaagccactgcggccttgtgctcttcgctatcctgatgatgaaccagacagcagctaccggagcggtgcttcagatgctcagccacggattaatgacagctctgttcttcgccctcatcggtatgatatacggacgtacccatacccgtgacgtacgcgagctgaacggactgatgaaagtgatgccgtttctcagtgtctgctatgtgattgccggacttgccaacctgggtcttccgggacttagcggcttcgtagccgagatgactatcttcgtcggttcattccagaacttcgatgtattccatcgtacactgaccatcatcgcttgctcgtccatcgtgatcacggcagtctatatcctccgactggtaggtaagattctatatggaacgtgtaccaacaaacatcatctggcactgacggatgcaacctgggacgagcgctttgccgtcatctgtctcatcatttgtgtcgccggactgggtatggctcctttctgggtcagccacatgattggcgagagtgtattgcccgttgtttcacacttaataccctaa

SEQ ID NO: 797 - DNA, 1596 bp, B.fragilis
aatatggaagaaataaaatacatagaacccgcagcactacacgacgaaatgctgcgtctgcgtaacgaaaaacagatggacttcctcgaaagcctaacgggtatggactggggagtggcagacgaaggtgacgcaccgaacgtaacccggggacttggagtagtctatcatctggaatcgaccgtaaccggcgaacgcatcgcgataaaaacatccacaaataaccgcgaaactccggaaataccttccgtcagtgacatctggaaagcggccgacttcaacgagcgtgaagttttcgactattacggcattgtattcatcggacatcccgacatgcgacgtctttatctgcgtaatgactgggtaggccatccgatgcgtaaagataacaacccggagaaagacaatccgctacgtatggacaatgaagagacatatgatacgactcgggaaatagagctgaatccggacggaacgtatcaaactcaggagaatgtgatcttcgatgaccgtgaatacgtagtcaacatcgggccacagcacccggcaacccacggagtgatgcgcttccgcgtctcacttgaaggcgaaaccatcaaaaagctcgacgccaactgcggatatatacaccgtgggatcgagaagatgaacgaaagcctcacctatccgcagactttggcactgaccgaccggctcgattatctgggagcacaccagaaccgccatgcgctctgcatgtgcatcgagaaagcaatgggtatcgaggtcagcgaacgcgtgaaatacatccgtaccatcatggacgaacttcagcgtatcgactctcacctcctattctactcctgtcttgccatggacctgggcgcattgacagccttcttttacggattccgtgaccgtgaaatgattctggatatgttcgaagaaacttgcggtggacgtttgataatgaactacaataccattggaggcgtacaggcagacctgcacccgaacttcatcccgagagtaaagaagttcatcccttacctgcgtggaatcatccacgaatatcacgatgtattcaccggcaatgtcattgcccggcaacgtctgaaaggtgtaggggtgctgagtcgcgaagatgccatttctttcggatgtaccggtggaacaggccgtgccagcggctgggcatgtgatgtacgcaaacgtatgccttacggcgtatacgataaggtggattttaaagaaatcgtttataccgaaggcgactcttttgcccgttacatggtgcgtatggacgaaatcatggagagcctgaacattatcgagcaattgattgacaatattccggaaggaccgatacaggagaaaatgaaacccatcatccgggtaccggaaggaagttactataccgccgttgaaggcagccgcggtgaattcggagtgttcctcgagagtcatggcgacaagacaccttaccgtttgcactaccgttcgacggggttgccactggtttcggctgtcgacaccatctgccggggagctaagattgccgacctgatcgctatcggcggaacgctggattatgtggtaccggacatcgacagataa

SEQ ID NO: 798 - DNA, 1611 bp, B.fragilis
gcgctgctggatccactggatgaaaaggcctatgattttgtgtcgcctgagcagttgggtgacagcgaaagtgcagcttctcagctcgtgacaggagcctataatacggtgatcaccagctttattgctccgggatcttatctttacctgaccaatatggactgtgactacgcatcaggagcttcatgggcattcggtaatgtgggagcgggaaacccacaaggtttttgggggatagaccacatgtggcaaggtagttatacgttaatccaccgggcaaatctgggtatatccaagatttcggcaatgagtaatctgagccaggagagtaaacaggatgctttagctcaactctgtttccttaaagcatgggcttattttaatttggtgagaaattacggtcctgtacctattttccggaaatccatttcggaaggagaagctatgagtcaacctcgtgcatcggtttcggatgtatatgcacatattatcgaattgttggaacaggctgaaggtatgtactcaaaagatgatgcaggtttcgtggtggggcatgcttcaaatggagctgctaaagcattgttggcgaaggtatatgttactatggcttccggggcgatgtccggtgtgcctatcgtggttaagggaggaaatccgaatatatttgaaccacaacctatcacgcacattgcaaagactgttgcaggttatgagtcttttgatccggccaagtattatgcgttggcacgtgacaaagcttgggaggtgataaacgaatataccctgtttgataattatatggacgtatgggccataggaaaccgtaataagggagaacacatctggatggcacaggccatcagcggtgataaggactttggaaacacgatctgtcaggattatgtgggcattttcaaagaagacggtacgatggaaggtaactggtatggtatgcgcgatcactggtatctgcttttcgaagaacaggatacgcgtattgtcgatggagttattcatcgatatgcgtcggatggtatatccaatggtaaggttatctataactattatccccgttggtatgcaaataaagtggacaataaggaggtatatgacagtcatggcaatgcttttgatggtacggaagtctatcatgaacgtcaggggtggacattggcgaagttgacaaaatttacttttgttacataccggaaacaaaaaaacagtgattttcactttacgttactccgtttgccggatatcatgttgatttatgctgaggctgtcaatgaattgaatggtgggccggacgctgaggcctataatcaggtgaaccgcattcgtacgcgtgcacatgccactccgttctccggaatgaatcaggatgaattccgttcggctgtactggaagagcgtgcccgcgaattggcctatgaagctgaccgccgttatgatcttttccgttggggtatctatctggatgtgatgaatgccatcgatatggatgagcataatgtgactaaacgtcgtttggaacgaaatcttctttatccgatacctaccagtgaagtgaactctaatgataagattgattctaataatccgggatggtaa

SEQ ID NO: 799 - DNA, 1011 bp, B.fragilis
aatgttatggaactatcattatatataaaagataaattagtatcaggaaaacgggtagccatccccattatgacccatccgggtattgaattgttagagaaacgggtattggatgccgtaacgaacggtgaaattcattatcacgctatccgtgccttgaacgaatgttttccgcaatcggcggcttgtaccactattatggatcttaccgtggaagcagaagcttttggagctcgacttagtatgtcccccaatgaagtacccagtgtttgcggacgtttgctcactggatatgcagatgttgaggctttgcagattccttcggtcgaatcgggacgcatgcctcagtatttgctggccgaccgcctggcagcagaaggaatagacaagcccgtgctggccggttgtatcggtccctattctctggcaggtcgtctatacgatatgacggaaattatgatggctatctataccgagcccgatactgttctgcttttactggagaaatgcacggaattcattctccgttattgtctggctatcaaagagaccggagtggccggtgttattatggcggaaccggctgccggacttctttcgaatgaagattgtcaacgctattcttcggtctatgtgaaacgtattatcgatgctgtccaggatgattcgtttgcagttattctgcataattgcggtaacaccggacattgcactgctgctatgctggctaccggtgctaaagggtatcatttcggaaataaggcggatatgataactgctctccgggaatgcccttcggatgtatgggtgatgggtaatctggaccctgtaggagtgttcagggtgctgacgcctgaagatgtttttgcacggacagaagaacttctgacctgtaccggagaatacgctaactttattatatccaccggttgcgatactccgcccgaagtaccttttgacaatattcaggccttttatctggctgtagagaagtacaataagggtaggtga

SEQ ID NO: 800 - DNA, 1458 bp, B.fragilis
aagaagatggattattcacaatttctatatatgaaagaggagctgtcactgatagcagttatcctcatcctgtttgttgtcgacctgtttacctgtccggaccaaaaaggtgccgctcctaaggtgaacgtcaggtcgctcaccttgccggctgtgatcctgatgaccctccacaccgtaatcaacctctttcccggaactccggcagaggctttcggcggaatgtatcagtacacaccgatgcaaaccatcatcaaggcagtgctcaacgtaggtaccatcatcgtgctactgatggcccatgaatggttgagacgcgaagacacccgcatcaagcagggagagttctatgtactgacactctctaccctgctgggtatgtactttatgatttctgcgggacatttcctgatgttcttcatcggattggaaatggcaagtatcccgatggccgcactggtggcattcgataaatatcgtcatcactccgcagaagcaggtgccaagtacatcctgaccgcactgttctcaagtgcattgctgctattcggtctttcaatgatatacggtacgtccggtacgctctatttcaatgacctccccggacacatcacaggcaatatgcttcagattatggcattcgtgttcttttttgccggcatgggattcaaaatctcattggttcctttccacctctggacagccgacgtatacgaaggagcgcctacagccgtaacctcttatttaagtgtgatttccaaaggatcggcagctttcgtgctgatgaccatcctgatgaaagtgttcgcaccgatggtggcacaatggcaggaagtgttgttctgggtaaccattgcttccatcaccattgccaacctctttgctatccgccaacagaacctgaaacgtttcatggcattctccgctatctcccaagcgggatacatcatgctgggtgtcatcggaggcagtgaaatgggaatgactgccctggtttattatgtactggtttatctggcagcaaacttaggtgtatttgcagtcatctcaattgtggaacaacgtagcaacaaagtggagatagacgactataacggactgtacaagaccaatcccaaactggcttttatcatgacccttgccctgttctcgctggccggtatccctccgtttgcgggtttcttctcaaagttcttcattttcatggctgcattcaacagcggattccatctattggtattcattgccctgatcaatacagtcgtatcgctttactactacttactgattgtaaaggccatgtatatcaatcccaatgaagaaccgatccccactttccgcagtgataactacaccaaagtgagtctcgcactttgtactttgggtatcatagctctgggtattgcaagttgcatctatcagggaattgacaagttctcattcggaatgggaatgtaa

SEQ ID NO: 801 - DNA, 381 bp, B.fragilis
acatactattggattatgaattttacattgttagttgtcgttctgctgaccgcaattgcctttgtcggtgtggtgatagccctttcaaacgctatctcgccgcggtcgtataatgcacaaaagttcgaagcgtatgaatgtggtatccctacgcgcggtaaatcatggatgcagttccgtgtagggtactacctgtttgccattctgtttctgatgttcgatgtcgaaacagtatttctgtttccctgggccgtcatagcccgtgacctgggacctcagggattgattagtattctcttctttttagctgagttgggtctgggcccttgcctatgcctggaagaaaggagcactgtaatggaaataatgaaaaagccttaa

SEQ ID NO: 802 - DNA, 198 bp, B.fragilis
gcggaggcccggtttcgcaaatcctatcatgtggtgaacggagtagacaagattctcccggtcgatgtatatattcccggatgccctccccgcccggaagcattttattacggtatgatgcaactgcaacggaaagtgaagatagagaaattcttcggaggagtaaaccggaaagagaaaaaacctgaagggaaatga

SEQ ID NO: 803 - DNA, 1557 bp, B.fragilis
gagaatacgcgcagattttcacatctgcccgttcggcagatgcattgtctgcccgattcggagatacatattggttttatgcagactttagataagatggaaaagataaaatactgttttagcatgatagggctgctcttcttgtttgcagcttgtcaagagaaggtgacatcccctgccagggtggatacattgccatcgatatttcccgattatgtcggggttaccattccctctaccattgccccgcttaacttccgggtgacggacgatggggtagaggcggttgatgtcgtgattgccggtacgaaaggaaagcctgtacggctgaatggaagattggtagacattcccgccaagcaatggcacgaacttcttgaaagtaataagggagacagtatcgaggtgaaagtctctgtccgccaggggaagaagtggaaagagtatcgtccgtttccgatatatgtcagtcctttcccgatcgattacgggttggtataccgtttgctcgcacccggatatgaagtgtacagcaagatggggatctacgaacgtgaactttcaacattccgccagactcctttatttgagaatacgcaggtgacggccgcctgcatcaattgccatgctttcaaccggacggagcccacaccgtcgagcgtacatgtaagaggcgggcatggagccactgtaatcgacacaggagatcggttggaatttctcgataccaaagccgacgggcaattgtcggcctgtgtctatccgtactggcatccttcgggcgaatacatcgcttattcggtgaacaaaaccaatcaggcctttcatctgggaggaaagaagccgatagaggtattcgaccaggcttcggatgtggtggtttatcatccccggtcccatcggatactgactactcctttgctgagtacggcttcgtttgaaacttttccggcattctcgcccgacggacgaacgctttatttctgttcggccgagcagaaagagatgcctgtccgatacaaagacgtgaaatacagcttgtgcagcattgctttccatcccgaagacggaacgttcggcgaccggatcgatacgttgatctcagcccgcacgctggacaaaagtatctctttccccaaaccttcgttcgacggaaaatacctgatgttcacgctttccgattatgggaacttctccatctggcacaaagaggccgatctctggctgctggacttgaagaccggaacctatcgcaacttggaggaggtgaacagtgacgacacggaaagctatcacaactggagcagcaattcacattggtttgtgttcagcagccggagaggtgacgggttgtacacccgcctttatatctcctcggtggacggacaggggcgtatagggaaacctttcctgctgcctcagcaagatccgtatacgttctacgatcagttgatctattcgtataatgttcccgagtttgtgtctgttccggtgcaatgggacaagcgggagatggccaaagggctgatgtcgaaggagcgagttaaagtgaaataa

SEQ ID NO: 804 - DNA, 756 bp, B.fragilis
tgccaatgcagccgtaataatggccaagaagttgataaacgcctgttgaatatgccactgatgaattcccatattgttgaagagtgtctgcctttcacttcgttgagactcgatccggaggatattaatctttcaatgggagccggttacgtgcctgatgcggagatacaggcaatatctgatgcattggaaacagagattgccggaatttgtacaccccgctttctgtatgctctgttcgatgccgagccggccggtacttgtgaggtgggagtaaacggtatttctctgaaaacaggatctgttataactccttatcttaaagatgctgcgggctatgtactctttgttgctactgcggggtacgagtttgaggcttttcagcataggataggcagtcagggagacatcttacgcgaatttcttctggatgcttacggttcggcaattgctgaagcagttgtccgtgaagtatgccggaaagtggaatcccgaatgtttcctttgggatacggagtcagtcatccttacagtcccggttattgcggatggcacgtcacgcaacagcagttgcttttcagctgcttgcctgaatttccttgcggggtccgattgagtgattcttcgctgatgtcgcctattaaatcggtcagtggtattattgcttatggtccatgtattgtcaaacggaaatatggatgcgaactatgcggcaaagccgattgctataaaaacagaaataaactaaacagatag

SEQ ID NO: 805 - DNA, 345 bp, B.fragilis
caacaaaaagggaagaatttgaacttaaaaactgaaaaggagacgcttatgggatcaaagaaaacagacttaatgcgtatttcatattttgtagccatcgtgatattggtatgtctgataggtaatctcaaagacctttggctacaatcgtggaccgacctgatcatctatctgatagtcctgtttgccgccgccgaatgtctgttcagtacgtttgcacgcatccgtgcggtcggagagcaaaaacagccccgttggctgacttctatctccctgctgatttacggaatccttttcctcggaactctattttttatcggagatttcttaataaacaagttatga

SEQ ID NO: 806 - DNA, 519 bp, B.fragilis
aagaatatgggacttacacttgaaacagtagtattctactttctggcagtgttcatcattgccatgtccatactgacagtgaccacgcagcgtatcgtgcgttcggccacttacctgctgttcgtgcttttcggcacagcaggtatctactttctgttaggatacactttcctcggatcggtacagatcatggtctatgccggaggtatcgtagtgctctatgtattctccatcctgctgacgagtggagaaggcgaccgggccgctcacctgaaacgaagtaaattcctggcagggcttgtcactacgattataggtgcaatcctggtgctcttcattacactgacacacaaatttgtgccgacaagcgatccggaacctgtagaaatcagtatcaagaccatcggacatgctttgttaagcagtggtaaatatggatatgtattgccttttgaagcagtcagcattctgttgctggcctgtatcgtgggcggattattaattgcacgtaaaagatag

SEQ ID NO: 807 - DNA, 2799 bp, B.fragilis
actacttttatggataacgatattgaacgatttcggcaaatggcgtccatggcgcaactcggatggtgggaagctgatttcacagccgggcattatgtatgctcagaatacctctgcgatttattgggacttgaaggaaataccatatcttttacggacttcaggaaacgggtgcgtgaggattatcaggaacagatagtccgggagttcaatgcttccatccatagggagttttatgaacagactttccctattcactccaaagagggaatcgtgtggttgcacacccgtttgggggagcgtgaagaaataccgggcaggggagtcgtttcattcggtatcatgcagcgggtagaagctcccaatgatacttccgagcgggttctggagcgtgtcaacgacttgctgtacaggcagaactccatttcccattcactcttacgctttctcaaagatgatagtgtggacctctgtatcatggagatattgaaggatatcctcgatctttttcatggaggacgcgtgtatatctttgaatatgatgaatattaccgctatcaggactgtacctacgaggtggtggccgaaggagtgttgccggagatcgatagcctgcaacgtatcccgactgacagtttaccttggtggaggcagcagaccctgtcgggtaaaccggtgatactggattcattggaccagcttccgaaacatgcaaaagcggaatatgcgatcctgagccgccagaacatcaagtcactgatgatcactccgctgatagccggcgaacatgtatgggggtatatggggatcgatctggtgaagaattatcgcaactggaataatgaagacttccaatggttatcgtctcttgccaatatcatcagcatctgtatcgagctgcgtaaagcgaaagacgaagctgtgcgcgaacgttcttttttgcgtaatctgttccgcttcatgccgatggggtatatacgtatgactatggtccgggatgctgccggactaccttgtgattaccggatagccgatgccaatgatttgagttcggaactcataggaatgcctctttccgattacgtgggatgccttgccagcgagttgcatgcggactttaaggccaaggtggattatcttctcgatgtgatggagggcagtgtgcacaaagagactgatgtctacttccatcgcacccagcgcagttcccattgcatcgtgtattctccggaaaaggacgaggtggtcgctctgtttctggactctacggagacgattcgtgcccatagggctttagatcgcagtgagaagcttttcaagaatatctttgccaatattcccgcgggagtggagatttacgataaggatggcaatttgctcgacttgaacaactgggatatggaaacctttggtgtaaaagataaagccgatgtaatgggagtcaacttctttgagaatccgaatgtgcctcttgaaatcagagaacgggtacggaacgaagacctggtcgatttcagactgaactactcttttaataaggcttccgattactaccattccgataaaagtaatataatcgagctgtatacaaaggtcagtaaactctttgacagccaagggaacttcaacggctatgtgctgatcaacatcgataatacggagcgtatcgatgccattaaccgtatccgtgattttgagaacttcttccttttgatatcggactatgcaaaagtaggttatgccaaactgaacctgctgagtaaacgtggctatgccatcaaacagtggtttaagaatatgggtgagacggaggatattccgctttcatccgttgtgggcgtttatgataagatgcatcctgaagaccggcagaaggtctttgacttttacgagaaggtattggcgggtgaagagaaggacttccgtagcgaaatgcgtatcctgaaacccggcgctaccaacgagtggaactgggtacggatgaatgtggtagtaaccaagtttgaaccggagcatggggaggtggagattatcggcattaattatgatattacggaactgaaggagacggaagccatgcttatcgaggcgaaagagaaagcggaaaacatggatcggctgaagagcgctttcctggcgaatatgagtcacgagatacgtacaccactcaatgcgattgtcggtttctcgggcctcttggtcgatacggaagacatggaggaacgctgcgaatacatcaagatcgtacaagagaataatgacttgctgctgcagctgatctcggacatcctggacttatcgaagattgaggccggtacgtttgagttcacctacggggagacggatgtgaatatgctttgtgaagatatcgttcgcagctctcagataaaggttccccagggagttgaattagtattcgatccgcatccttcggattgcactgtgataagtgatcggaaccggttgcatcaggtcatctccaatttcgtgaacaatgccctgaagtttacctcctcgggcagcatccatgtgggatatgaaaagaaggaagagggtgtggagttttatgtaagcgacacgggaatcggaatctctaaagagcaactgacgcatatctttgaacgctttgtgaagctgaacagctttatccacggaaccgggctcggactctccatctgtaaaagtattgtggagcagctgggcggcgtcataggagtggactcggaagaagggaaagggtcccgtttctggttcaccattccctatattaacagcgaacagtcaatcgttaacgattga

SEQ ID NO: 808 - DNA, 558 bp, B.fragilis
ataaagtctatcccgtatgaagacttcatcgacaacgaatcgttggaaaagatggtcaaagaactcaatgaaggcggtgcaaacgtccttgtgggagtacttgacgatcttatcaactggggacgcaggaactcgctggggccacttactttcgcaaccagttgttgcggtatcgaattcatggcactgggtgccgcgcgttacgacagggcccgcttcgggtttgaagtagcccgtgccagtccgcgccaagccgacatgatcatggtatgcggcaccattaccaacaaaatggctccggtactgaaacgtctgtatgatcagatggcagatcccaaatatgtaattgccgtaggaggatgtgcagtaagcggaggcccggtttcgcaaatcctatcatgtggtgaacggagtagacaagattctcccggtcgatgtatatattcccggatgccctccccgcccggaagcattttattacggtatgatgcaactgcaacggaaagtgaagatagagaaattcttcggaggagtaaaccggaaagagaaaaaacctga

SEQ ID NO: 809 - DNA, 3216 bp, B.fragilis
accttatgtataactttaaataagaaacgaatgaaaaaaatttcaatcttattcatgttgttgcttggcattactacattatatgcacagcaattgaacattacgggtactgtgattgacaaaaagctcaatgagccaatcatcggtgccacagtccaagtaaaagggacgaacaatggatccatcacggacatggaaggtaagttttctctaaaaaacgttagcaaaggaggtatactgactgtttcctacataggttacaccactcagtcaattcctctcaatggtacacaaacatccttcaggattgagttaagtgaagattcaaaaactcttgatgaagtagtggtagtaggcttcggtactcagaaaaaagtaaatctgaccggagcggttacaagtgtagataccaaagcactagcatcacgtccggtatcacaagtcggtcaagccctgcaaggtgtagttccaggcttaaatctatcgactcctgatttagggggacagttgggacaaacaatgaacgtaaacatccgcggaacaggaaccattggtaaaggatcaagtgcctcaccacttatactgattgatggaatggaaggcaatatgaataatctgaatccagaagatattgaaaatatctctgtcttgaaagatgctgcttcttcttccatctatggttcacgtgctgcattcggtgttatcttaatcactacaaagaaaggaaaagcgggcaaaatgcaagtgaactataacaatagtttccgctattccggaccaaccagccttcctaatcaacttgattcctatcgttttgccaattatttcaatgatgcagccattaatcaaggaggaagtgtgatctttgatgaagagaccattgaccgtatccaaaagtatatggcaggcgagattacaaccaccaccatagctaacggtaccaactggcatttccacgaaaaagcaaatgataacgtaaactggtggaaaaaacattttcaatgggcctggtcaaacgaacataatatcagtttaaatggaggaacagagaagttacaatactatgtttcagggagctacttaaaccaagatggtaatcttcgttatggaaatgataattataaacgttacaacgcaacagcaaaagtcaatacccaaatcaacaaatatgtagatttcaacattaataccaaatttgttcgttttgatcttgacaatccagtatatcttgaggaaggtggacttctttatcatgacattgcacgtatgtggcctatgatgccttttaaagatccgaacggttattatatgagaaatggaaaactcaatcaattgactgacggtggacgtgccaaaacacataatgacaatatttatcttcagggacaattagttattcatccgctaaaaggatggaatatctatgcagaagcaggtatgagagtcatcaaccaaaataagcaaaccaaccttaatccaatctatgagcacgacgtaaacggtaatccattagcattggctttcagcggaagttactcaccaggatcttcatttgcacgttcagcataccacaatagtaacttttatacgacaagtgtgtacaccgattacacattacaaataaaagatcattatttcaaagctttagtcggaatgaataccgaagaatatgtatatcgcgaacttgccgcacaacgtcctgacgtgattagtagtctcattccagaaattagtgcagcaacgggagaagataaaatcaatagttcaaaatacaatgattggtctacagccgggttcttcggacgtctcaactacagttacaaagaccgctacatggctgaagtaaatgttcgttacgatggatcatcccgctttttaaaagatcaacgttggaatgtatttccttctttctctttgggatggaacttagcacgtgaatcattctttgaaccaattaacaacattattaatacactaaaaccccgcgtatcatggggtatgctcggtaaccagaacacagactcttactatccgttctatttaacacaaagtgtaacagccaatggtggcaattggctaatggacggcagtagaccaacaacagccggagttcctggaatggtcagcagtacactcacatgggaaaaaatctataataccaatttaggcatcgaccttggtatgttcaacaatcgtctgaacatgacttttgaatacttcatacgtagaacgaaagacatggtaggccctgcagccgaagtcggtgcaatattaggaactgctctgccaaataccaataatgctgagttgaaaaataaaggatgggaactacaggccaattggagagataatattggaaaagttaactataatataggatttaacctttctgacaaccgcgccaaagtaatttcatatccaaacgcttctaaagccctatgggattctaatggaaatactctttattacaacggaatgactatcggggaaatttgggggtatgaaactgaaggtattgcccaaacagacgcacagatgaccgaatggctggctagcaatgatcagagtaaaataggttcagtttggggtgcaggtgatatcatgtatcgagaccttaatggtgatggtatagtagacaaaggaaacagtactgccacagaccatggtgatttaaagaaaatcggaaatagcactccacgccttcgtttcggtttaagcttaggagctgactggaagggtttcgatattcaaatgtttttccaaggagtcatgaaacgtgatttatggttgagcggaccaatgttctggggagcagatggaggagaatggcaatcagtaggttttgacgaacatcttgattatttccgtcctgaaaatacaacttctatattcggagcaaatttgaactcctactatcccaaagcctacttaggagacaaaggaaacaaaaacaagcaaactcaaacgcgttatctgcaaaatggtgcttacatgcgtatgaaaaatctgcaaataggatatacattccccaaagcttggatgaataaagcaaaaattgaaaagctccgcatttatgtcagtggagagaatttattcacaatcagtggtattgccgatatgttcgatccagaagcaacagccggtaacggatttagcaacggaaagacttatccgctgtcaaagactatttcatttggattaaatattactctttaa

SEQ ID NO: 810 - DNA, 2085 bp, B.fragilis
ttcatacgcatgaaaagatatttcatcataagtttgcttactttggcaagtacggtcgctcctttgacggctgtatttgcccaaagttcttttatctacgaaaaaggtaaatcgtttaaagatgtaaacgcctctccaatgcctcagaccatccgcctggacagaacggcagaaccggtcatttatgagaatgcagttcctgagaatgcaaccactatatgctaccgcatccaactgccgtcttatgtacgggggacattcttcagtcgggattcccgccccggagattacgaatggcccaacaataccaatcgtctcttaccttggatgttcaatcatctgacagaccttacccgggacgactatccgggtattccttccaacgcacgtccttctacactgggagacgctttattgttgcaactgaccgatggaagctatctattcaccaaagcaatagcgggtgataacagcctcagctggtttcaggtaaataccgacggctcgctcaatttatatgtatcgacattgggaaccgaccggctcgaacacaaagtacctgtagcactggttcaaagtgccggcaacatctatcaggtattccagcaggcttacgaaaccctgatatccgaccggaacgtatcggccctgcaaaagcgcacggaaaagaactattttgaggctctgaactatctgggatggtgtacttgggaacattaccatttcgatattgatgaaacaaaaatcctgaatgacctggatgccatcgaaacctccggagttcctgtacgttacgtactgatcgacgatggtcacctggccaacaagaatcgtcaactgacaagttttacccccgatcctcaacgtttcccgaacggatgggctccgatcatggcacacaaaaacaaagataaaatacgttggataggattgtggtatgccctctccggatattggatgggaatctcccccgataatgattttccaacccatgtaaaaaacagcctctattctttcaatggaagtcttttgcccggtaaaagcaccccgaatatcgacacgttctaccagtattatgttcactctctgaaaacccatggattcgattttcttaaagtagacaatcaggcattcaccttaccgctttacatgggctctactgaagtcgtacgtcaggcgaaagagtgtaatctggcattggaaaagcaaactcacgcacagcaggtgggactgatgaactgcatggctcaaaacgtacttaacacggaccacaccctgcatagcggagttgcccgtgtcagcattgactataaaaaatacaatgagaacatggcaaagtcgcatctcttccagtcatacaccaacacattactgcaagggcaaaccgtatggccggatcacgatatgtttcattccagcgatacgatctgtggcagtttgatggctcgttccaaggctatttcaggcgggccggtctacctgtccgattctccgaaagaatttgtaaaagagaatattttcccactgatcgataaagagggcaaaatattccgcccggaagcccctgccattccgaccccggaatcggtactgaccaatccactgcaagacggaaaggcataccgggtattcgctcctaccggtgacgaggctgtatccgtcatttgttataacctcaacacctcacccaaacaccggaaagtaaccgccgaaatagacccgaaagattatctgttacgcgaaacactgaccggcaaaccaacacctcaacaaaaacgagtgattctattcgactggaataatcagacagccactgaactgaccggtaaacagactgtagaattggatggctttaccgaccgtctattccatctctgtccgatccatgacggatgggcggttatcgggatacaggaaaaatatctgtcacctgcggccgtccggattctatcttcgacaccggacaaattggttctcaatgtattgtctccgggaactctgaaaatatggacagagaactccggaaaacaagaactgagaaacattcaggtaaaggaaaccggaaaaatgaccatcagaaaataa

SEQ ID NO: 811 - DNA, 1464 bp, B.fragilis
ctttacagcattatgaaaaatatcatccctcaagcactgcttaccatgcctattttgagcactggactacaagcacaagaaaagcaaccgactcccaatctagtcttcatcatggccgaccaatatcgtggagatgccatcggttgcatcggtaaagaacctgtaaagactcctcacctggacaagcttgcctccgaaggaattaacttcaccaatgctatcagtagttatccggtatcatcgccggcaagaggaatgctaatgaccggtatgtatcccattggcagtaaagtaaccgggaactgtaactccgaaaccgctccttacggagtggaactttcccaaaacgcccgctgttggagcgatgtgcttaaagatcagggatacaatatgggatacatcggaaagtggcatctggatgcaccctacaagccctatgtagacacttacaataatcgcgggaaagtggcatggaacgaatggtgtccacccgaacgtcgccacggtttcgaccattggatagcttatggaacatatgattaccatttgaaaccgatgtactggaataccactgctccacgagacagcttctattatgtcaaccaatgggggccggaatacgaggcaagcaaagctatcgaatacatcaacaaacagaaagaccaaaaacaaccgtttgcattggtggtatcgatgaatcctccacacacgggatatgaattggtgccggaccgatataaagagatatacaaagatctggatgtagaggcgctttgcaaaggacgtcccgatatcccggccaaaggtacggaaatgggagactacttccgaaataacatccggaactattatgcctgcatcaccggtgtagacgaaaatgtagggcgaatcatcgaggcccttaaacaaaataatttatttgataatacgatcgtggtctttacctctgaccatggaatctgtatgggtgctcacgaaaatgccggaaaagatatcttctatgaagagtctatgcgtatccccatgattctatcttggccggatcaaataaaaccacgtaaaagcgacccgttgatgattgcttttgccgacctataccccacactcctgtcaatgatgggattcagtaaagaaatcccggaaacagtacagacattcgacctgtccaatgaagtactgaccggaaaaaacaaaaaagatcttgtacaaccatactatttcgtaaaattcgataaccatgcaacaggttatcgcggactccgtaccgaccgatatacatatgccgtacacgcaacagacggaaagatcgataatgtcattcttttcgaccgtaccaatgatcctcatgaaatgaataacattgccagccaacaattgaaacttacccatacatttaaccggcaactgaaaacatggcttgaaaagaccaatgacccatttgcccaatatataaaacttaaataa

SEQ ID NO: 812 - DNA, 387 bp, B.fragilis
gaaataggaatgaaacaaaacttaaaatattatataataatagtgcttgccgtgctgcttcattcggtaacgatgaaagcggcaaacacctcttatataatagaagatccggaccaggaagaatgtttcatttcgcaagccactcctgcaagccggaatatcctggaacgctttcatttctattgtaccattatgccctgtgaaatggggcatgcagatatttctcatgtaccaacggacaaaagttttatccgtcctgaaatgatctttcataaatacagaatgagaaataatcctttttctgtccattcaaatcactcacatacatacaatccgtctgatccactgacctactatgtctacggattaaggaaaatcatcatttaa

SEQ ID NO: 813 - DNA, 318 bp, B.fragilis
gacgatatgatgatacacatggaatattacctggtggtttctaccatcatgatgtttgcgggaatatacgggttcttcacccgccgcaacacacttgctatcctcatctctgtagaactgatgctgaatgctacagatatcaactttgccgtatttaaccgtttcctttttcccggagagctcgaagggtatttctttgccctgttctccattgccatctcggcagcggaaacggctatcgctatcgccatcatgattaatatttaccggaatatacgtagtattcaggtaaagaatctggatgaattaaagtggtaa

SEQ ID NO: 814 - DNA, 4143 bp, B.fragilis
atctcttttgtatgtttaggctttatttcgttcttttgcaataaattgattattaatatgaagaagctaaatctctttttattggttttgtttatatgtaattgtccggtcgtttctggttatgctttttttgatagagatattcgtctgttaaccatgcaggatgggctggcggataatactattacatctatctacaaagatcgggatggctttatgtggtttggtactaataatggcttgagccgttatgatggtaaattaataaaaaacttctcttcttcaccagcgtatatgtatgtttccgaaattgtagagatgtcagatcgatatttgggagttatcgctggaaatactttatattgttttgctcggtcgctggagaaatttataccgatcgtccatgcaacggattatagttctgtacatgtctctcacttattacctatagataataactctttttggggactgtcagggaataaattatatctatatacacaggaagaagttaaaaatgagaaaggagaggttgttcagattaaattgaaatgtgagaaacagtataaagatttgattgattctggtgataatttctgtgcaatgtgttatactgataatcatgaaatgttatgtttggttacacagcaaggaaatttgctattgtttcagcctgaatcttcggagaaatctaaaaagatatctttgtggaaaaataaaacttgggatgcaacttcggtattatatgataaaggagtggtatgggtttctactattggacacggtattctgcgttattacgtttcttctgggtatatagacagaattacttataaggaaaataataaagaaaacagtctatcccatacagatgtttttcaagttattccaattaataataatcgttatcttgcagtgacttggagtgggtatactttattatttcaggataagaatgatccgaaaagaatgatgacagaaatatactataatacagcttcacaacttcaccgcaacttagaaacaagaatgatttcagcgtattacgaccccagtgggattgtttggataggtactaatgggggaggagtgatttattctgatctacggtcacaattttataaccaatttcatcaagagaggcataatgaaatttgtggtatagtcatggataatagaaaatatgtttggatggctacgtttcatcaagggattatgaaaagtgagcaaccttttgaaccaggaagacgaatgaattttactagggttggtactccggatattcaaagtaaaaatacagttctttgtgccattaatgataatagaggttcactttggtttggaaatagggatggaacattaacttcatataatgaggcaacaaaacaatttcgattacattttttacaagatagaggtaaagtgaatactgtgtcaatttgggcattatattgggatactaatcgaaatttatgggtaggtactaatgatggagtttggaaattgaatatagattctggattttgcaaaaaaatccctattgagattttgtttaaggaccctactcctatttgtatacgagctattgccggcacgaaggacggaactatatggttaggtacaagtaatgcaggagtttgcaaattgaaaattgattctagaggagagatgtctttagagacaggctatgagaagaaagcgaatatcaaaaataattcggttcgttctttgttagtatcttctgatggtaatgtatatgtaggttatatggatggtttcgctattctttcacctaaaaaggatgcaatacgtgagtattatacaactagaaatggattatgtagtaattttataggatgtctggtcgaagataaccgaggacatatttggttgggaagtaattcgggagtctctcgttacagtaggcatcagcaccttttttataattattatataagtggaagcaatcgttcggcattacttgctgataatacactattttttggcaataataaatcgctcacttattttgatccggatgacgtgggtggtcatttggatgaagatcaggttcttattactggacttgaggtagatggtcgtcctgtagggattggggataaaataaatgggcagactgtattggcagaaggcatttcatatactagttcgattactttgaataatgaaaatcgtgactttgttttatcttttaataatctttcttatgcagaggaacaacagaagtacaattaccgcttattaccatatcagacgcattggttggtttctaatgatggagagaaggctacttatatgaacttacccgaaggggattatacatttgaagtgaagaatatttatcctgacgggaaagatggaaaggttacatcactccaaatacatattctaccgcattggagtcgtacattgcctttccgattatttattttactgttattggccggtggtgtggcttatttgattcgtcttgtcaaacatcgtcagatgcgtatggaacgtgaaatgcgcatggaacatgaacttctgtcagtaaacttagagcgtgagaaagagcgacaaatccggatggagcgtgagaacttttttacaagtgcggcacatgaactacgtacgccgctaaccttgattcttgccccattacaggaattattggaacacataaaggcatccgatccactgtatagcaagctatataccatgtataaaaacagctcctcgctacatacactggtcgatcagttgctctatgtacaaaaaatagaggccgggatggtgaaactgcgtttgtcagaagcggatattgtggagctagtgagagaagtagcagagtcttttcgccaaatggcagggataaaaggatgtacatttcaggtaagacttccggaagatcctgttttcctatggatagatacggagaaaataacttcgtcggtcggaaatctactatctaatgcttttaaatacacttctcccaatggagaggtattgctcactcttacccgtatggaacaggatggaaagcctttttgccagataacagtatcggatacgggtgagggaataccggatgagtttcagaagcgcatttttgactctttcattacgggtgataattcaccggctttctctactaaagtaggcattggactgcggattgtgaaaaatacgatggatctgcatcatggacaggtcattcttgatagtgagccgggaaaaggttctacattcgtattattgataccggaaggtaaatctcactttactggtgatttatatgaaatagtagattatcgcgggcatgaaacggaaccgcagtttcaacctctatctgtacaggaaaaatcggaagaaggagttccggtcacaaagaaaacattgctgattgttgaagataatgtagatgtccgtcagtatattcgctctttgtttgtgacaaaatacacggtacttgaagcggctgatggtgaggaaggggtccggattgctaccaatgagatacccgatctgattatctcggatgtaatgatgccggttaaagatgggtttgcctgttgccgggagatacgtgaacggcaagagaccgctcatattcctatcctgatgttgacggccaaggcagaagatgcagatgtattgcaaggatcttatagtggggcggatgactatatgatgaagcctttcaatccggaagtattgaaagcaaaggtagagaacctgattcttcagcgcgaacgtctgaaacgcatttataccaaagcattgatgttgaaacgagaatcggttgaagatgaagaggcagatgacgaatttatacaaaaactcattcacgtggttgagaagaatctgtctaatgagaacttcaacgttaagatgttggccgaacaacttcacatgagccaacctactttataccggaaggtaaagcaacgcagtgagttatctgtggtcgatatgatccggagtgtgcgggtgagtaaggctgcttcgttgattatggagaatcgttactccattcaggagatttccgaaaaagtaggattcagtgatgcccggacattaaggaagcactttacggaacaatttggtgtgcccccttcaaaatatatggagaataaatga

SEQ ID NO: 815 - DNA, 1266 bp, B.fragilis
aatgtaaacgtcatgaacagatcaagagataaagtgcgttgtgcactcaatcatcagaatgcaggtagtataccggttgatttcgggtctacagcagtcacgggtatccattgccgtattgtggaagcgctaagaaactattatggactggcaccccgtccggtgaagattgtagatgcttttcagatgttaggagagatagatgcggaattggccgaaaagatcggagtagactgtataggtataggtggacccaaagatatcttcgatttggatacgactcgtatgcacgaacagacgaccccttgggggcaacgggtgttggtgcctgaagcaatggatttaactcctgatatgcggggagatgtatatgtgtatgccggtggggatcaaaattatccccccagtgccgtgatgcccaaaggatgttatttcattaatgctattgagcgtcagcagcccattgaagaagatcgtttggacccggaagacaatgtagaagagttcgggctattgacagagaatgatctggcttattactgtgctgaggcagacaaggcatatcagaccggcagagctgttgttgccagtttcgggggaacggctctgggggatgttgcttttgttcccggtatgggattgaagcagcccaaggggattcgtagtgtggtagaatggtatatgtctactgctatgcggcaggactatttgcatcaggtatttgagaaagagatcgacattgccattgccaattatgaaaaactctgggctgcattaggagataagatagatgtggtgttgacatgtgggaccgatttcggttcccaggaatcacagttttgctctatagataccttccgtgagctttggttaccacactatcgacggatgaatgattggatacatcaacatactacctggaaaatctttaagcattcctgtggagctattatcccgattctacccggattgatcgaagccggatttgatattatcaatccggttcagattaatgccaaagacatggaatccagaagattgaaagaggaattcggcagtcaattgaccttttggggcggtggggtagatacgcaaaagatactgcctttcggtactcccgatgagatacgtcgccatgtaatggggcagtgtgagatattgggccgtgacggaggttttgttttcaatgctgtccataatgttcaggccaatgttccggtagacaatgtagttgcgatgttcgatgctctaaaggatatctcttga

SEQ ID NO: 816 - DNA, 1155 bp, B.fragilis
tccgggatggtaatgaatacattcgtaacatttaaaattgaagatgcaatgaaaacatttagatatattttattcgtgtgggtgatgctgggctgtgggctttttgcatcatgtgaggacgatgaagtggaatatgctcctttggcggttacaagggtatctaccgtacttgaccgtgagcagggcattgatcaggctaatcttgcacagtacatcatagtgcaaggtacgggactgaatgctgttaattcaattctggtgaatgatgtgcaggttgatttgaaagacgcatacatcacttccggagaaattacttttccgattccaagagtgattccgggagaaataaataatctgataactttagggagtggaaattctacagtgacagctccgatatcagtgtttatccccgaattggaagtgaatggaatgttcaatgaatttacaccggccggtgatacaatgaaagtagtcggcgattatttcgatctttatgagataacgaccgaatcgggacaactgttctttggtggtaaagaagtgaaaattacaaaatcaacgggcaacagcttgagttttgtattgccggaagatgctgtaatgggatcaaaaattaaattagtcagtccggtttgtggagaggtaacggttccaggtaaatatatggaaaaaggtaacatgctgtgtgactttgatccgtttaccggttggggaggtagtaaatatgtgatagatggtcctgtgcctgctccgtacagtggatacttctcccgtttcaagatcaataaaggggatgcgaacgattgggactggaacgaggtgactactattgcacagtgtgctgtcgaatattctccggaggttattgccgatcaaaataaatatttgctgaagtttgaagtaaatacaatcaaaccattgactaaaaggcagattcgtttctatttttcacagatcaattacgattgggaaccttttgcatcgggacttgctctgaatacaaatggagaatggaaaaccgtttctattgatctgggagagatgtggaaaggagatattcctaatgatggagtcctgcagattatgggtaatagttgggcggaagatacagatatctgttttgataatttccgtatcgttcccaaagattaa

SEQ ID NO: 817 - DNA, 2061 bp, B.fragilis
gtccataaggttgtcagtccgcctccctttccactcttacttattaaatttccaatcaaaaagatgctccttccgctttcttttactaaatttgcatttaaatttgcccgaatcatgaagaatgaaccaacatatagcttgctaaacgccatcaattatcccaaagacctgcgccaactgagcgtagatcaattgccggaggtatgcgaggaattaaggcaggacatcattaaggaactatcgtgcaacccgggacacttcgctgccagcctcggtgtggtagaactgactgtagcactgcactatgtgtacaacactccttatgatcgtattgtctgggatgtgggacatcaggcctacggacacaagatactgaccggacggcgtgaagctttctctaccaaccgtaaactaggcggtatccgtccttttccctcaccggaagagagtgaatatgacacattcacttgcggtcatgcctccaactccatctcggcagcgttgggtatggcagtggcagccgagagaaaaggagaaaaagaccgccatgtagtagccgttatcggtgacggatccatgagcggaggacttgctttcgaaggattgaacaatgcttcatcgactgcgaacaacctgctgatcatactcaatgataatgacatggccatcgaccgcagcgtaggcggcatgaaacaatatctgttcaatctcactacttcgaaccgatacaaccaactgcgtttcaagacatcccgcctgttattcaaaatgggattactcaatgaagaacgtcggaaggccttgataagattgggaaacagcctgaaatctctggcagcccaacagcagaatatcttcgaaggaatgaatatccgatacttcggtcccatcgacggacacgatgtaaaaaacatagcccgtatcctgcatgatattaaagatatgcagggaccaaagattctacacctccacaccatcaaaggaaagggatttggtccggcagaaaaacaggctactatatggcatgccccgggtaagttcgatccggtaacaggaaaacgtattgtagccaatacggacgggatgcctcccctgtttcaggatgtattcgggcatacgctggtagaactggcggaaaagaacaaacggatcatgggagtcacccctgccatgccgagcggctgctccatgaacatgctgatggatcgtatgccggatcgcgcctttgacgtaggcattgccgaaggacatgccgtgaccttctccggaggtatggcaaaagacggattactgcccttctgcaacatctattcctcgtttatgcagcgggcttacgataacattatccatgacgtagcgatacaaaaactaaatgtagtattctgtcttgaccgcgccggactggtaggtgaagacggtcctacgcaccacggtgtgttcgacatggcttatctacgcccgatccccaacctgactatctcgtcaccgatggacgaacatgagttgcggcgcttgatgtatactgcccaattgcccgacaaagggccttttgccatccgttatccgcgcgggcggggttcgttggtggactgggaatgtccgttggaagagattccggtgggaaaaggacggaaactaaaggacggaaacgatctggcagtaattacaatcggccctatcggcaagttggctgcccgtgccatcgaacgtgctgaagcagataccggcatttccgtagcgcattatgaccttcgtttcctcaagccgctcgatgaagagctactgcacgaagtcggcaaaaagttccgccatatcgtaacgatagaagatggaatcattaaaggaggtatgggatgcgccatactcgaatttatggccgataacggatattatcccgaaatcaggcgcatcggtgtaccggatcagttcattgaacacggatcggtgcagcaactctaccacttgtgcgggatggatgaagaaggaatttacaaggtaattactaaaaacgaattacgaatggatgctcctgtggaaagctgcatggctacccattcttaa

SEQ ID NO: 818 - DNA, 1539 bp, B.fragilis
agcatcaaattaaatagcagttattattggataaaatcaaataatgtgtatttttggtccgaaattaaacctgaaaattttaaatcaaatagtatgagtacactccaaaatgcaatggggaaaatgacaaactacagatggacgatttgcgccatgttatttttcgcaacaactataaactaccttgatcgccaagtactatcgctgacctgggacgaatttatcaaacccgaatttcattggaacgagtcacattatggcatcattactgctgtcttttctattgtatatgccatttgtatgctgtttgctggccggtttatcgactggatgggaacaaagaaaggttacctttggtccatcggtatatggtcggccggtgcctgccttcacgctttctgtggaattataaccgaagaatatgtaggaatgcatagcgcagccgaactaatcgctgctaccggtgatgtagtagtggtacttgccaccataagcatgtattgttttttagtcgcacgctgtattttagcactcggtgaagccggcaattttccggctgccattaaagttaccgccgaatatttcccgaaaaaagaccgggcttacgctacttccatttttaatgccggagcttctatcggtgccctgattgcccctctcagcattccattactggctaaagcctggggatgggaaatggcattcgtcatcatcggtgctcttggcttcgtgtggatgggattttgggtattcatgtacacagctccctctaaaaacaaatttgtaaactcagccgaactcgaatatatcgagcaagacaaacatgaaacctacacagcaactgtaaaagagaacgaggaaaagaaaagtatgactttccggcaatgtttcacctacagacaaacctgggcatttgcattcggtaagtttatgacggatggagtgtggtggttcttccttttttgggcaccttcttacctgaatacccagttcgacatcaaaacctccgaaggattgggaagagcattgatctttacactttacgctataacaatgttatcgatctatggagggaaactccctacgatcatcattcataaaaccgggctaaacccgtatgccgcacgtatgagagctatgctgatctttgcattctttcctctgttggtattacttgcccagccattaggaaccatctctccctggtttccggttattatgatcggtatcgggggagctgcccaccaatcatggtcggctaatattttttctaccgtaggcgatatgtttcctaaaagcgccattgccagcatcaccggtattggcggtatggcaggaggagtaggttctatgattctccagtattcagccggcgagctgtttgtacatgccgacaaaactcaaatggtatttatgggctttatcgggaaaccggctggttatttcgttatcttttgtatctgctcggtagcctacctgattggatggatcgttatgaaggcattagttcctaaatataaacccattatcctgaattaa

SEQ ID NO: 819 - DNA, 2463 bp, B.fragilis
ccagataattcagaaacaatgaaaatgaaattaatatgctttttgatgttgagtgtgttttttatttttccggttcgggctaaaaacacattcgggaagaaaaaagacaaagtgacgcgcttgcatttttatgacctgaataagaatgggcggatggacacttatgaaaacccttctgctcctgtggagtatcgtgtggagcatcttttgtcacagatgactttggaggaaaaggtaggacagatgcttacttcattggggtggcccatgtacgaacgggtgggagaggacatccgcctgacccctcagttggagaaagaaatcggagagtaccatatcggatcgctctggggggttatgcgggctgatccgtggacgcaacgtacgttgcataccggactcaatccttcgctggctgcccgagcgtccaatcgtcttcaatcttacgtcatagaacatagccgtttgggtattccgctgtttctggcggaagaatgtccgcatggccacatggcgattggtgcaacagtatgtccgacttccatcggtcaggcaagtacctggaatccggaactgatccggcagatgggacgtgtcattgctattgaagcaagtgctcagggagcacacatcggctatggaccggtactcgacttggcccgtgatccgcgttggtcgcgtgtagaggaaacttatggagaagatccttatctgaatggggtgatgggaactgctctggtacgtggttttcagggagagacattaaacgacggtaaaagcgtgatagcgaccctcaaacattttgcttcgtatggctggacggaaggcggacataacggaggtactgcccatataggcgagcgcgaactggaagaggctatctttcctccttttcgtgaggcggtaggtgccggggcattgtctgtgatgagttcatacaatgaaatagacggaaatccatgtaccggaagtcgttatttgttaacggatatcctgaaagatcgttggcaattcaaaggttttgtcgtgtccgatttgtatgctgtcggaggattacgggaacatggtgttgccggcaatgactatgaggcggccataaaggccgtgaatgccggagtggatagtgatttgggaacgaatgtctatgctgagcagttggttgctgcggtcaaaagaggggatgttgctgtagcaacgatagataaggcggtacgtcgcattttatctctcaaattccaaatgggattgtttgatgatccatttgtagatgaaaagcaggcagtacaacttattgcctcttccgaacataccggactggctcgtgaagtagcccgtcagtcaatcgttctgcttaagaataaggacaagctgttgccgttgaagaaggatattcgtacccttgctgttataggtcccaatgccgataatgtgtataatatgcttggagactatactgctcctcaagccgatgggactgtagtgacagtcttggatggaattcgacaaaaggtctctaaagaaactcgtgtgctgtatgccaaggggtgtgcagtgcgtgattcttcccgtaccggatttaaagatgctatagaaacagcccgtaatgccgatgccgtagtaatggtgatgggaggatcgagtgcccgggatttttcctcggaatatgaagaaaccggtgcggcaaaagtcactataaatcagatcagtgatatggaaagtggcgaaggctatgatcgagccacacttcatcttatgggaagacaactggagttgttggaagaaatctccaggttgggtaaaccggtggtattggtattgattaaagggcgtccgttattgatggagggagctattcaagaggcagaggcaattgtggatgcctggtatccgggcatgcagggagggaatgctgtggccgatgtgcttttcggtgattacaatcccgcaggacgtctcactctttctgtgccacgttcggtcggtcagttgccggtatactacaatacaagacggaaaggaaatcgtagccgatatattgaagaaccgggtactcctcgttatcctttcggttatggtcttagttatacaactttttcctatacggatatgaaagtgcaggtaactgaaggaagtgatgattgccgggtagatgtaacagtaaccatacaaaatcagggtactgcagatggtgatgaaatggcacaactctatttccgggatgacgtaagcagttttacgactcctgccaagcagttacgggcgttcagccgtattcacctgaaggctggtgaatcccgagaagtaacttttactcttgataagaagtcattggctctgtatatgcaagagggggaatgggtggtcgaaccgggacgctttacaataatggtgggaggctcttccgaggatattgcctgccgacaagcatttgagataaaccgaaaatatacttttaaaatgtaa

SEQ ID NO: 820 - DNA, 1662 bp, B.fragilis
gtcttgtttagggaaatcaaccggggtccggatttaccagaagagttcaaagaaaccatttacaagaccagcccaataattccaccgggagggcatttacccattcagccaaagaaaggatattcgaaccttccccggattttcagcgtgagaatagagaccacgtcgcccatatacaccgacaagggcagcaagacgatcgcatcgacgttgccgggcaaccgggcacattctttcgatgggtggattacatccaccggccggatatccgccaatgcgcccaaagcgggaccgccgcggccggtggtgaccgacggggtttaccggcggacagaaaaactcaatatcacctccgtgtcaacggagtcgggcatcgtatgcaatatcgggtttgacgaaagcctgatgtatgaagcctggaaaaacgtttcactcaaggaacttccgggactgccggtcatcaaatacccggaaggcgtcgcagcccttgcccgtcacctggaggaagtgatgcgctaccaaaccccggcggattatcacgtgttccgcatacaggtggcgtctgaaaccctggaagagacggagtatccggagttcatcaaccccatagggtcggacgggaagacgtacgccctgctgaaggaagcacggaccgagagggttgtcatatcgggccaggccgtagatgtaaaggttcccgcaggatacgggatatcgccgttcctgaaggtatcccgcatattggagatgatattctcggcatacggctttacattggtggagaatccctttgccaccgattaccagctcagcaagatggtcgtgctcaacaatgtggcggacaccattgtcaccggagagatcgactacaggaatttgatgccggactgtaccgtcaacgagttcctggacgcgctgttttgccgtaccggggccaaggtttacgtaaatgccggccggaaagccgtcatacgcctgctcaaggattcgataggcgcaacggcatccgccgactggacaccgctcaaggcctcggaaccggaaataaactacacgcccgcaaagcagctcaagctctcggcgggcacatcgttcaaggaagccgaaccggcggcggactcctttgagaaattccttaagccttatggggggatcattacggaatttacaggggaccgggacgtgcccgacgaactgtacataacctaccagccttccaccggaagatattacaagcgggacatcgtgaacaagaaaaagaagtggatatccagcgactttttcccatgggacaagggcacccccggtgtggaatacctggagataacgggaaaggacgaatgtgtccccatggcatttaaaacggggctgctgactcccggatatctggcgggggcggtcaacatcaacacaaccctcagaggggccgccaaggagcagggggagaagaagcagacacccctggctttctgcttcgccatggggaaaaccaatcagattataggggccggggcccttgtggaggagtattatttcggcagctcactctgccgggagcccaaaggcgaatactttcaggaccccggggggaatgtttacaggtattcactggttttcaagggagaggacggggcgtttaaccggttctttaaggagtacgac

SEQ ID NO: 821 - DNA, 216 bp, B.fragilis
accccgtcggtcaccaccggccgcggcggtcccgctttgggcgcattggcggatatccggccggtggatgtaatccacccatcgaaagaatgtgcccggttgcccggcaacgtcgatgcgatcgtcttgctgcccttgtcggtgtatatgggcgacgtggtctctattctcacgctgaaaatccggggaaggttcgaatatcctttctttggctga

SEQ ID NO: 822 - DNA, 534 bp, B.fragilis
gtagcatgttcaacagtgatttctggcttccggcccgaactgagcagttcgaagacagaagaagactttttctgggcaggtactaatgccgctaccgaagaccagaactttgtaatctactcttacccgtatacagataaggatacctttacgaaagagttctttatccataagcgagattcagtgatgaaggctaatattccgggtgccaaagagggtatgtacatggcgactgattcgtctaccgtagaggttcgtccgattgatattcatggagattacacaatggaagcacgcggactgtggcgcataaagggcgatttcatgggtggcccgtttgtttcgcacacccgtctggataaagccagccaccgtattatcactacagaagtatttatttactcacccgataaaatgaaacgtgacctgatgcgccgattggaagcatctctgtatactttgcaacttcctaccgagaaggcgcaggaacagattccgatgggcatagagcaggaggagaaaactaacaaataa

SEQ ID NO: 823 - DNA, 246 bp, B.fragilis
cttcgtatctctaaagaattaatatcttgcaattacgaagttaatattaacgtactgttaatgttaacttcctacagttctcttattaagatattattgtttgataatcaattgcttatattctggatgcattctgtcgtaaaattcttctcttacgttcaagatgtgcgtagttgtctgtttatcaagttaccgttaagactctccatagcctgcctctccacttatttccacattcttttataa

SEQ ID NO: 824 - DNA, 1155 bp, B.fragilis
gagaattactcttatctttgctatccgaaaggagaactgcgatgcagaaggattgcagagatgaatgaacgtaaaattatacatatcgatatggatgccttttatgcttctgtggagcaaagggatcatcctgaattgcgtggtaaaccgcttgccgtggggcatgccgaggagcggggagtagtagcggcagcaagttatgaagctcgtcgttatggagttcgttcggctatgtcgtcacaaaaggcgaaacgtctgtgtccgcaattgatttttgttcccggacggatggaagtgtataaatccgtttcccgtcaggtacacgaaatatttcatgagtataccgatctgattgaacctctgtcattggatgaagcgtttcttgatgtgacggagaataagcaggggatcttgctggctgtggatatagctaaagctatcaagcaacgtatccgtgaagaactgagcctggtggcatcggcaggcgtgtcgtataataaatttctggctaaaatagcttcggactttcgtaaacccgacggactttgtactattcatcctgatcaggcaatcgatttcattgcccgtttgcctattgagtcattttggggagtagggccggtgactgcccggaagatgcatttactggggatacacaatggacttcagttacgggagtgttcgtctgaaatgctggtacgtcagtttggtaaagtgggactgctttattatgattttgcacgtggagtcgatcttcgaccggtagaagcagtgagaatacgtaaatcaatcggatgtgagcatacattggagaaagacatccatgtaagatcgtctgtgattatagagctttatcacgtagctacggagcttgtagagcgattgcagcagaaagagttccggggaaatacactaactctgaagatcaagtttcatgattttagccagataacacgaagcatgacacaggcacaggaacttacgaatcttgagagaatcttgccccttgccaaacaattgctgaaagaggtggagtatgagcagcatcccattcgcttgatcgggctttcggtatcgaatcctagagaagaagcggatgaacatcggggagtatgggaacaactgagttttgaatttagtgattggggaaaatag

SEQ ID NO: 825 - DNA, 189 bp, B.fragilis
cgatgtttatcaccgtcgcggagttcaagcgcttcgtgttcaccggtcgatgcacccgatggaacggatgcacgtcccataatgcctgattccaatactacgtctacttctactgtagggttacctcttgagtcgagaatttctcgtcctgtaattttttctattttcattgtttctcttgttttttag

SEQ ID NO: 826 - DNA, 3333 bp, B.fragilis
ataatgggatttaatgaatttttaagctcgattttcggaaacaaatccacacgagacatgaaagaaatccaaccctgggtagacaagatcaaagccgcttacccggaggttgctaagcttgacaatgacggcctccgtgcaaaaacagaggaacttaaagaatacatccgtaactcggcaagtaaagaacgcgccaaggccgatgaactcagagccggcatcgaaaatgtagagctggaagaccgcgaagaggtatttgctcagatcgacaaaatcgaaaaagaaatattggaaatatatgaaaaagcactcgatgaagtattaccggttgctttctctattgtaaaagaatcggccaagcgtttctctgaaaacgaagaaatagtggtgacggccactgactttgaccggacattggcagcaaccaaggactttgtccgcatcgaaggtgacaaagccatctggcaaaaccattggaacgccggcggcaacgacacggtgtggaacatggttcactatgacgtacagttgttcggtggcgtggtactgcacaaaggtaaaattgccgaaatggcaacaggtgaaggtaaaaccttggtggctaccctccccgtattcctgaatgcactgaccggaaacggcgtacacgtagtaaccgtgaacgactacctggcaaaacgtgactccgaatggatgggaccgctttacatgttccacggactcagcgtagactgcatcgaccgtcatcagcctaattccgatgcacgccgccaggcctatctggcagatatcacattcggaacgaacaatgaattcggtttcgactacttgcgtgataacatggccatcagcccgaaggacctggtacagcgccagcacaattatgctatcgtcgacgaggtggactcagtattgatcgatgatgcccgtactccgttgattatctccggtccggtgcctaaaggcgaagaccaactttttgatcaactccgtccattggtagagcgactcgtggaagcacaaaaagtattagcaaccaaatacctctcagaagccaagaaacttatcaactcggacgataagaaagaggtggaagaaggattccttgcgttgttccgcagccacaaggcactgcctaaaaacaaggcgttgattaaattcctcagtgaacagggtatcaaagccggtatgctgaagacggaagaggtctacatggaacaaaacaacaagcgcatgcacgaagcaacagatccattgtacttcgttattgatgaaaagctgaacagcgtagacctgacagacaaaggtgtcgatctgatcacaggtaactcggaagatccgactctattcgttttgccggacattgccgctcaactttccgaactggaaaatgaacatggattgagcgacgaacaaaagcttgaaaagaaagatgccttattgaccaattatgccatcaagtcagaacgcgtacacaccatcaaccagttgttgaaggcatataccatgtttgagaaagacgatgaatatgtagtgatcgacggacaggtgaagattgttgacgagcaaacaggacgtatcatggaaggccgccgttactcggacggactgcaccaggccatcgaagccaaagaaggtgtgaaagtggaagctgccacacagacatttgctaccatcacgctgcagaactacttccgcatgtaccacaaactctcgggtatgaccggtacggccgaaacagaagccggtgagttgtgggacatctacaaactggatgtagtagtgattccgaccaaccgcccgatagcccgtaaggatatgaacgaccgcgtttacaagacgaaacgtgaaaaatataaagccgtaatcgaagagattgaacagttggttcaagcaggacgcccggtattggtgggtactacttcggtagaaatttccgagatgctgagcaaaatgctgacaatgcgcaagatcgaacacaacgtactgaatgcgaaactccaccagaaggaagcagacattgttgccaaggccggtttgagcggtacagttactattgctaccaacatggcgggccgtggaacggacatcaagctgagccccgaagtaaaagcggcaggcggtctggcaatcatcggtaccgaacgtcacgagtcacgtcgtgtagaccgtcagttgcgtggccgtgcaggacgtcagggtgacccgggttcatctgtattcttcgtttcactggaagatgacctgatgcgtctcttctcttctgaccgcatcgccagcgtgatggataaactgggattccaggaaggtgaaatgatcgaacataaaatgatttcaaactccatcgaacgtgcacagaagaaagtagaagaaaacaacttcggtatccgtaaacgtctgttggaatatgacgatgtgatgaacaaacagcgtacggtggtttacaccaaacgccgccacgcccttatgggtgagcgtatcggaatggatatcgtcaatatgatctgggaccgttgcgcggccgcaatcgaaaacaatgcagactacgaagaatgtaaactggacttgctccaaacactcgcaatggaggctcctttcacagaagaggagttccgcaacgagaaaaaggacaagctggcagacaaaacattcgatgtggcaatggctaacttcaagcgcaagacagaacgtctggcacaaatagccaaccctgtcatcaaacaggtgtacgagaatcaagggcatatgtacgaaaacatcctgattccgattacagacggaaaacgcatgtataacatctcttgcaacctgaaagcggcttacgaaagtgaatcgaaagaagtagtgaaatcatttgaaaaatcaattcttcttcatgtcattgacgaatcctggaaagaaaatttacgcgaactggatgaactgaaacactcggtgcagaacgcaagttatgaacagaaagacccgctgttgatctacaaactggaatctgtgactctgtttgacaacatggtaaacaagatcaataaccagacagtgtctatcctgatgcgcggccagattcccgtagccgagcctacagaggaacagcaagaagcagccagacgcgtagaagtacgtcaggcagctcctgagcaacgccaggacatgagcaaatatcgcgaacaaaaacaagacctgaatgatccgaatcagcaggccgctgcccagcaggatactcgcgaagccgtaaaacgcgaaccgatccgcgctgaaaagacagtgggtcgcaatgatccttgtccgtgcggaagtggaaagaagtacaaaaactgccacggacggaacagttaa

SEQ ID NO: 827 - DNA, 1206 bp, B.fragilis
gaagcagagtcactgagttttattgataacttgaaactgaaagcatcatacgtattcctgggtaacaataatatcggtaactacccttatcagtccacttacgcacttggaaaggcgatgaactatgtattcggaggtgtgtatacacaaggagccgcagtgaccacttatgtcgatcctacactgaaatgggaaaagacccgtaccaccgatgtcggtattgaaacagctttctggaacaataaattgacattcaacgctgcttacttctatcgtaaaacgacagatattctctataaaccgagtgcaagttactcttctatctttggtctgggactttcgcaggtcaatacaggaagccttgagaacaaaggatgggagtttgagatcggtcatcagaacaagattggtgagtttagttatcatgtgaatggaaacttctcgataattaaaaacaaggtgatcagcctgggtgtaggagatgtggaacagaaaagcggaatgataggtaacggtagcgacctgttcctgggttatccgatgaatatgttttatggctataagacggatggcgtattcctgaccgatgacgaagtaaaagaatggcacgatcagagcaagattgctcctaactccaaagccggtgatttacgctatgtggacatctccggtgacggaaaggtggacgaatccgataaaacttatttaggatcaaagatacctcagtatacgtttggcttaggactgggtgcggagtataagggatttgatttcaatatattgcttcagggagtggccaaggtaaaaggccagttgaccaattatgccggttatgctttcttccaggaaggcaatattcagaaatggcaggcagaagaaacctggacgaataatcagtcgaaccgatatcctaaatatcctcgtctcgaagtgatgtcgaatgcaggtagcaacaatacgctgggctctgatttctggattttggatgcctcttatctcaaagtgagaaatatccagttaggatatacattgcccaaacgtataactcagaagttcggttcttccaaccttcgtttttatatatcacttgataatccattctccatcagcggatatcgtaaaggctgggatccggaaattaatacagacggtagttattatcctattctgtcaacttatacatttggtttaaccttaaaattttga

SEQ ID NO: 828 - DNA, 1050 bp, B.fragilis
acagatttgttgcttacttactttttacttattatggaaaagaaaacaagaaaaagcttcatttggctggctatcctgctgttgggaacaatttggatactagcccaacgaaataaacaaataccttacaacagtatcaatgggcttgtattcggcacagtatataatattacctatcaatatgatggcaatctgaaagcggagatcgatgccgaattaaaaaaattcgacggttcactttctccattcaatgatacatctgtcattacccgtgttaatcgtaatgaagaaatcgtcacagacactttcttccaaacctgttttaaccgatctatggagatctcagccgaaactcgcggagctttcgatatcacagtagctccattagccaatgcctggggattcggtttcaaaaaaggagccttccccgactcgatcatgatagatagtctactccaaatcacaggataccaaaaagttaaactggaaaacggcaaagtgatcaaagaagaccctcgggtgatgctaagttgtagtgctgtagccaaaggatattccgtagatgtagtagcccggtatttggatagcaaaggtatcaaaaactatatggtagatataggtggcgaactggtggtaaaaggggtgaatcccaaagaggaagcatggagaatcggcataaacaagcctgtagacgattccttgtcgcttaaccaagagatacaaacaacattaaaactgaccaatgtaggtatagcaacttccggaaactatcgcaacttttactacaaagatggcaagaagtatgcccacaccatcgacccacgtaccggatatccggttcaacataatattctttcagcaaccgtagttgccgacgattgtatgactgccgacgcattagccacagcttttatggtaatggggctggatgaagcggaagcttttacaaaatcacaccccaacataggtgcttattttatctacagtgatgaaaaaggggaggtgaaaagctattttacaaagaacatgaagcaatatcttgacaaatag

SEQ ID NO: 829 - DNA, 1629 bp, B.fragilis
ataagattgttggctatctttgtatccggatctgacagaccttattggaaattactcatgaacaaaattgatatgacaaacgaacgaatgaaattactgaactgcacattgggattagtggcaggggtgtctttgccggtaagtgctttggccgtacctcagcctgcccaggatcaaacagagaaacaacccaacatcatcctgattgtcgccgatgacttgggatacggagatttaagttgttatggcgcacaccggattcaaactccgggtatggatcgtatagccaacgaaggtattcggtttacgcagggattttgtactgcagccacatctacccccagccgctattcggtgatgaccgggaaatatccctggagcaatgtggatgctaaaatcttaccgggtaacgccgcattgattatcgatactcaaaaaataacgttgcctaaacttatgaagcaggcgggatatactaccggttctgtcggtaaatggcacatcggcctaggagatgggcatgtggactggaataaggaggtgcatcccggagccgctgagatcggttacgactattcgtttattcaggcagcaaccaatgatcgcgttccttgcgtctttctggaaaatggaagagttgtcggattggatccgaatgaccctctttatgtggattaccggaaaaacttccccggtgaacctaccggtaaagagaaccccgaattgttgcgcatgcatcccagtgtgggacatgcaggctctattgtgaatggagttccccgcattggtttccagaaaggtgggaaggctgcacaatggaaagatgaagaaatggcaggattattcctggacaaggccaggcagtttgtagatgacaataaagacaagcctttcttcctttattacggacttcaccaaccgcatgtacctcgtgttcccaatgaacgttttgtaggaaagtcaggcatgggaccccgtggtgatgtgattctggaggcagactggtgtgttgatcagttcctgaaagagttggataagttgggattggcggagaataccattgtgattctgacgagtgacaatggtccggtgctcgatgatggttatcaagatgatgcggtagagttggtgggtgatcacaaaatagccggtccgttgagagggggtaaaacaagtatgttcgacggaggtacccgtataccgttcatgcttcgttggcctgcaaaggtgaaacctcaggtgtcagatgtatttgtctgtcagatggacctattggcctcgtttgcttttcttttgggacagacttatccggacaaggtagatagcgaaaacacactcgatgcttttctgggcaagagtaaaaaagggcgtaaagagttggttattgagggaatgttcaattatgcctatcgtcagggagattgggcgctgattcctccatattacaatccttatagcaaggaagacggtgacttcatcggtttgggttacggttataagttgtataatttgaagtcagacatcggtcaacaaaagaatctggccgagaagtatcctaaaaagttgggtgaactgatcaatcgttttgagtatctgaaagctcactccgacaaagtgacgagattttga

SEQ ID NO: 830 - DNA, 1626 bp, B.fragilis
agtagcatgtttcattccttccagacctccattgccggcatcgaattgccccgcttgtttacttatcccttccattacactcctcatccgttatgtgtaatggcagcaggagaagtacaggcttacataaataagcagacaagatggaaagaagaattggacaaaggaaaaatgttcggcgtattgatagtccgtacttctaacggacaaacgggatatttggctgctttttcgggtaatttgtgcggaagcaattcacactctttctttgtaccgccggtatacgatctgttgaaaccggatggtttcttcaagatagaagaagaacaaatctcggctatcaatcaccaaatcggacagttacaaaactgtgaccgatatctggaactccaacaaaagatggagagagaaacagcttcctcacagcaggcattgtcagaggccagaaaagttctgaaagcagcaaaagagaaacgggaacagcgcagacttcaccgaccgaacgaaaatgaacaagttgccatgattcgcgaaagtcaataccagaaagcagaattcaagcgtttggaaagatactggaaagaacaaatttccgaaataaagacagaactggaaagtttctcgtcacagatagaggctctcaaagccgaacgcagaaatcgttcggcagcattgcaacaaaagctattccaacagttcaacttcctgaatgccaagggggaaactaaaaatttgtgtgctatcttcgaagaaaccgttcaaaaaacgccacctgccggagcaggtgaatgtgctgccccgaaactattgcaatatgcttatctaagcggattaagccccattgccatggccgaattctggtggggggaatctcctaagacagagatcagacaccacggttattattatccgtcttgcagaggaaaatgcgaacccattttgcgacacatgttgcaaggtctcaatgtagagccagcaccctcagaaagatactctttatcacaaaatatgccggagattcttttcgaagaccaatggcttttagttcttcataaacccgaaggagtactctccgtacccggaaagtcagaagaacaatcgatctacagtctgcttagagcccgctatcctgaagcgacaggtcccctcgttgtacatcgattggatatggccacttcaggattactgctggctgccaagacccaagaagtacaccggcacctacaggcccagtttgaaaaccgaagcatcaaaaaacgatatatagctctattggatggtatccttccggaagaagaaggagttatcgatcttcccatctgtccggattatcttgacagacccagacaaatggtgaacgaagagctaggaaaaacagctatcacccgatatcaggtgatggatcggaaaaacggacagacccgtattgctttcttcccgctgacgggacggacacatcagttgcgtgtacatgcagctcatccgttgggattaaactgccctatcgtaggagacgagctttatggacggaaggcagaacgcctttatctgcatgccgaatatctggaattcatccaccccgtatccgggcaaagaatggtcatcgaaaagaaagctgaattttaa

SEQ ID NO: 831 - DNA, 501 bp, B.fragilis
ttctccgctttttttgtcatttatccgtttatatccggaacaatcattataaaatattcgttaattagacaacgaattctattttttctcaaatttattgctacgtttgcagctactatgataaagtacatattctgcatattgataggtatcttttttgtgtatggagccggttataccgcttctatagaagaaactgcagaccttcccgccgaagttactgccacctttgtatcacaatatgccggagaccattctttattcaatgatgagacggctgaatccaaagtgtgtgatgctattcttccccatagttctttttcacgggaactaagttcttccaaaattttgaaactcaaattgcagactgctatccggctgctcaatgcctcacttttccatcaatcggagaggggagatacttatccggacttcaatcataacttcattaaatattccagcgggtattatgtatactcgttagagcatatcctgatttag

SEQ ID NO: 832 - DNA, 924 bp, B.fragilis
gaatcattgccttatacccaatttgaatacctaaatattatggcagacaattatatcgaaagacaatacgaacaatatgaagccagaaaagcggcttgggaaaaagcacgcaaatatggcaaaaagaaaacggggatcactcaccctgctagaactgaacaaccgggccaaacgacaatagagccccatcattataaaagagtatttgttacgggaggagccaatggaattggtaaagccattgtagaaatattctgtaaaagtgggtatcgggtggcattttgcgacaaagacggaatagcaggaaaacgtactgcagaagaaacaggagccatttttcatcaagttgacataagcgacaaggatatgcttgaacactgcatgcaatccatcattgaggaatgggatgacattgatattttaatcaataacgcaggtatcagtgacttctctcctatcactgaaacaagcatagaagatttcgacaggattctatccattaatctacgcccggtatttattacttcacgcttcatagctatccaccgtcaatcgcaaacaacatccaatccgtacggaagaatcatcaatatctgctctaccaggtatttaatgagtgaatccggcagcgagggatatgcagcttctaaagggggaatctattcactgacacacgcgttagccttgtcacttgcccaattccatatcacagtcaattctattgcgccgggctggatacaaacccatgactacgatcgtctccgtccgaaggaccatgagcaacacccttcgagaagagtcggtaaaccggaagatatagcccgcatgtgtagattcctttgtgaagaaggaaatgactttatcaacggtgaaaacatcacgattgacggagggatgactaaaaagatgatttacacggaataa

SEQ ID NO: 833 - DNA, 1623 bp, B.fragilis
ctttgcgctttatcaagaaaaacgactatgctcaaacggataccccacacatacaccatcatttcttcggtcattctactctgtgcagtgctttcctggatcattcctgccggagaatatgtgcgagagacaatcgacgtaaacggtatttcccgcactgtcattgtagaccattctttccaccgggtagaacagacaccccagacctggcaagtgttcagctcccttcttgaaggcttcgaacgtcaggcaggaattatagctttcttactgattatgggaggtgcctttcaaataatgaatagcagccgtgctattgataccggcattttttcatttctgaatttcacgaaaggacttgaaaaacaccgactgatcaaaatactgggagtaaacaatgtagtgatatccttagtcatcatccttttcagccttttcggttccgtattcggtatgagtgaagagacactggccttcgtcatcatcattgtcccacttgccatatcaatgggatatgactccatcaccgggctgtgcatggtatacgtagctgcccatatcggcttttccggtgcagtactgaatccttttacgatcggcattgcgcaaggtttgtctgatctcccgttgttctccggatttgaataccgtatgttttgttggctggtactgaccaccgccctgattgtttgtgtactcagatatgccgctgtcgtcaaaaagcatccggaaaaatcacctatgtatcatgctgacgcttattggcggaaacgggaaaaagaaagctgtggagagatatcccatgtaacgactcgccaagcatggatcgtatacctattgttactcgtgtccttggggttgttctccatcatctacccgatcagtactttttcagtaggtgaagcatcagtcacctgctatgcagttcccaccttatctatcttgtttgcagttttcggttggctgggtttacgcaaatccaaccagttctttatattgaccttactcgcattcactattcttttcctgattatcggtgtcatgggtcatggctggtatttaccggagatatccgccatctttctggcaatgggcattctttcggggtttgccaatagtgaacatgcagatgctatcatcaagcaattcatggatggagccaaagacatgttgtcggccgccatagttgtgggactggccggagggattattcaaatactgcaagacggacatatcatcgaccccattttacattctttggcttcactgatgggagaagccggaaaaatagtatctttgggggtgatgtatctgatacagacactcattaacctgattatcccttccgggtccgccaaagcagcgttaaccatgcctatcatggcacccttttccgatgtcatcggactttcgcggcaagctacggtaatggcttatcagtttggtgacggatttaccaatatgatcacccctacttctgctgtattgatgggtgccttaggcattgcccgcataccttatgagatttgggtaaaatggttgtggaagatacttcttttattcattatcctaggaatggtactactgattcccacggtacttttcccattgaatggattttag

SEQ ID NO: 834 - DNA, 1338 bp, B.fragilis
aatttagatacaatgaaaattaaaacgcttgtggctgtgttgtttctttcggcgggagcaacaactgtggtagcacaggacgacgctaattgtaattcgaacagtagtatttctcacgaagcagtgaaagctggtaactttaaagatgcttatactccgtggaaagctgttttggagaactgcccgactcttcgtttctataccttcacagacggttataaaattctgaaagggttgctggggcagatcaaagacagaaactctgcagaatacaaaaagtattttgatgagttgatgaatacgcacgatttgcgtatgaagtatactcaggaattcttgggaaaaggtgtaaaagtatcgtcggaagatgaagcactgggcattaaagctgtcgattatattgcatttgctccgaaggtggatgtaaatcaagcttatgattggttgaaaaaatcggtggacgctgcgaaagctgagtctgcagctgctacattgttctatttcttgcagatgtctcacgataaactgaaggaagatccggctcacaaagagcagtttattcaggactatctggctgcatccgaatatgcagacgatgctatagctgctgctgataaagagagtgtgaagaaagctttcggaggtatcaaagataatctggtagctctgttcattaacagcggtactgccgattgcgaatcactgcaaggtatctatggacctaaggtagaaacgaatcagactgatttgaattatttgaagaaagtcatcagcattatgaagatgatgaagtgtacggatagcgacgcttatcagcaggcttcattctatgtatacaagattgagccttcggctgaggctgctaccggatgtgcataccaggcctataagaaaggggatatcgatggttctgtgaagttctttgacgaagcgatcaaccttgagacagacaatgcaaagaaagcagaaaaggcttatgctgctgccagtgttttgactactgccaagaaattgtctcaggcaagatcttatgctcagaaagcaatcagcttcaatgaaaactatggtgctccttatatccttatcgccaacttgtatgctatgagtcctaactggagtgatgaatcggctttgaacaagtgtacttattttgctgttatcgacaaattgcagaaagctaaatctgtagatccgagtgtaacagaagaagttaacaaaatgatcagcagatattccgcttatactccgcaggctaaagacttgtttatgttgggctacaaagccggcgaccgcatcactatcggtggttggattggagagtctacaacgatcagataa

SEQ ID NO: 835 - DNA, 501 bp, B.fragilis
attatcagcacattggatgaaagtatacgaccatttcgtagatttgtgaaaacattaaaattgatgcatatgaaaaagtacctgttttacctcagtatggctcttgtagcagtagtgttgttttcttgtaaaagcggcaagaaaagtgtgtttactccaacttccagcggacgtgcttatgaagtcctcgttgtggttgagaagcctgtgtgggagcgtcctgccggtagagctttgtacaatgtgctcgatacagatgtgcccggacttccgcaatcggaacgttcgttcaggatcatgtctacttctcccaaagattttgatgccatcctgaagttggtgcgcaacattattatcgtagatatacaggacatttatacccaacctaaattcaagtatgccaaggatgtatatgcatctccccagatgattttgactattcaggctccggacgaggcatcgtttgagaagtttgtcgaagagaacaaacagccgatataa

SEQ ID NO: 836 - DNA, 1191 bp, B.fragilis
aagcctcgaacggttaaaaactgttcgaggcttttctatattcaaccaaaatcgtatttttgttcttttagaaaagtaaaaaaacaggctatgacaaaatatccgtatatactgttcgtattgctcctcgcgtctttcagttcctgccagactgttgagcaactttccatcgattatatgctccccgcagagatcagttttcctaacgaactgaaacgagtggcagtcgtaaacaatgtgagcgacactccggataacaccttaccacccaaggataatacaataaaaaataagaatgaactcagccgtgcagtagcctatcacgagggacaacccgcactcactaccgaagcattggccaaagctattgccgaacagaactatttcaatgaagtcgtaatctgcgattcggccctgcgtgcacgtgatttcacaccccgtgaatcgactctcagccaagaggaagttcagaccttggcacagtttctggacgtggattgcatcatctcactggaaaacctgcagatgaaatcgacacgggttctcagttacatccccgaatggaacacttattacggcacattggatacgaaggtttacccaacgctgaaaatctatctgccgggacgaaaaagcccgatggtaaccatcaatacccatgacagtattttttgggaagaatatggaaataccgaagggtttgtccgctcacgcctgccggatgaaagacaaatgatacgcgaagcttctgaatttgccggttccgtgccggtaaacagaatattaccttattggaaaacggccaatcgatattatttcatcaatggctctgtagctatgcgcgatgctgccgtttatgtgaaagaaaacgaatgggaaaaagcatccaaactgtgggaacaggcttttaaagcagccaagaacgacaaaaagaaaatgcgtgcagccttcaacctggctctatattacgagatgaaagacagtgtggaagaagcacacaaatgggctgtcactgcacaggaactggcccgtaaaatagacaaaatcgacacgttgaagagaaacgatatagacttgagcgaaatccccaactactacctgaccagcctttatgtgaatgaattaaaggaaaggagcaacggattgggcaaattaaaaggccaaatgagtagatttaatgaggatttttaa

SEQ ID NO: 837 - DNA, 2022 bp, B.fragilis
ctttgcagaacaaaaatgaaatcatatatggaaaagctaaaaatggaatctgtgagcatcgcagaggacagcctgaataaaatagccgaactcttcccaaacgtagtcactgaatcgatgggtaaggacggacaactacataaagctatcgactttgataaactgaaattcctgcttacagccaaccaagcagaaatgggagtggtatatgatgacgacgaacgttacgaattaacatgggtgggcaagaagcaggcgataagagaggtggcgcatcctatccgaaaaacattgcgtccctgcccggaagagagcaggaattgggaacagacccaaaacctatacatcgagggagacaatctggacgcaatgaaactcctgaaaaagagttacgcaggaaaggtagacgttatctatatcgatccgccttacaacacgggtaaagactttatcttcaatgatacattcgctctttcacaggaagagtccgacgagaaacagggaagatataatgaagaagggcaacgattgtttcagaatacggaggctaacggaaagtttcactccgattggtgtagcatgatgtatgcccgactgatgcttgcccgcactctgttaaatgataatggcatcattttcatttccattgatgatcacgaattggcaaatctgatcaaaataggaaatgaagtattcaatgcttctaatttcatcgatgtatttaattgggccaagacggaaactccggaaaatctctcaaaaaaaagtaagcaaatcatcgaatacatcgtctgctatcagaagaagaaaaacgacatgaaattccagggtctgaagaaggaatcggtcagttcgaacggtttgttgaatcaaccgaattccgtcggtatcctgaccttccccgccaacaaagtagtcacttccatccccgacggagtgatcaaagcaggcatgtacggaacagatgcttatgatgtggaattactggaagacaccaccgtacgtggcggactgtttacagcccccgtcaaactgaaagccaaattcaaatggagccaggcgaatctggacaaagagatacaaaaaggaacaacaatcaaaataccgactctcaagttaagtccttcatacgaaaagctggaatatgatccggaagttccgcccaacctgatcaattacaaagtaggagtcgaaaccaatgaacaggccggtaaccatcaactacagttctttgataagaaagtgttcaactttccgaaacctgtcagcctgatccaatatttatgtgagtttatcgacaccaaaaacaaagattgcatcgtgatggattttttctcaggaagcggtacgaccgccgaagcagttatgcggatgaacatgaaaccacgtaaaaacaaggtgaaatacatcctcgtgcaactgccggaagatgtgactgaaacaataaaaaaggccaaaactcctagtgaaaaagagattatgcagaatgcaatcgacttccttacggaaaaccataaagcattgaacatctgcgaactgtccaaagaacgtattcgacgtgccggagacacaattgaggcggaatgcaaccagcgtaaattaaaggacctcccggacatcggtttccgtgtttttcggattgccgacagcaatatgaaggacgtgtactacagtgcaaaggaatattcacagagtgatttattctatttcactgataatatcaaagaagaccgtaccggactcgatctgctttatggttgcctgaccaacctgggactatccctgtctctaccacatgatgaagaggatataaatggatatacggtttattctgtcgacaagaccgaattaatggcatgtttcgcagaacagattcccgaaaaagtcttccgtgaaatagccggcaggcaaccacgccgggttgtcttccgggacgcctcattccgtgacagtgccgatcgtatcaatatagacgagatattcaaaacattatctcccggtactacgatcgagattctttaa

SEQ ID NO: 838 - DNA, 891 bp, B.fragilis
gtgaatatgactataacagtgtttacgccgacatttaatcgggccactctgttacctagattatatgaaagtttagttaatcaaacatttcttgattttgagtggcttattgtagatgatggaagtactgatgatacatttaactttatagaatcaattaaggaaaacgataagattgatatacaatattactatcagaataatgctggtaaacatgctgctattaattggggagtagagctagctaaaggcgatcttttttttattgtagatagtgatgaggttatgattgaatctgggttacagactatagtagatgtttataaacaagtatctgataatgataactttgcaggagtgacagggctgaaaagtttttttagtggtaaaactatagggggagagcttaattatacttatttagattgttctgcaatagattataacctgaaatataaatatggtggggagatggctgttgcatataggactaagattttgcagaaatatccatttccgatttttgaaggagagaaatattgtggggaaggacttatttggtataaaatagctttgcactataaattacgatattttgcacatccaataatattgactgaatattatcctgatggtcttactgcattaggagtgaataaaaggatggaaagtcctaaaacgactttggctacatatagtgagctctctaaaatgaatgttccttttaatagtaggatcaggtatattattaatttttggagatttttttgttgcgataaacaaagaggatttgcatgcaaattgaaattggttaataagtctactattttactattccctttaggatactgccttcatttgattgatatttttaagacaaaaagaagatga

SEQ ID NO: 839 - DNA, 1293 bp, B.fragilis
cgaaaagagacaaataaattcattgaaccggccattttattcccacaaaagcagtatctttgccacatgaactcaaagttgcgacatttactcctgattgttttttcaatcttcccgattctgacatggggaacggaaagtccgtccaccgctgattccatccggatcagcctgttgacatgcgctccgggtgaagaaatctattcgctcttcgggcacacggctatccgttacgaagaaccggcacgaggcatcgaccgggtatacaattatggcttgttcagtttcaacacccccaacttcatcctgcgtttcgcactcggcaagaccgattatcaattgggggtggaagattaccgctgttttgccgccgaatacgaatacttcggacgcagtgtatggcagcagacgctcaatctgacagtcgaagaacaacaacagttaatcacccttctggaagaaaattaccgcccggaaaaccggatataccgctataactttttctacgacaactgtgctacccgtccacgggacaaggtggaagagagcctgcaaaaaagcggtagccaattgctcttcagcaatgcacacaccgaaaatggcgaaacgaaatcttatcgggatattgtccatcaatacacgaaaggacatccttgggcacaattcggaatcgatttctgcataggcagccaagccgaccaccccatcaacgatagacaaatgatgttcgctccgttttatctgatggatgcttttgccggagcacgcatagccaacacttcagacaacaaagcactggtggcttccaccaaaaaaattattgactgtgaaccggctgtatccggctccgcagaaaatgatatctggaatatgctaacccccatccgattgtcccttcttgtgtttatcgcaatcggaatggctaccgtctatggtctacgcaagaaaaagagtctttggggactggatatcgcagtgtttgcggcagcgggtatcgcaggatgcatcatcgctttccttgctcttttctccgaacaccccacggtaggctccaattacttgctgtttgtcttccatccggggcatctgctctgcctccctttctttataaacgatgaacgaaagcgacgcaaaagcaggtatcatctgctgaactgcacagttttaacactttttatagtgctttttccggtaataccacaaaatttcgacttagcagtattacctttggcactctgtttgctgatacgttctgcaagcaatcttattctgacatacaaaaaagctaaatga

SEQ ID NO: 840 - DNA, 402 bp, B.fragilis
agtgtttattttaaaaaacaaaataaattacccggacaaataattggggataaaatgaagttaatccaatatatttcaacaacttacgttagagaagaactttataacccggacaatcgggatcttattaacccaaaaagtccccctgaatttataagttcaggaggacctttttgtcataaagtggagctggagggattcgaaccctcgtccaaacgaggaaatcataagctttctacatgcttatctttgcctaagtttttcgtgcaggagcagaaccaaagccatcaattcctgccttatcctttaaagtttcatcagaagcgcaaggccacttctgactatccccgatgtaactgcaccactgaaccggaatgcttcggagcaacagcttccgagtga

SEQ ID NO: 841 - DNA, 795 bp, B.fragilis
atcattcttttctcttacttttgcagccgatttttcaaaagagttatggcacagtttacggaagaagagaaaaccattcggcgtatcgaaaagcgttttaacaaaggtatggttcaatatgggttgattgaagagggtgacaaagtgcttgttggcctttcaggaggaaaagattccctggcattagtcgaattgctgggcaaacgttcgcatattttcaaacctcgtttttcggtggtagctgtacatgtggttatgaagaatattccataccagagtgattgggattacctccgtgaacatgctgaaaagaatggtgttcctttagttgtttacgagacttctttcgacccttctaccgatacgcgtaaatcaccttgttttctctgttcatggaaccggaggaaagctctgtttactgtggctaaagagcagggttgcaataaaatagcccttggacaccatatggacgatattttggaaactttattaatgaacattacctatcagggtgcattcagtacaatgccaccacgtttggtaatgaacaaatttgatatgaccattattcgcccgatgtgcctggtgcatgaagcggatttgttggagttggcgcaaataaggggatatcgcaagcaagtgaaaaattgtccttatgaatcccaatcgagccgtagcgatatgaaggggatactccgacaattggaaaagatgaatccggaggctcggtacagtctgtgggggagcatgacaaatgtacaggaagaattgttacccaaagaagtggagttttaa

SEQ ID NO: 842 - DNA, 189 bp, B.fragilis
tgtgcatatttctttgcgcaaacggccgaccgttatcaatggataacgcccgcacagaaaagatatattcacccggaggaaggttcgaaaaacgaattctattatctacagacggagcactccaatccgtatgatcgagtttccaactgtaagctatatcctgcttttcagtatagcgaatggcagtag

SEQ ID NO: 843 - DNA, 1167 bp, B.fragilis
ttggttatggctgaatcgaattttgttgattacgtaaagatatactgccgctcgggtaaaggcggaagaggctctacgcacatgaggcgagaaaaatatactcctaacggtggacctgatggaggagatggcggaagaggaggccatgttatcctgcgtggtaaccggaattactggacattgcttcacttgagatatgatcgtcatgcaatggctggtcatggggagtcgggcagtaagaaccgtagtttcggtaaagacggagcggataagattattgaagttccctgtggtacggtggtttacaatgccgaaacaggtgaatatgtatgtgatgtaacagaacacggacaagaggtcattcttttaaaaggcggacgtggcggattgggaaactggcacttcaagacggctacccgtcaggctccccgttttgcccagccgggcgaaccgatgcaggagatgactgtaatccttgaattgaagttgctggctgatgtaggtctggtaggtttcccaaatgcaggtaagtctaccttgttatctgctatttctgctgcaaaaccaaagattgccgattatccgtttacaacattggagcctaacctgggtattgtatcttatcgtgacggacagtcgtttgtgatggctgatattccgggaattatcgaaggtgccagtgaaggtaagggattgggattgcgtttcttgcgtcacattgagcgcaactctttgttacttttcatgataccggcggatagcgatgatatccgtaaagattatgaagtgctgctaaacgaactgaaaacatttaatcctgaaatgctggataaacaacgggtacttgccatcactaagagtgatatgctggatcaggagttgatggatgaaatagaaccgacattgccggagggaattcctcatgtattcatttcatctgtatccggtttgggcatttcggtgctgaaggacattttatggacggagttgaataaggaaagcaataaaatagaagctattgtgcatcgtccgaaggatgtcagccgattgcagcaggaactcaaagatatgggtgaggatgaagaactcgactatgaatatgaggatgatggtgatgaggacgatttggattacgaatacgaagaagaggattgggaagataaatga

SEQ ID NO: 844 - DNA, 360 bp, B.fragilis
cagtatatggcagacgtgaaagagaaaataaatcttctggatgtaattcctttccgtagtgaaaatattacggccgaaaagggaagcgatggtaccgttaccattgctttcccccggtttaaatacgagtggatgcggcgattcttgttgcctaaaggaatgtctgcggatattcatgtccggctggaagatcatggcactgccgtatgggagttgattgacggaaagagaaccgtacgccggattattgaagagctggcagaacacttcaattatgaagaaaattacgaatcacgtattacggcttatatcactcagttgcagaaagacggatttgtgaaattagtgattgagaactga

SEQ ID NO: 845 - DNA, 1296 bp, B.fragilis
tatgacatggcaaaaatacaaattaaatctgagaaactcacaccttttggaggaattttttcaatcatggagaaatttgactccatgctttcacccgttatcgactcaacactgggtcagagatgcagcagtatcttcggatatcagttcagcgagatagtccgttcgctgatgagcgtttatttctgtggcggctcatgcgtggaagatgtaacgtcacaactgatgcgccatctctcgtatcatcctacccttcgtacatgcagctctgataccatcctcagagccatcaaggaactgacacaggaaaacatctcctatacttccgaccaaggcaagacctatgatttcaatactgcagacaaactcaacacattgcttataaacgctttggtttctacaggcgagttgaaggaaattgaggaatacgatgttgactttgaccatcagttccttgaaacggagaagtatgatgcaaaaccgacctacaaaaagttcctcggctacaggcctggcgtatatgttatcggtgacaagatagtctatatcgagaacagcgatggtaacacgaatgtgcgttttcatcaggcagacacccataagagattcttcgctcttctggaatcccagaacatccgtgtaaatcgcttcagggcagactgcggttcctgctcgaaggaaatcgtcagtgagatagagaagcattgcaaacatttctacatccgtgccaaccgatgcagttcgctctacaatgacatctttgctctgagaggatggaagacggaggagattaacggcatccagttcgaactcaattccattctcgttgagaaatgggaaggcaagtgctatcgtcttgtcatccagagacaaagacgcaacagtggcgaccttgacctgtgggaaggcgaatacacttaccgttgtattctgaccaacgattacaagtcatcgacaagggacattgttgaattctacaatctgcgtggcggcaaggaacgtatctttgacgacatgaacaacggattcggttggagcaggctccccaagtcattcatggcggagaatactgtctttcttctgcttactgcattgatacacaatttctacaagaccatcatgagcaggcttgacaccaaggcttttgggctcaagaaaacgagtcgcataaaggcttttgtcttcagattcatctccgtacctgccaagtggatcatgactgcaaggcaatacgtgctgaatatctacacagagaaccgagcttatgcaaaacccttcaaaacagaattcggataa

SEQ ID NO: 846 - DNA, 1446 bp, B.fragilis
cagattcattatcaatatctattaataataaacattcatatattcagtaacaggtctgtaacactaccctcctatttttgcaccggaaaacaacaagcagatgttatgaacaatgtacagcaagtaaaaacttattcgcagagaaaaatttctgatttccttttcattctttgggcaggcggagcagcgctgctctcctattcattggtatatgcactgagaaagccttatacagcagccggatttgacggacttgaagcgtttggaatggactacaaagtggtagttaccatcgcgcaaatattaggatatgtactttctaaattcatcggaattaaattaatctccgaattaaaacgggaaaaccggatgaagtttattctgatctccataattctggctgaagcttcgttaatattgttcggactgttgcccgcaccttataatataggagccatgtttctgaacggactttcactgggatgtatgtggggaatcatttttagctttatcgagggaagacgaatgacggacattcttgccagcttactcggagtcagtatggtcatcagctcgggtaccgccaagtcggccggtttgtatgtcatggacactttgaacatcagcgaattctggatgcctgccctgataggcggagttgcccttcctctacttgccttgttgggatatgcactcaaccggcttccacagccaacagccgaagacattgccatgaaatcgaaacgggaaacactgaacggcaagcaacgatgggagctatttaagaatttcatgcctttcctcactctgctctttatagccaatgtggtactgactatcttgagagatataaaggaggacttcctggtaaaaattatcgatgtctctcaatactcttcgtggatgtttgcacaggtagacagcgtagtaaccctcattattctgataattttcggattaatggtgttcgtcagaagcaacttgaaagcactgtcgatattactgggattgatcattgccagcatggtagtgatggcagtcgtttcgtttggttacgaacaattgcagctgaacgccatcgtctggctattcatccagagtctgtgtctctatctggcttttctcactttccagactatcttcttcgaccgttttatcgcttgcttcaaaattcgaggtaacgtgggtttcttcattgctatgaatgattttctgggctatacgggaacagtcatagtattggctgtcaaagaattcttttcaccggacattaactggacagctttctacaatctgatggcaggatatgtgggaataatctgtttcgttgcttttgtatgctctttcatctacctgcaccaacgctaccgcagggagaattacggaaagacaggggtattcagaaaaaaagaagaagaaaaagaagttcccgatttcgtatattaa

SEQ ID NO: 847 - DNA, 609 bp, B.fragilis
tttataaattaccattttaacgacatgacaggattagagatttggctacttgcaattggtttagcgatggattgcctcgctgtctctattgcaagtggtattattttaaggcgtattcaatggcggcctatgctcatcatggcattttttttcggacttttccaggctataatgcctttattggggtggttaggagcaagcacattcagccaccttatcgaatcggtcgatcactggattgcctttgctattctggcctttctaggcggacgaatgatcaaagaatcttttaaagaagaagattgctgccaaagatttaaccctgcaagcctgaaagtagtgataacaatggccgttgcaaccagcattgatgcattggccgtaggagtatcctttgcttttctgggtatcaaaagctgttcgtctatcctttacccggcaggaatcatcggatttgtttctttttttatgtcccttataggattaatcttcggcattcgcttcggatgcggcattgccagaaaacttcgtgctgaattatggggaggaatcatactgatccttattggaacgaaaatattaatcgaacacttattttttaataattag

SEQ ID NO: 848 - DNA, 1074 bp, B.fragilis
aacattagttattggaactttatgaaattattggtaaccggtgctgccggatttataggttcgcatgtttgtaagcgtcttttgcaacgtggggatgaagttgtgggtttggataatatcaattcgtattatgatattaatttaaagtatggacgcctttcgagcttaggtgtttctcaatctgaactgtcatggtataagttcacacggagtaatgtttatcctcgatttagttttgtgcggatgaacctcgaggataggcaggctatgcaaatgctgtttgctaatggaaattttgatgtagtaatcaatttggccgcacaagcgggagtgcgctactccattgagaatccatatgcttatgttgaaagtaatatagacggttttctgaatgttctcgagggttgtcgtcacagtcaggtgaaacatttggtttatgccagttccagtagtgtatatggtttgaatggacaggttcctttttcagagaaagatggcatagcccatccggtgagtctgtatgccgcaaccaagaagtcgaatgaacttatggcacatacttatagccatttatataatataccttctacgggtcttcgtttcttcacggtatatggtccctggggtagaccggatatgtctccttttctatttgcggatgctatcttgcatggtcgccccatcaaggtctttaacaatggcaacatgcttcgtgattttacatatatagatgatattgtggaaggtgtcttgagagtggctgattctattccggaagggaaccagtgctgggatgctgaggttgcggatccaagcatgtcctgtgctccctataagatttataatattggtaattcccgtcctgtaaaattgatggattttatacgtgctatagaaatgtcaatcgggagggaagctgacaagatctatcttccgatgcagcccggggatgtgtatcagacctatgcggatacttcttctctttcgcgggaaattggttttcaacccaatacgtccttggaggcgggcgttaaggaaacaataagttggtataaagaattttataatctataa

SEQ ID NO: 849 - DNA, 1068 bp, B.fragilis
aaaaaaattctaaattataaagggttcgtttcgggaggttcttccgagacaatgagttggttatttatacgtaaattaatctgtttgcataaaggtaaaatcaaatttgcttataaagaagaacaaaaactggtgcttattttaatttttcctattgtcatccggcaatcggaaagagtttctgaattctccgggatattatccgtaccggagctctccacagggaatggtgagttgttgtcggttaccggaatgctgccgacagtgaaaacttctgagcagaaacgtccggataagaaaaaagagaaacattctctggtattggttgaaaggaataaggatttgtgtaattatcttgtgcaaatcctgatgaaggagtataagattgtgtctgtttgtgatgcggaggcggcctttgagactgtgtgtgaacaatgtccggatgcagtactggcttcttctgttcttacccgtatttcgggtgaggaacttgccgttcggattaaatcggatgacagagtagcacatattccggtaatattgttagtgaaaccgggagaggatgaccggtacattcaacggaatgccgatctttatgtgtggatgccttttgccatatcatctttaaagactgagattgcagctttgattgctaaccgggaaatgatccgtaagaggtatattcgtttggccttggggggtgaggcctcggaccctatcgataaagaggtagagtcatcagaaggtgatcaggagtttattcgtcaggtgagaagtctgattgaagagaggatgaccgattccggatttaagattggtgaactgagcgactgcatgaatatgagtcgttcgagtttttataataagattaaggagataaccggacatgctcctgcggactatgttcgtaatgtgcggctcaacagagcattggttttgttaatgagcagaaagtatacggtggctgaggttgcggatatgacgggtttcagtgatcctaaatacttcgggatcgtgtttaagaaatattatgggggctcaccgacgaagtatataaacaatttatag

SEQ ID NO: 850 - DNA, 492 bp, B.fragilis
atcgtcgcctaccaactgacagcgatccccgatgcgttgagtcaatttcttccagccttcccagtcattttcgctcataccatcctcaatggaatcaatcggatattcgttgataagtttttccaaatagtcaatttgttcgtcagctgtacgttttttgcctttttcaccttcaaatttggtgtaatcgtaaataccgtcatgatagaattcggaagaggcgcagtccatgccaatcattacatctttgcccggttcgtagcctgcagctttgatagcggcaagaatagagttaagtgcatcttctgttccttccaggttgggagcaaaaccgccttcatcaccaacagctgtactcagaccacggtctttcaatacttttttcaaagcatggaatacttcggcacccatgcgcaacccttctttaaaagaacttgcacctaccggacggatcataaactcctggaaggctatcggagcatcactgtgtga

SEQ ID NO: 851 - DNA, 960 bp, B.fragilis
cttatgtactatctaataatcttagttctgctattcctggcagaacttttttatttccgtattgcggataagtgtaacattatcgataagcctaacgaacgtagttcgcatacccggattacactgcgtggtggagggatcatcttttattttggggagttggcttattttctcacaaaccactttgaatatccatggtttatgctggctttgagtctgataacctttatcagttttatagatgacatccgttctacttcgcaaggacttcgtctggtctttcattttacggcaatggctttgatgttttatcaatgggggctgtttagcttgccttggtggacgatccttgttgccctgatcatttgtactgggattatcaatgcttacaactttatggatggcattaatggcataacaggcggatattcattgatcattctgatagcattggcctacataaataggatatatgtcccatttgttgaaccggaccttatttatactatgctttgcgcagtattggtctttaatttttttaatttccgcaaacaagcgagatgttttgccggtgatgtcggttcggtcagtatagcttttgtaatcctgttcctgatcggaagtttaattatcaaaacagagaattttggctggcttatattgcttgctgtatatggagtagatagtgtgttgacgatcgttcatcgattgatgcttcacgaaaatattggtttgcctcaccggaaacatttatatcagataatggctaatgaactgagaataccgcacgtagtagtatcgttggtgtatatgattgcgcaaattataattatcatcggatatttatattgccaaaattatggttattggtatttattgggctgtatcctcttgctgagtggaatatatattgtttttatgcacaaatattttcacttgcatcttttatctaaaagataa

SEQ ID NO: 852 - DNA, 771 bp, B.fragilis
attttatctcttatctttgcgccctcaaacagagagaaagtgaacttaattatcgatattggaaatacagtagccaaagtagcgcttttcgaccggacttctatggtagaagttgtttacgactctaatcagtccctggattccttggaggctgtttgtaataagtatgatgttcggaaagcaattgttgctacggttatagacttaaacgagtgtgtgctggctcagttgaacaagcttcctgtccccgtcttatggttagacagccatacgccgcttccggtaataaacttgtatgaaacccccgaaactctcggttatgaccggatggctgccgtggtggcggcccatgatcagtttccgggtaaagacattttggtgattgatgcgggtacttgtatcacttacgaatttgttgattctttgggacagtatcatgggggcaatatttcgcccggactctggatgcggctgaaagcactccatcaatttaccggacgtttgccgttggttcatgccgaaggacgcatgccggatatgggaaaagatactgaaactgctattcgtgcaggtgtaaagaaagggatagaatacgaaattacagggtatattacggctatgaagcataaatatcctgaacttttggtttttttaacgggcggagatgatttttcttttgatacgaaattaaaaagtgtcatctttgcagatagatttttagtgttgaaaggattaaatagaatattaaactataataatggtaggatataa

SEQ ID NO: 853 - DNA, 672 bp, B.fragilis
tttattatgtataccattattgtatcgaaagagttaaaagaagcatgtcctgtttttgcaggggctgctatatatgctgaagtgaaaaacacttcttattgtgaagggctttgggaggagattcaatctttcacagaaatgctcactgcaacaacccggttggaagatattaaaaaacaacctgtgatagctgccacacgtgaagcctacaaacgctgcgggaaagatcccgggagatatcggccgtcggccgaagcgttacgtcgcagattgatgcgggggattgctttgtatcagattgatactttggtcgatttgattaatctggtttctctccggaccggacattcgataggtggttttgatgctgataagatagcgggcactggcctggaactggggatcggtaagatcaatgagcctttcgaagggatcgggcgtggtgtgctgaatatcgaggggctgccggtgtaccgggatgctgtggggggaatagggactccgaccagtgataacgaacggacaaagatggggctggaaacaacacatatattggctatcgttaatggctataatggtaaagaaggactgcaggaagctgccgaaatgatacaaactttattgaaaaaatacgctgactcggacggaggaacaattacttactttgaataa

SEQ ID NO: 854 - DNA, 1044 bp, B.fragilis
atatacgtgtattggacagtaatgatgaatatattagtaacagggattcatggctttgtgggttctaacttggttgaagctttaaaagagaattgtatcttttatgggcttgatattgtttctcctgctaaagagggagttgtaactactttttcttggctagatatcgaacccacatcttttccttttcaaactcttccccaattcgatgccattattcatcttgccggaaaggcccatgatacgaaaaaccaatcagccgctcagtcctattttgacatcaataccggtctgactcaaaagatattcgacttctttttggagtcttctgccaagaaattcattttctttagttcggtgaaagctgctgccgatagtgtagtaggagacgtgcttaccgaagacgtgattccgactccggttggtccttatggggagagtaagattaaggcggaagaatatataaaaaatcattttatgtttccaactgtttctattagtgaggatcggtctttgcggttggagaaagagaaggggaggatacccaagaataaacaggtgtatattcttcgtccctgcatgattcacggaccgggaaataaagggaatctgaatttattatataatgtagtgaaaaaaggaatcccttggcctcttggcgattttgataatcgccgttcgtttacttcaatcgataacctttgttatgtgattgaggggcttttgaatcaggatgtgcttacgggcatctaccatatgggagatgatgaagctctttcaacgaatgaactgattggcatcatgtgtgaagcaatgggaaaaaagccgcatatctggaagatgaacaaaagggttatggaaggatgtgccggcctgggtactttgatgcatttacctttgaatacggaaagacttcgtaaactgacggaaaattatgtggtaagcaacgctaagatcaaggccgctttgggtattgataaattacctgtaacggcaaaagaaggattgatgaagaccattcgttcatttgaagaaactaaataa

SEQ ID NO: 855 - DNA, 1029 bp, B.fragilis
tatagagatttatatagctcatggatagaggctttagcgatttatgttttttacgacaaacctatcagatgtggcaaagttacacattgtctttctaatgggattctattttatttgcagtatatttctgtatatttgcattcggaatccaaatggatctttatggctattttagaacgaaaaattatacatgagattgatacctcatgcagtcatattatctatccgcaatttgtgttaccccgacacaagcatgcggaatacgaaattatgctcttcactcaagggagtggaaaacagtttgtaggagaaggagtcgcggactttcaagaaggggatattgctttgatagggagcaatgtgcctcatctgcatctttgtaattcaaaactgaatcctgttgcgaatactgtatgcagtgccggagaagccttacagtttcttccggacatatttcctgtacatgtagaaaatttgcctgattatcaagagatttatcgtctactgagaaaaagtcaatatggcgttcgcttttatgataaagggttgtatgatgaggtcaaagaattgtttcaggagatggatctcttaaaacatactaatcgtttgatcactatattacgtatcttggggagactgactgaatgtcggaatattaaattactttctgatgtagcctacaatggttctaataggcttctggaagtgaatgaaccggtcaataaagtgtatacctatttatttaatcattttaaagagaaagttctcctgcaagaagtggctgattatgtaaagcagaatccttctgcactttgccgttactttaaacaacggacagacaaaagtatttttcagtgtctggcagaaatccggatagaacatgcttgtaaattactgtcatattcaaacttgtctgtttcgcaaatagcttttgagtccggtttcaacagcgtaccttattttattaagcagtttcagagtatcactgaaaagactcccggtgagtatagggaattgataggcagataa

SEQ ID NO: 856 - DNA, 1089 bp, B.fragilis
aatatttatcatttaaagcatattaacatgaaggtattgtatatcggatacgataagaagttagttaaaagtggagctgatcaaattgatattaggaatttagagctattgtatgatagtattccatatgtaaaagtattgccggttttagaaacacgatctttttataaacgttatttatttggaattgattctcttttgatccaaaaagtatttgctgaattacaaacaggtgattatcagttggtatttgtcagtcagtctttgatgggtaggatttcaaagcatattaaatgtgatttccccaatattaaaatcattacattttttcataatattgaaaagtattatgctttagaacttttgagagtgtcaggctttactcattatcttttttatttggccgcaagttatttcgaatttcaatctgtgaaatattcagattatctaatagtcttaaatcagagggagagtaatttgttacaaaagatatataataaaagtgctgacttgattttacctacttcatttaaagaccaatgtagtaaaatagaaaattgtaatataagaaaagaatttgtttacttatttgtcggtgctgcgttctttgcaaatattcaaggtataaaatggtttatttctaatgtgctccctgaagtacatggaaaattaattatcgttggtaaagggatggatttgtatagagaagaattcgctagtgaaagagttgaagtttatggctatgtacaaaatttatcagagtattattctatggcttctgttgttatatctcctatattttctggtggtggaatgaaaactaaagttgcggaggcatttatgtatggaaaggttgttgttggtaccaaagaagcatttactggatatgtcaattgttctggagttatgtatgaatgtaatgacaagtatgcatttgtgaaaatactaaatgagttatttgtagataaaacacatactgtgtttaatagtaaggctcgtgaaatatatttgcaagaatatagttacgaatcttcatatagtaaattttcaagatggatttctcctattttgaaattattgaataaatga

SEQ ID NO: 857 - DNA, 1401 bp, B.fragilis
ataatgaatcaagacacaatttgcgccatagcaaccgctcaaggaggagccatcggaagcattcgtgtttccggtcctgaagctattaccatcaccggccgtatttttaccccggccaaatccggaaagctgctgagtgaacagaaaccttatacgcttactttcggccgaatttataacggagaagaaatgatagatgaagttcttgtcagtctcttccgggctccacactcttatacaggggaagacagcactgaaatcacctgtcacggatcatcttatattttacaacaagtgatgcaactactgattaagaacgggtgtcgcatggcgcaaccgggagaatatactcaacgagcgtttcttaatggtaaaatggatttaagtcaggccgaagccgttgccgacctgattgcctcttcctctgctgctacccaccgtcttgccttgagtcaaatgcgaggtggctttagcaaagaattgacaactctacgtgagaaactgctgaacttcacttcaatgattgaactggagctggacttcagtgaagaagatgtagagtttgcggaccgttccgccctacgccgactggctgacgagatagaagaagtcattgcacgtctggccaattcgttcagtgtagggaatgtcataaaaaatggtgtaccggtagctattatcggagaaaccaatgcaggaaaatcaactctactgaatgtcctgctgaatgaagacaaggctattgtaagcgatattcacggcactacacgggatgtcatcgaggatactgtgaatataggtggtatcactttccgttttatcgatacagccggtatccgggagaccagtgatacgatagaaagcctgggtatcgaacggacttttcaaaaactcgatcaggcagagattgtactgtggatgattgattcggctgacgcaatttcacagttaacactgctctccgataagattcttcctcgttgtgaacacaaacaattgattttagtctttaataaggtagaactgataaatgaaactcagaaaaacgaacttacctcacaattttctgagcatataggttcggaaatagaatctatttttatttctgcgaaacaacgtttgcacacggatgaactccaacagagactcgtagcagccgctcatttaccaacagtcacccagaatgatgtcattgtaacaaacgtccgccattacgaagcactaacacgtgcgctggatgcaattcaccgggtacaagaaggattggacgcaaatatctccggagattttctgtcacaagacatacgcgaatgtattttccatttatccgatatagcaggggaagtgacaaatgatatggtgctgcaaaatatatttgcgcatttttgcatcggaaaataa

SEQ ID NO: 858 - DNA, 648 bp, B.fragilis
atcagcagacaaatgaataagagaggctttgtaagcaggatcttacagaatttccggaagcctgaaggttttttcggaagaatgatactttgggggatgaatacaggacatgcatcattggcgcaatggggaatgtcatgtttgcaatggcaaccggaatggagtgtactcgatatcggttgcggtggtggtgccaatttgctacagatattgcaacgttgcccgcaagggaaagcatatggcatagatatttcatcggagagtgtcacctttgcgcgtaaaaaaaataaaaagtatctcggtacacgctgctttatcgagcagggaggagtccaccgacttccctatcctgattatgcgttcgatgcggtcactgctttcgagactgtctacttctggggtaacctgcagcatgcttttacggaagtggcgcgtgtgttaaagcccggtggatcgtttcttatctgttgtgagataagcgatcctgccaataaggcttggacgggacttgttgaagggatggagattcattcctgtgatgaactgaaggcgattctttccaaaagtggttttaccgatacggccatattccggacgaaaaaagaagaactgtgcctggtaagccatcggcagactgtgcggttgtaa

SEQ ID NO: 859 - DNA, 1569 bp, B.fragilis
aaaatgagacaatatgtattattggcttgtctctctccggtagcatgcctgatggctgctaccggtcagaagggaggaaaagccaagcaaaaaatcaatgatcggcaacttcctaatgtcgtgtttatctatgccgacgacctcggttatggcgacttggagtgttatggtgcaaagaatgtgcagactccgaatgtaaaccgtttggcagctgaaggtattcgctttaacaatgcgcatgctacggctgctaccagtactccttcgcgttactctatgcttaccggagaatatgcctggcgtcgtccgggcactgatattgcagcaggcaatgcagggatgattatccgtcccgaacgctatacgatggctgatatgtttaagaatgccggttacgctacggcggccatcggcaaatggcatttggggttgggcgataaggatggagaacaggattggaatgctcctctgccgactgctttaggagatataggttttgattattcttatataatggctgcaacagccgatcgtgttccgtgtgtctttatagaaaatggtaaagtggccaattatgacccttctgctccgattgaagtcagctatcgtaagccgatcgagggggaaccgttgggaaaagatcacccggaattgctgttcaatctgaaatcgagccatggacacgacatggccatcgtcaatggtatctgccgtatcggatatatgaaagggggcggcaaggctttgcggaaagatgaaaatattgccgattcaatcacttcacatgccatcggctttatccgtgagcataatgacgaacctttctttatgtatttggctacaaacgatgtacatgttccccgtttcccgcacgaccgttttcgtggaaagaacccgatgggattgcgtggagatgccatcgtgcagttcgactggagtgtaggccagatcatggaaacccttgataaactgggactgtcagaaaatacgctaattattctgtccagtgacaatggtccggttgtcgatgacggctatcaggatcgtgcggaagaattgctgaacggtcatagtcccgcaggaccgttgcgtggtaataagtacagtgcttttgaagggggaactcgtattcctgccattgtaagatggccgaagggagctgcttcatcacaggtttccaacgctttggtctcgcagatcgactggtttgcctctttggcttcattggtaggagccgggctgccgaagggagcggcacccgatagctttaactacctcgatacttggttgggcaaaaaccagtccgaccgatcctgggtgatagagcaggcttccaatcatacattatcagtccgcaccaaggactggaagtacattgaacccaatgacggaccggccatgattacctggggaccgaagatagaaaccggaaatctgagtacaccgcagttatatcacgtggtagacgatgtggcagaacagaagaatgtagcttctctccatccggatctggtttttgaactccagaatatattaagacatgtccggatgaaaaacctgaagccctaa

SEQ ID NO: 860 - DNA, 252 bp, B.fragilis
gttcctgagcaacaaaaagttgcccaggattttgccatgtcagaattttcacttatcttagtgttgcaaaaagaaaacaagcaaaactctaatatgacatggcaaaaatacaaattaaatctgagaaactcacaccttttggaggaattttttcaatcatggagaaatttgactccatgctttcacccgttatcgactcaacactgggtcagagatgcagcagtatcttcggatatcagttcagcgagatag

SEQ ID NO: 861 - DNA, 375 bp, B.fragilis
gcctccattaatgatgttcatcattggtacaggcaatacatacgtattcgtacctccgatgtatctgtaaagaggaatatcgagatagttggcagcagctttagctacggcaagcgaaacacccagaatagcgttggcacccaatttggcttttgtctttgttccatccaatgccaacatggcatgatcaatgcctatttggtcgagggccgacataccgatcagatgcggagcaatgactttattgacgttctctactgctttctgtacacccttgccgccataacgatgtttatcaccgtcgcggagttcaagcgcttcgtgttcaccggtcgatgcacccgatggaacggatgcacgtcccataatgcctga

SEQ ID NO: 862 - DNA, 552 bp, B.fragilis
cgaacgattaatgaaacctgtacgatgaaaaaattaataaaactggtactcttcctgatggtagcctatccactaacgggtgctatcctttcggcttgctcggaagagagtgattgctccatgaccggacgcccgatggtctacgccaaaatgtatatcatcaatccggaaaccaaggctgtactgaatgacaccctcgattcattgagtgtgacagcattcggaactgattcaataatcatcaataaccagaaaaaggtacatgatatcgctctcccactacgctatacaagtgactcgactattcttgtgtttcattacacccggttgttaagagacacaatggtgatcctgcaaaccaatactccttactttcagtcgatggattgcggatacagtatgaaacaaaatatcatcagtattcatccgattgattatacggaaaccaataaaaagaaatatcatagcatagactctctatatatcaaatcaaatgcagctaacattaatggaacagaaaatctcaaaatattctaccgctacaatcgttag

SEQ ID NO: 863 - DNA, 246 bp, B.fragilis
gctacagataaaaaaatagacaacattgctatcaatccaaaatcagctggagaaactaatctagctataacaatggtcaatataaagcgtaatgcttgccccgacattttctcaacagcattccacattaaactatttaatgctgccaattttaaatttttaatcatcatatacaatcatcatctccaagttattaacaatataaaagcattgatcattcaaaaatacaatcaatatttagtatag

SEQ ID NO: 864 - DNA, 966 bp, B.fragilis
tttataagtaaaatggatatatctgttgtcgtaccattgttcaatgaagaagaatccattccggagctttttgcctggattgaaagagtgatgaaggccaacggcttttcatacgaagttatctttgtaaatgatggtagtaccgaccgttcttgggaaattatcgaagagcttcagaaacagtcgtccactgtgaaagggatcaaattccgacgaaactacggaaaatccccggctctgtactgtggctttgaacgtgccgaaggaaatgtggtgatcacgatggatgccgacctacaggatagtcccgatgaaataccggaattataccgtatgattactgaagacggatatgaccttgtttcaggctataaacagaaaagatacgacccgctgtcgaaaactctacctaccaaactatttaatgccacggcacgtaaagtttcagggattcataatctgcacgactttaattgcggattgaaagcttatcgcaaagctgttgtaaaaaacatcgaagtatacggagagatgcatcgctacatcccgtatctggctaagaatgccggattccagaaaataggcgaaaaggtggtgcaccatcaagcacgtaaattcggaaaaactaaatttggaggatggaatcgcttctttaacggatatctcgatttaatctctctttggttcctctcaaagtttggaattaaaccaatgcactttttcggtttattaggctcattgatgtttatactgggattcatttcagtggttattgtcggagccagtaaattatatagtatgaatcacggtatgccttatcggctggtaacagattctccctatttctatctgtcgttgactgccatgattattggaacacaactctttttggcaggatttcttggcgaactgatttcacgcaacgccccggaacgcaataattatcagatagaaaaaataatataa

SEQ ID NO: 865 - DNA, 798 bp, B.fragilis
agtgattgcaaaaccatatcctctggagaagctgaaagaaacgatcgaaacttatttataggagggaggaatagtcggtctttcaatgcaacaatttatcatatagtatgttctgtagtaaataatgctataaagataaattggattatgaagaaagtagtactaatcggggccagcggcttcgtcggttcggctattctgaatgaagctttgaaccgtggattccatgtgacggcggtagttcgtcatcctgaaaagatcaagatagagaatgaaaatctggaagtgaagagagctgatgtttcttcattggatgaagtatgtaaggtttgtaaaggtgctgatgccgtgatcagtgctttcaacccggggtggaataatcccgatatatacaaggaaaccattgaggtttatctgacgattatcgatggtgtaaaaaaggctggagttaatcgttttttgatggtgggtggtgccggttcactgtttattgctcccggcatccgactggtcgattcgggagaagttcccgaaaagatattgcctggtgtgagagccttgagtgatttttatcttgattttctgaagaaagaaaaagaggttgactgggttttcttctcgccggcggcagatatggctcctggagtacgtacaggcagatatcgcctggggaaagatgagatgattgtggatatggtaggtaacagtcatatatctgtggaagattatgcggctgccatgattgatgagcttgagaagccggagcatcatcaggagcgtttcaccatagggtactga

SEQ ID NO: 866 - DNA, 876 bp, B.fragilis
agtgacggcaaaattcaatatcggactttcaatgacaacaacctcaagaacggcaaggtctatgatgtcgattttgaagccgcacagcaaacgcaggcaccaaccggaacgctcgtagcccgctaccggccgatcccttcgttgagtgatccaaaatactattcacacttcaccctctcaaagttccgcaatggaaccttccaactcctcaactacgacgaaggtgacgtagatatgggtggaggagccacctggtcgaacttgctgaagaatggtgcacgcctggacacaggatactatatgatggtaaccggtactcgcatggcaagcggagctgtattggctaatgtgactttcttcaccattgaagagggaaagacaacaactgtcgatctggtcatgcgcgaaagcaaagaccaggtacaagtaattggtaattttaattccgaatcgacttatctgcctataggaacctccgaaccgcaaagtattcttcagacttgtggccggggatactacgttgtagcagtgctgggagccggacaagaacccactaaccatgcccttcgggatattgcagctttaagcggtgaatttgaaaaatggggacgcaaaatggtgttgctcttccctagtgaagaacagtacaaaaagttccgcccgtcagaattccccggattgccttcaaccattacctatggtatcgacgtagatggagcgatccagaaacaaattgccgaatcgatgaagttgccaaacagcaccatcctgcccatgtttattatcggtgatacattcaaccgggtagtcttcgtgtcacaaggttataccatcggattgggcgaacagttaatgaaagtaatccatggattatag

SEQ ID NO: 867 - DNA, 717 bp, B.fragilis
ataaagttaaattatagtgttgcggaattaaggataacaaacgaatcatatatgaagccaacaatcaaaaaagtacaacccgtcaaagtcgtagctccgttccttaacagtcagtccgaaagtccggtcccactggatgcacttaccgaccaagagaaagtttccgatttgtacttccttaagggaaccgtacatcaaatagctaaaccttacctaagtattaataattgcactttcaaacaacaaatattcagcgaatgtcagtttaaatcagctcaactgacagacgtacgttttgaaaattgcgatttatccaacgtttcgtttgccggaactactttctaccgggtagaatttatatcttgcaaattgctgggaaccggtttcccggaagccaccctcaatcatgttttaatggatcattgctacggacaatacatcaatctctccatggtaaaaatgcgaacagcccgtttcagccattgcaatttccgaaacggcagcctgaatgacagcaaactgatgccggcagcttttgatacttgcgaattgttagaagccgacttttcgcacacttcactcaaaggtatcgacctgagaaactctagaatagcaggtattcaactcaatatagccgatctgaaaggagccatagtcagttcgttacaagcaatagatctgttacctctactaggggtcaaaatagaagacgattga

SEQ ID NO: 868 - DNA, 462 bp, B.fragilis
aaagagctaaaagatatgaaacttagtcagcaatcacaagccattatcgaatctgcgattcaaaaagcaatcaacaaatatacctgtggatgcgaacagaccatcgtcacagatatccatattcaaccgaatcagaattccggtgaactctttatctatgacgatgaagatgaagaactatccagtgtaaccatcgatgaatggacaacctacgaaggggacgacttttacgaagatgctgaaagaattttccgtaccgtgctttgccgcatgaaagagaacgggagcttcgataagttaaccatcctcaaaccctactcctttgtgttggtagatgaagacaaagagacgatctcagagcttctgcttgtagatgacgacacactgttggtgaacgatgaactattgaagggactggacaaagaattggacgacttcctgaaagacctgttggagaaataa

SEQ ID NO: 869 - DNA, 1236 bp, B.fragilis
aaaacaataaatcttgatagtatggaaagtatagactttggaaccctgtttcagggatttggaacaatgatagccagcggatggtttctggccagtgcccgtatgtttttaatagctttggggtttctgctcatttatttaggctggaaaggggtactcgagccaatggtgatgattccgatgggcctgggaatggtagctattaattgtggaacactgattatgcccgacggaacattggggaatctttttttagatccgatgctgtcggataccgacgcattgatgaacacgatgcagattgactttctacaaccggtatacacattgacctttagtaacggattgatagcctgctttgtatttatgggaatcggtacattgcttgatgtgggattcctattgcagaaaccgtttgccagcatttttcttgctttatgtgctgaattgggtacattcttgacagtgcctattgcttccggtctgggactgtctttaaaagaaagtgcttcagtggcaatggtaggcggagctgatggtccgatggttttgttcacatcgcttgctttggccaaacacttgtttgtacctattacggtggtggcttatctttatctgggattgacttacgggggatatccttatttggtgaaattgctgattcctaaacgtctgcgtgctatcaagatggtagaaaagaaagctcctaaaaattatgatgcgaaagtgaagctggctttttctgcaatcctgtgtgcagtattgtgtttcttgtttccggttgcttcaccattgttcttttcgctattcctgggagtggcagtacgtgaatccggtatgaagcatatatatgattttgtgagcggtccgttgctctatggttctacttttatgttaggattattattgggtgtactttgcgacgcacatttgttactcgatccgaagattcttaaactgttagtattaggtatgcttgctttgttactgtcgggtatcggaggcatcatgggagggtacattatgtatttcattaagaaagggaactataatccggtgatcggcattgcagccgtaagctgtgtacccactacggcaaaagtggctcaaaagttggtaagtaaagataatccgaattcttttattttgggtgatgcattaggagccaacatttcaggagtaatcacttcggccatcattacaggcatttatataacgattataccttatttataa

SEQ ID NO: 870 - DNA, 1533 bp, B.fragilis
actaagcaaaaatctctaatgaaaaatttctggaagaaataccataaatgggtaggtttattctttagcttttttatcctgatgttctgcttttccggtattgtactcaatcatcgtacactcttttcaaaagctgaagtcagcagaaactggatgccggaaagctatcactacaaaaattggaataatggaatcataaagggaacactacgcctacccgatgggaaaattctggcatatggtaatgcaggagtctggaaaacagactcctgctttgctacatttgccgatttcaaccgaggtctggccaaaggaatcgacaatcgtaaaataagtaatatcgtccgtgtagccaataacgatatctggtgtgccggattatattctatctatctcctggaccatgacagttggaaagaatatccgatagccggcaatgacgaacgaatctcagatatcactcaacgtggggataccttagtcatattgacacgctcttatctttatacgggtgtttctccttatgacgaattccggaaaacagaattgaaaacaccggaaaactattccccaaagacctctttgttccggaccatctggctgctgcatagcggagagttattcggtacccccggcaaactggcagtcgattttctgggagtagtattaatcgttctcagtgctacaggaatcatatacacccttcttcccccattcattcgccggagacacagaaaaagacttcctgtcaagacacaggcaaaggctctgaaaacttcactgaactggcacaataaattgggtacatggttgatcggactgaccctattgctatctgtcacaggcatgtgtctgcgacctccattaatgataccttttgttctggtcaatacccggcctgtccccgggagtacactcgattcggataatccctggcacgacaagcttcgcagtattcgttgggacgcatcccggaatgtctggctgttatcttcgtcaatgggattctaccggataaacgatttacaacttccaccggttaagttaaaacaaactccaccggtaagccctatgggagtaaatgtatttcatccccaaagtccggacgaatggctgatcggatctttcagtggcctcttcgtctggaatccttccaccggcaccgtcctcgattattatacgggacaacctcctgcagccgttcacggacgaccactcggcggcagtctcgtcaacggattcactgacgatttagttacccgtgaagtaatcttcgaatacgacaacggagcacgcaataaagagaacaatttagtattaccggcaatgccggaccttataaaacagcaacccatgtcgttatggaatttctgtttggaacttcatgtcggtcgttgttattccccattcttaggtgttttttcagatctattcgtttttatttccggccttctgctaacgttaatccttatttcgggatatatcgtatataaaagacaccataaacgaagcaaaaaaataaggatgcattaa

SEQ ID NO: 871 - DNA, 1929 bp, B.fragilis
  unsure (1889): Identity of nucleotide sequences at the above locations are unknown.
agataccgaaagattaaagtagaaaacagtaattccggaaagatgaaacaaaaagagaaagaaatcaaaactaaatatatgaaccaaaagcattcactcccccctctccttaagagaggaacgggggtgaggccttacttaacaacaaattgtatgaaaaccctaacccgctttctaatcattccgatgttgtcggttgcgttcttttcatgcagtgagtcccatttcctgaaagatgtggcttaccgaaaccaagtgacgcaagattttgaaatgaagaagcagcaacttcccaatggagagttgtttgcagtgtttaatgaaaagctcaccattcccgaacaagaggctttaatgttcctctatgcctacatgcctacaggtgacgtaacagattatacaggcgactactatctggaaaatgtcagactctccgatcaggcacgtcgggaaatgccttggggaaaagaaatccccgatgacgtattccgtcattttgtgctccccattcgggtaaacaatgaaaacctggatgactcacgccgggtgttttacaatgaactgaaagaccgtgtgaagaatctgtcattacacgacgctgtactcgaggtaaaccactggtgccatgaaaaggtaatctacaccccaagtgatgcccgtacgagttctccactcgcttccgtaaaaaccgcttatggtcgctgtggtgaagaatccaccttcaccgtagcagctcttcgctcggtaggtattccggcacgacaggtatatactccgcgttgggcacataccgatgacaaccatgcatgggtagaagcctgggtagatggcaaatggtatttctttggtgcctgcgaaccggaaccggttttgaacctgggttggtttaatgctcccgccagtcgtggtatgctgatgcatacaaaggtattcggacgctataccggacaagaagaaatcatgtacgaaactccgaattatacagagatcaacgtgattgacaattatgctccgactgccaaaggttccgtactcgtgacagatgccgaaggtcagccggtagccgatgctaccgtagagttcaaggtctataactacgctgaattttatacggtggccaccaaacatacagaccggagcgggcatgcatcattgactgccggcaagggtgatatgttggtatgggcctccaaagacggacggttcggttattctaaactatcattcggcaaagacaatgaactgaagatcacactggacaaaaacgccggtgaaacctattcgcttccactggatatcgttcctcctgccgaaggcgccaacctgcccgaagtgactccggaacaacgtactgaaaatgatcggcgcatggcacaggaagattctatccgcaacgcatacgtagccactttcattaccgaagagcaagctcggacttttgccaaagagaataagctggatgaaaccgaaacagtacgcttactgatagcttccagaggtaaccaccagactttaaccgatttcctttctgatgctgtaaaagccgataaggccggtcaggctatcagcctgctgaaagtagtctcggccaaagacctgagagacgtaagcccggaagtattgaacgaccatctgaataactccggcctgcccgcttctgaagatttctgtagcaacgtactgaacccgcgtgtagccaatgaaatgatcactccttacaaagcattcttccggaaagagattccggcaagtgaagcagaagccttccgcaaaaatccacaagctttggtagaatggtgtaaaaaagagatcacaatcattaacgaattaaactcacaacgtataccaatgtcaccattgggtgtatggaaaagcccgggtagcaaacnaaaaaatcccgtaccatttctttgtatccatggcccgtag

SEQ ID NO: 872 - DNA, 1296 bp, B.fragilis
agatgccgaaaaggcaaaaacagattctgtaaactaactatgagcatcattatttacctgttgattacgatggcattttctgctttcttttcgggaatggagattgcttttgtttcggtagacaaacttcgttttgaaatggaccggaaaggaggggtatcatcacgtatcctttcgctattcttccggaatcccaatgattttatttcgaccatgctggtcgggaataacatcgctctggttatctatggtatattgatggcacagattatcggcgacaatttgctggccggatggatcaccaatcattttgtaatggtattggtacagaccgtgatctccacactgatcatcttggtgacaggagagtttctgcccaagacgctttttaagatcaatcccaatctggccctgaatgtctgtgcagttcttcttttcatctgttatgttgttctctatcctatatctaaattttcgtcgggagtctcttacctctttcttcgcctgtttgggatgaaagtgaacaaggaagcctctgcgaaagcctttggtaaggtagatctggattactttgtccagtcgagtatagacaatgctgaaagtgaggaaactctggacacggaagtgaaaatctttcagaatgcactcgacttctcggcggtcaagatacgcgactgtatcgttccacggacagaagtggtagctgttgcgctggatacatcccttgaagaacttaaaggccggtttgttgagtccggtatatcaaaaataattgtctacgatggtaatatagataatgtggtgggatacattcattcgtccgaaatgtttcgtagcccgaaagattggcgcgatcatgtgaaagaagttcccattgtgcctgaaacgatggcggcccataaactgatgaagctgtttatgcaacagaaaaagaccattgccgtggtagtggatgaatttggaggaacttcgggtattgtcagccttgaagaccttgttgaagaaattttcggtgacatcgaagacgaacacgacaacacttcctatatttgtaagcagatcggtgagcatgaatacgtgctttcagcccgtttggaaatagaaaaagtaaacgaaacttttaatctggagcttcccgaatccgatgactatctaacggtgggaggattaatcttgaatcaataccagagctttccgaaattgcacgaattggtctctgtcggtaaatatcagtttaagataattaaggttacagcaacgaaaatcgaacttgtccgactgaaagtaatggaataa

SEQ ID NO: 873 - DNA, 1500 bp, B.fragilis
aagaagagaaaaaaggtttatttccaattaatttgtatttttgaacttctgaataataacccaagaccatttatgaagaaaaaaaatatcctattctttctattatgctttctcctgacaagcctatcggcacaaactttggaacaagcaagaggcatgtatggcagagggcaatacgctgaagccaaacctgtttttcaaaaatatgtcaaatcgcaaccggcaaacggtaattacaacctatggtacggtgtgtgttgcctcaaaacaggtaatgctgccgaggccctaaaatacctggagacggcagtaaagaaacgcattccgagcggacaactatatctggctcagacttataatgatttataccgctttcaagatgcagtagattgctacgaagaatacattgcagacttgtctaaacgcaaaaaaccgacagaagaagccgagcagcttttagaaaaggctaaaggaaaccttcgcatgctgaaaggggtggaagacgtatgtgttattgacagttttgtaatagacaaagccaatttcctcaaagcttataaaatcagtgaagaatccggaaagctcttcacttacaatgactatttcaagacgaaaggctatcatccgggaacagtttacgaaacagaaatcggaaaccgtatttactacagcgagcagggagaagagagtctgaatattctgtctaaaaccaagatgctggacgagtggagtcagggaaaaccacttccaggaagtatcaacgcctccggaaatgccaattatccgtatgtcctgtcggatggagtgaccatttattatgcctcggatggtgatggctccatgggaggatatgacatttttgtaacccgatataacacaaacactgatacctatctggtaccggaaaacgtgggtatgcctttcaactcaccttataacgactacatgtatgtcattgatgaatataataatttaggatggtttgcttctgataggtatcaacctgaagataaagtttgtatctacgtattcgtacccaatgattctaaacgaacttacaactacgaagctatggaaccggaaaaaatgattgaactagcccagctccattctctagagagcacttggaaagactctaaaatagtggatgatgcccgtcaacgacttgaagcggttatcaaccataaaccggctgtagaacaaaactttgattttgaatttatcattgatgaccactctacctaccatcacttaacggatttcaagtctccaaaagccaaacaactgtacctgaaatatgaacagatggaaaaagattaccgccagcaaaccgataaactgaagagccagcgtgaaggattcgcacggtctaataaagacgaacaaagtaaaatggcaccggctatccgcgatcttgagaagagggtacttcagatgtcagaagaactggataaacaggctattgaagtccggaatgcagaaaaacaaaacttaaaataa

SEQ ID NO: 874 - DNA, 552 bp, B.fragilis
tcattactgaaactttttcttacgaacgtagtcttggagacaacagatagcgataaacattggtatgtcgtactgacacgaactaactcagaacgtaaagttcgggattattttcaattgcaggaggtagatacctttcttcctgtacaaaaccgtgtcatagagcgtgaaggaaaacgcattgagcgtgagcgccttttgttgccccgtatggttttcgttcatatctcccgtcaggaaatggctgccgtccgaagtacactgaatgtatacgatttccttcgagatcgttctaccggggctcctacctgtatccctgatgcgcaaatggctgattttcgctatatgctcgattactcccaggatcaggtgatcctgacaggagagtccattcccaaaggtactcgtgtagtagttgccaagggcgatttacaaggcttgcggggagaattggtccgctacaataataaatatcatattttagtacgtatcgatatgttcggtagcgctatggttacaattccggctagctacgtccggaaagagaaataa

SEQ ID NO: 875 - DNA, 1497 bp, B.fragilis
gatacaatgaaagcaaatgatttactatcccaatttggtgatcatcgccaaagagttcaaagcgccattacctccgtttgcgaaggaagagggattcttctggtagatgacgaaaaccgagaaaatgaaggagacctgatcttctctgcccaaagtatgacagaaacagacatggccataatgatacggcattgtagtggcattgtttgtctgtgcatcacggaggagaaagcccgacaactgaacttaccgttaatggtggagcaaaacaccagtaaatatggtaccgcattcaccatttcgatcgaagcagcagagggagtgaccaccggagtatcagcagccgaccgcatacagactatccggacggccattgcccccaatgccactcccgaatctcttcatcatcccggacatatattcccattgatagcccgttccggcggaatcaaagaacggagcggtcacaccgaaggcagcatagatctgatgaaactggcaggacttgcaccctgtgctgtactttgtgaattgaccaatgatgacggaactatggcgcgcttacccgaaatcatagaattcgggctagaacacaaatatccggtagtgacaatcaatgatttaaaagaatatcagacagcccccgacttccttcccaagctggtaggctccttctcttgtccggcagccgaaaatccgactactgccattatggaagcagcattccgtcaccactatatgcactacagatatatcaactgtgaagtcggtcccgaaaatctggcggctgccatacagggtgcaaaagccatgggatggagaggattcaactgctctctgcctaacaaggtggaaatcatccgatacttggacgaattaggagaatcggcaaaaatcatcggtgcagtgaatacagttgtcattggagacgatcagagggctaccggagaaaacacagatggaaaaggttttgtaaaagccatttcggaaattatcaccatccaagacaagaagattgccttgttaggtgctggcggtgctgcccgtgccatcgctgtcgaaatggctctggcgggagtgaaagagatcactatcttgaacagaaacagagacaaaggccaggcattggcagatttactgaacagccaaacggttgcaactgccagatttgtactttgggaccatccttatcggttttccacagatatcgacattgtcatcaatgccacctcagtagggctttatcccaacgtagaccaacgcttggacatagacacagataccttattgccacatatggtagtagccgactgcatccccaacccggtatacacccaactgttgagagatgcggtccgccgcggttgttgtcatgtattgcccggaatgaaaatgctggtctatcaagcggtcattgccataaaatactggtcaggagttgatgtcgatccggatataatgctggaaaaattaaaagaagtagtaaaacctgcttag

SEQ ID NO: 876 - DNA, 327 bp, B.fragilis
tgtaagatgaagagtttaaaatatatagtagcattggcattggcggcaggactgtttcaagcttgtgatttagagcgctatccactgacagacttgtccgaagagactttttggaatagcgaatcgaatgcggaattggcattgacttctctgtatagaggaagcctgacagacggcgtagagtataacccttcggattggtggtcctatcacggaatgattatgatggagcatctttcggataacgcttttgaccgtcggggagagaacaatcctttctttaagatttcgagtggaaaccctgactgcagacaatgcttttattaa

SEQ ID NO: 877 - DNA, 921 bp, B.fragilis
tttgtggtgaacatatttattaaactaaaacctttcaataacatgaaaaagtattttccttcctccgaattaattatcaacgaagacggttcggtattccatttgcatgtaaagccggaatggttggcagacaaagtaatattggtaggtgatcccggacgggtggcactcgtagcttctcacttcgaaaataaagaatgtgaagtggaaagccgcgaatttaaaacggttaccggaacttacaaaggcaaacggataactgtcgtttctaccggtatcggttgtgacaatatcgatatcgtggtcaatgaactggatgctttggcaaatatcgacttccagactcgggaagaaaaagagcatctccgctctttagagttagttcgcatcggtacatgcggaggattgcaacccaacacaccggtcggcacattcgtctgttctgaaaagtcaatcggctttgacggactgttgaacttctatgccggacgcaatgctgtttgtgaccttccctttgaacgggcatttctgaatcacatgggctggtccggtaacatgtgtgctcctgcaccttatgttattgatgccaatgcagaattaatagaccgtattgcgcaagaagatatggtgcgcggtgttactattgcagccggtggtttcttcggaccgcaaggacgcgaactccgtgttcccttggcggaccctaagcagaatgataaaatcgaaaagtttgaatataaaggttacaaaataaccaacttcgaaatggagagttccgcccttgccggcctcagcaagctgatgggacacaaagccatgaccgtttgtatggttatagctaaccgcttgatcaaagaagcgaacacaggctataagaataccatcgatacattaattaaaactgttctcgatcgaatctga

SEQ ID NO: 878 - DNA, 1161 bp, B.fragilis
gacaaaaagaagatgaatatagtttttgtaggactttctggagttccatatgcgcgtagagctattgacacaagattactctcatttgcaaacttgtttacttcatcgaatcacgatgttgtaatattaaatcgttattcggcattgaaacctaattgggaatatgatgctcaatttattgatgatagagttagtgtaatagaactttgtaatttgaagggaatacccaaatgtatgtcaaagttcttattaatttatacaataataattgaattctggaaacttatattcttgaataagaaaaagaaaatagatgttctccatgtggcttcaggacattttatagatattttctattatgttataattgcacgttgtataggtgctaaggttgtttatcattattgtgaatatagatcttcctttaaatcaagaaatgtataccatcggattaatggtaaattgatcaattgctatgctccgaagttttgggacggtgctatttgtattagtcattttttggtatctaagacaaaagaagttaataaatttattaaaataattcaaatccctcccatctgtgattatgattattttgatcatattatttgtgaaaaagaagcctctccttatttgcttttttgtggctatacaagctattctgagataatttatatgataatagacgcttataataaatctaggattaaagaagtggcttcattaaagatggtaataaatggtaatcctgtagtgatttctgagattaggagatattgtcctaaaatggagattcttcaaaatttaaaatatacagatttgatttctatgtttaagggtgctttagctctatttataccactgagaaataccattcaagatattgcccgatttcctaataaaatatgtgaatatacagcgtgtcatggcgtagtggtgacaactcggtatggggaaataccttattactttgaggataaaataaatgcattgattgcagatgattttaacgtggcatcaatagccgaacagttagactggctatatgacaatatggatcagacagcacgaattaaaaagaactcttatttattggggcgtagagttttcaatttaatttcttataaagattctgtgacagaatttttaaaagagttgtag

SEQ ID NO: 879 - DNA, 210 bp, B.fragilis
aaagccaacgaatcagctgcagaggcaatcaactttatcaccccggcaacgaaaaaaccaatgacgaaggtaagccccatcatggcaaaagtggataacaataagctaaacataacacagtatgattttagattgaaaaataaaatgcaatgtataccgaccgccggaaaatacaagacgcacctccccggcatttatcggaatggataa

SEQ ID NO: 880 - DNA, 903 bp, B.fragilis
atcatgatagaacaaccttccccaaaagtatatgatgaacttctttccatctgggaagaagctgtccgaagcacacaccatttcctgaccgaagcagacatacaattttataagccgctgatccgacatgaatatcttgccgcagtccgattgtacatcattcgcgaagattcaggaactattgcagccttcatgggattaagtaatgattgcatagaaatgttgtttgtccgtccgaatgcccatggacatggctacggtagtcggctggttgaatttgccattcggaaaaaacgaatctataaagtagacgtaaacgaacaaaatgcagcagcactgggattctatttacatatgggatttgagactaccggtcgcgatgcattggatgcaacaggtaagtcattccccattttacacctgcaaattcctcccatccgactccgaaaagcaactcttgaggatatagatctgcttagaaccctatttacacaaagcgtgcagaatacctgttcggctgactataacaggttacaaatccaagcatggaccggacggggaactctacaacgttggcatgaactgtttcaaagcgacctatactttctgttggcagaagacagcagaaagtctcaagtggcaggattcacatctgtcaactctaaaggatatctgcatagcatgttcgtacatcccgactatcaacgccagggaatagcttcgcgcctattgctaaaagcagaagagtatgtccgtatccggcaaggcgtatctgtctattcggaagtgagcatcactgcccgcccattttttgagaaacacggctatagtatcgaaaaagaacaaacagtatctgttggtgacatagaaatgactaatttcttgatgtataaacgaatttaa

SEQ ID NO: 881 - DNA, 192 bp, B.fragilis
gaatggtcagagtgtgaacggagttttatgcgtttgtttaaccgtatccaagcaagtatacatgatatctattgggaaaatcagtgtacagaccatctcatgacagatgaattgcgaagagaggagggggaacctttactgctatctgtggcagatgttatggaaattttagttcggaaaattttgaaataa

SEQ ID NO: 882 - DNA, 1305 bp, B.fragilis
aaaacaagagaaacaatgaaaatagaaaaaattacaggacgagaaattctcgactcaagaggtaaccctacagtagaagtagacgtagtattggaatcaggcattatgggacgtgcatccgttccatcgggtgcatcgaccggtgaacacgaagcgcttgaactccgcgacggtgataaacatcgttatggcggcaagggtgtacagaaagcagtagagaacgtcaataaagtcattgctccgcatctgatcggtatgtcggccctcgaccaaataggcattgatcatgccatgttggcattggatggaacaaagacaaaagccaaattgggtgccaacgctattctgggtgtttcgcttgccgtagctaaagctgctgccaactatctcgatattcctctttacagatacatcggaggtacgaatacgtatgtattgcctgtaccaatgatgaacatcattaatggaggctcacacagtgatgctccgatagccttccaggagtttatgatccgtccggtaggtgcaagttcttttaaagaagggttgcgcatgggtgccgaagtattccatgctttgaaaaaagtattgaaagaccgtggtctgagtacagctgttggtgatgaaggcggttttgctcccaacctggaaggaacagaagatgcacttaactctattcttgccgctatcaaagctgcaggctacgaaccgggcaaagatgtaatgattggcatggactgcgcctcttccgaattctatcatgacggtatttacgattacaccaaatttgaaggtgaaaaaggcaaaaaacgtacagctgacgaacaaattgactatttggaaaaacttatcaacgaatatccgattgattccattgaggatggtatgagcgaaaatgactgggaaggctggaagaaattgactcaacgcatcggggatcgctgtcagttggtaggcgacgatttattcgtaactaacgttgacttcctggcaaaaggtattgaaaagggttgcgctaactctatcctgatcaaggttaatcaaatcggttcactgacagagacactgaacgctattgaaatggcacaccgccatggatatacgacggtcacttcacaccgctcaggcgaaacagaagatgcaaccattgcagatattgccgtagcaaccaacagcggacaaatcaagaccggttctctaagtcgttcggaccgtatggcaaaatacaatcagctgcttcgtattgaagaagagttgggagaccgcgctgtatacggatataaacgaattgtagtaaaaggctaa

SEQ ID NO: 883 - DNA, 543 bp, B.fragilis
ccggttatggataccattcagataaaagataaactattcactgtttctatcagggaacaagagattcagaaagaagtgattcgcgtggcgaacgaaattaatcgtgatttggcaggtaagaacccgttgttcctcagtgtgttgaatggctcgtttatgtttactgccgacttgctgaaacacattacgatcccttgcgagatctcttttgtgaagctggcttcttatcagggagtatcatctaccggttccattaaggaagtgatcggtattaatgaagacatagcgggacgtacgatcgttattgtagaagatattgtggatacgggactgactatgcagcgtctgctggaaacattgggaacacgcggaccaaaagaaattcatattgcttcgttgctggtgaaaccggataaactgaaggtggacttgaatattgaatatgtggcaatgaatattcccaatgatttcattgtaggatatggtctcgattatgatggtttcggccgtaactatccggatatttatacagttgtagactaa

SEQ ID NO: 884 - DNA, 477 bp, B.fragilis
caaactatggatgtactgatcatcattgcactgatagccgccgcagtaatactctttttagttgaactgttcgtaattccgggtatcagcctcgccggtatttcagctttggtctgcattatctatgcaaactattatgcttttgctaacctgggaacaggtgcagggtttataacacttattatatcgggaattgcctgtatcggttcgcttgtctggttcatgcggtcgaaaaccttggataaattggcattgaagaaagacataacatccaaaatagaccgaagcgctgccgaaaaagtaaaagttggcgatacaggtatcacgattacccgactggctcaaattggcaatgctgaaatcaatggcaatatcatagaggtcaagtcaatggacggattactgaatgaaaaaactccgattgttgtcaatcggatcactgatggaataatctttgtcgaaaaattaaaatcctaa

SEQ ID NO: 885 - DNA, 528 bp, B.fragilis
aagaatatggattggaataaaaagataatgcgaatttcactgctggttttcacactggtagtaggaatttcgtgtactgtttcttataagtttaatggtggtaatatcaattacgataaggtaaagactatctctattgccgactttcctattaagtcggactatgtttatgcaccgttaggcactaagttcaacgaggacctgaaagacattttccttcgtcagacccgtctgaaactggtgaataacaatgccgacctcgagattgatggagagattaccggatataaccagtataaccaggctgtttcggccgacggatactcttctgaaaccaagctgaccatcacagtgaatgttcgttttgtgaacaatacgaatcatgaacaggacttcgagcaacagttctcggctttccgtgtttatgattcgagggagttgctaacagccgttcaggacggactgattgcggagatgactaaagagattacagatcaaatatttaacgcaacggtagcaaactggtaa

SEQ ID NO: 886 - DNA, 1068 bp, B.fragilis
aataaaccggaaatgaaaaagctaattatactgacagggctgttactctctacctcggcttatgcccagaccgaagttacagcgggagttacccggggaaaagattacggtgtaacctatgcacttcctaaaacagcaatcaatattgaagtcaaagtcaataaagtgacatatactccgggagaattcagcaagtatgccgaccgttatctccggttgaccgatgtgtcgggtgagcctcaggaatattgggaactggtcagcgtcaaagcaaaatctgtcggtatccccgatagcgaacatacctattttgtcaagctgaaagataaaacagtagctccgctaatagaattgaccgaagatggtatcgtaaaatcaatcaacgtaccgctatctcctaaaaaatcggctccgatgcaacccgccacgacacagaaaaagaagataaatccacgtgattttctgaccgaagagattctgatggcaggttctacggctaaaatggcggagttggttgccaaagagatttataacattcgtgaaagtaaaaatgccctggtacgcggacaggcagacaacatgcccaaagatggggagcaactgaagattatgctcgccaacctggaagagcaagaggctgccatgaccgaaatgttctcgggtaccttgaataaagacgaaaagatattcaacatccgcctcactccggataaggaaatggacaacgaagtagctttccgcttttcgaagaagctgggcatagttgccaataacgatcttgcaggagagccggtttatatcacgctgaagaatctgaaaaccgtcaacgtaccggaagacgatggcaaaaagaaggtggacggcattgcctataatgtgcccggcaaagcacaagtaacactaacggaggggaaaaagcaatggtttaacggagaacttcctgtcacacaattcggtaccatcgaatatctggctccggcgcttttcaataagaaatcgactgttcaggttactttcaacccggatacaggaggcttgatcaaggtagatagagaagaaggagaataa

SEQ ID NO: 887 - DNA, 3054 bp, B.fragilis
acagagaaggaagatacagaaatgaaattaaaattcaaacatcagaagtttcaggaagacgcagcaaaagcggtatgtgatgtctttggcgggcagccatacaagacgttcgactatcaagtagagacccggaagaaagacggacagaccagctttgaaaagtttacaggattccgcaaccaccctatcgtacctcaactcacagatgagatcgttctgaaacacatccgggatatccagcgtgcccaacaaatcaaaccgtcggaagcgctggaagggaaatacaatctcaccatcgaaatggagacgggtgtaggtaaaacgtatacctacatcaaaaccatctttgaactgaacaaacgctacggttggtgcaagttcatcattgtcgtacccagtgttgccatccgcgaaggagtccacaaaagcctggagattatgaaggaacactttgcctcggattacagcacccctctgtcttatttcatctacgactccaaacagttgggtgaattgaacgcatttgtcacagacagcaaaatccatgtaatgatcatcaattcacagaagttcaatgcaacgaataaagatgcccgccgcatctacatgaagctggatgattttggcggaaactgtcccatcgatgtgattgcgcagatgaatccgatactgattatcgacgaacctcagtcagtagaaggagccaaaacaaaagagggattgaaacgattcaatcccctgttcacactgcgttattcggctacacaccgcgaactctataatctggtctatcgcctggacgcaatggaagcttacaacctgcaactggttaagaagatcgctgtcaagggtatctctatcagtgggacaacagctactgaaggattcgtttatctggaaggtttgaacctgtatccggacaaaaacccgactgccaatatcggattcgaaataaaaagaaccaaagcagtgaatcaggtagtacgagctctgaagataaatgatgacttgtatgctaaatcaaaccatctggaagaataccggaacgactatgtaattacagatatcaacggcgttgaagactccgtcaccttccggaacggcatcaaactttatgcaggtgacgtagcgggtagcgtcaacgaaactcaactacgacgtatccagatacgggaaaccatcttgtcacacatagaaaaagaacaggaactgtttgagaaagacatcaaagttctctcccttttcttcatcgatgaagtagccaaataccgccggtataacccggacggaaagggagaatatgccgagattttcgaacaggaatataccgatatcataaagcacctggatccttcgttattcaatcagccggaatatatcgattacctgaaatcgactgtggcatcgaaagctcacgaaggatacttctccaaagataaaaaaggaaaactgattgacagtaaaaccgagcggggaaccaaagaatcggcagatgaagatgcttacgatttgattatgaagaataaagaacgtctgcttgaccggaaagagccgatccgctttattttctcacattccgctctgcgggaaggatgggacaacccgaatgtctttcagatctgtaccctgaaacaaagttcggcagaggtacgcaagcgtcaggaagtgggacgagggctgcgcctctgtgtaaacggacagggagatcgcatggacgccaacgttttaggcgaagaagtgcatcgtgtcaacctactgaccgtgatagccagcgaatcgtacgaatcgtttgccaaaggcttacagacagaaatggcggaagccatagccgaccgtccacagaaagtaaccatccaattattcaaggaccagtcgctccgattagctaacggtgaaaccatcatagccaccgaagatatagcacaaagtatctacgactctttacttgaaaacaagtacatcaagaaaggagaactgacagacaaattctatgaagaccgtaaacagggagaagtgattttcgacgacgagctcaccgattataaggcgtctatcatgaccatcctggcctctatctataatccaagggagatgcagccgaacgatgcaaggaaaagtaagataaatcttcggttgtcaaaagataaacttgaaaacagcaaacttcaggaactgttaaaactgctatgcagtaagtcaacctacaccgtaaagtttgacgaaaaagaattggtagagagagcgatcgaaagtttaaatgaaaagttaagagtatcccagctctatctttctgtcattacaggccaaatggaaaaaatcaagtccaaagcagctttaatttcgggagaggcatttaaggtagatgccaatcaggcgcactatgaaaagatagatgccatggcaaacgatcaagtaaaatatgacttgctcggtaaactcacagacgccaccaatctgacccgacaggcagttgctcagattctctcccggataaaaccgaatgtattcggccaattcaaaaacaatcccgaggattttattatcaaggcttcggaactgattaatgaagaaaaagcatgtctgatagtaaaacatatcgaatataccccaatcgaccagtactatgatgtatcggtctttacccgggcaactattcaggggcgtttgggagtaaacacaataaaagcagataaacatctgtacgatcatgtgagattcgactcccaaaatgaaaaaacattcatggaaagactggaagaaaatgacgaaatagaagcttatgtaaaactacccggcaatttctatatccctactccgatgggaaaataccatccggactgggccatcgtcttcaaacaaaagttatcgaagtatccttattttattgccgaaaccaaagccagcgattcctccctacaagatcggagaatagaagaggcaaagatcgaatgtgccaaaaaacattttgcgaagacaaacggtgggaagcttaaatataataaagtaagctccttcgaagaactcttgaaaatcgtcacacaagaatccgtttaa

SEQ ID NO: 888 - DNA, 1251 bp, B.fragilis
tcaggaagggagtttagtgcgaatatgacaaaagcggaaatacaacaggtaaaactaaggttcggtattattggtaacactgaagctttgacgcgtgcgatagatgttgccatacaggtggcacctaccgatttgtccgtgctaataaccggagagagtggtgttggtaaggaaagtttccctcagatcattcaccaatacagtcgccgaaagcatggacagtatattgctgtcaactgtggtgctattcctgaaggaaccatcgattcggaactgttcggtcatgaaaaaggggcttttacgggagccattggtgagcgaaagggctattttggtgaagccgacggcggaactatttttctggatgaagtcggagaattgcctttgcccacgcaggcacgtttgcttcgtgtactcgagagtggggagtttataaaagtaggctcctccaaagtacagaaaacggatgtccgcattgtggctgctaccaatgtcaatttgacccaggccattgcagagggacgtttccgtgaggatttatactatcgtctcaatacggtgcccatccagatccctcctttgcgggagcgtggagaagatgtgctgttactgttccgtaagtttgcaagtgactttgcagagaagtatcgtatgcccgccatacagctgaccgaagatgccaaacgggttttgctgtcttattcctggccgggtaacgtgcgtcagttgaagaatatcacggagcaaatctctataattgagaccaaccgtgagattaatgcccctatcttgcaatcttatctgcctgcccagagtacgcagcgattgcctgccctgtttggtgtaaagacagggaagagcttcgaaagtgaacgtgaaatcttatatcaggtcctttttgacatgcgacaagatgtgaccgaactgaaaaagcttgtacacgaaattatgtccgagcgcggagcggtaacctccaatgtcggtacgttttatacgccggctccggtagtagcccctacgccctcagtgcctgccatcattcatccggtcaagcccaattgtcccgatgacgatgacatacaagataccgaagagtatgtggaagagtcgctttcgttggacgaagtcgagaaagaaatgatacgtaaagcccttgaaaagcatcatggcaagcgaaaaagcgcggcaaaggatcttaatatatccgagcgtaccctttaccgaaaaataaaagaatatggattggaataa

SEQ ID NO: 889 - DNA, 1410 bp, B.fragilis
tttctgagtttaaatattacaatgacagaacaattgaaaaacaaattgagtgactccaaaacacttcgttggagtgtgctcgctctggtcgcgtttactatgctttgcggctatttcctcaccgatgtaatgtcccctttaaagcctatgctcgagaaagagcttctctgggatagtttggactacggattctttaccagtgcttacggatggttcaatgtattcctgctcatgttgattttcggtggtattattctcgataagatgggagttcgtttcaccggtatgggagcttgtatactgatggtgttgggttgtggactaaaatattatgctatctctactactttccctgaaggtgctttgattatgggtttcaagactcaggtctttctggcggctttaggatacgctatctttggtgtcggcgtagagattgccggtatcactgtctctaagattatcgtgaaatggtttaaaggcaaagagatggctttggctatgggactcgagatggctaccgcacgtatcggtaccactttggctatggtgcttaccgttcccattgccgattatttcggctatacggatgaaagcggcagtttccataccaatattccgatgcctattttgttgtgcctgatcatgctgtgcatcggtactatcgcctttttcatttataccttttatgataagaaacttgacgcttctttagatgctcagggagaagaaccggaagaaccgttccgtatgaaggacgttatgctgattgtcaccaataaaggcttctggctgattgctttattgtgtgtactattctattctgctgttttcccctttattaaatatgcaaccgacctgatggtgcagaagtataacgtagaccctaaactggccggaaatattccgggattactaccgataggtaccatcttcctgactccgttgtttggtactctttatgaccgtatcggtaagggagcgacgttgatgattatcggtgccgtcatgctgattggtgtgcatactttgtttgcgcttcccattctgaacgtatggtggtttgccactgtgattatgattgttctgggtattgctttttcactggtgccttcggccatgtggccttctgttccgaaaattattccggagaaacaactgggtactgcctatgctttgattttctgggtgcagaactggggattgatgggggtacctctgttgatcggatgggtgttgaatacctattgcaaaggtcctgttgtggatggagcgcagacttatgactatactttgcctatggctatctttgcttgtttcggtgttttggctctgattgtagctttaatgctgaaagcggaagacaagaagaagggatacggactgcaggaagcaaatatcaaaaaataa

SEQ ID NO: 890 - DNA, 813 bp, B.fragilis
atgatttcactcactgacgatagaaaaatgttggggtatgggctgttgggcgcataccccaacatttctcattttgtaacgacccgtcacggcggttatagtgagggggcgtatgcttcttttaattgttcacctttttcgggagatgaacttgaaagggtagagaagaatcagacgttgttgtttcaatcactatcgcaagctcctaggcatttgattattccttttcagacacacggaacgaaaatacttccggtcgatgaaaaatttcttggagcttctgggcagcagcaacaggaaatgctaaacgggattgatgcgttgattaccactgagccgggatgctgcatttgtatttccacggcagactgtattccggtattgttgtatgatagagtacatcatgctgtagcggctgtgcatgccgggtggagggggacagtggagtatattgttggacatacgcttgagaagatgcgggctgtttttggaacggaaggacaagatgtaatcgcatgtatcggtccgggtatctctctacaatcattcgaggtgggggatgaagtttatgaagcttttcgtttgaatggttttgatatgtcgcgtatctctttcaggcattcggttacacataagtaccatattgacttatgggaagccaaccggcaacagcttttggattttggagtaccgggagtacaaattgaaatagcggatatttgtacttacatccggcatgaggatttcttttcagcgcgaagattgggcataaagtccggacgtattttgtcgggcattatgataaatagctga

SEQ ID NO: 891 - DNA, 1263 bp, B.fragilis
tgcgaaatttgggtttacttctgctttatgtatactaaaaaatttcttgtttttgataaaaataccatatttattatattaatattgttattttggttatttgctccatttttgacgatatttctagttcttttattattctgtaaacgactttccatatgtcaatacaagtgcatgtttttagtgatctctatgtcatttgctttattagcatatactcaaaagtctctgttttatcttgatactgatattataagatactataacgcttattatccatttatcgatcagtcttttgatttattctcactaatgtttgtattagagaataatcttacattttcgtttaatttaattaatgttcttttagtgtgtacttttgctaatgttcagataatttctattttttgggttttttgtatatactatttttattttctatctttacttaagttatttgagcatgaaggcatatcaatttctcctataaatatattattagttacttttatttctatttttggatttatcctttttactcaagtaacagatactataaaaaatgctgcttcatttgctattttcttttatgcatttatctgttttatatgtaatgaaaataaacttaagattattttattatacattataggggttggcatacatagttcaattctgatgttgcttcctttgtttttatataaaaaaataaatacccaaatattaatattactttttatactagctgtattaatatcttctcgcataaatataatgagtttgttttctattattcttccagatgttgggtttggaagtttattgttgaagaaagcggaaacttattctattgttggtgatgctcaatcttctatcagatatattggtatttcttgcgtaatgttgttgtctgcaatatatctttcaataaataaattgtttaatgtaagtaataaatatatgaacataatatttatatatttaattattatgtacttaaattataataatcctgatggatatatccgatttgctaattttgcccatttcctttttttatttgaatttatccaattgttacgtgataaaaagagatatagtctagtgatttttttattcatagttgtttttattgttacaaatttccaaatgacatattctaggacattgtctggtgggtattgttcgagctatatgaataattctatttttcagattttattctctaatgtggtagaatatttatcatttaaagcatattaa

SEQ ID NO: 892 - DNA, 1191 bp, B.fragilis
tgctttctctgtctgaggagtactttctatgatatattggacaatatttttattatgattagaatattaataacaggagattattgtcctagaaataggattgatgatctgattaatctaggaaaatatcagtctgtttttgaagatattattcctatagtgaagggacatgattattctatagtgaatttagagtgtcctgttgttgagcatgacgattgtgctattaagaagcaaggtccaaatttgtcttcgtctttgagagctgtagaaattttgaaattattggattttaatcttcttaccttggctaataatcatttttatgattatggagacggaggtgttaagcatacacttgaatgttgcaaaaatttggatttagattttgttggtggtggtgagtctttatctgcagctcgagctattaaatttaaaaatttgttcggaaaacgttttgcatttatcaatgtttgtgaacatgaattctctatagcaacacaaacgactggtggctcaaacccattgaatcctatatctaattattatgatatacaaaaagctagagcaacagctgattatgttattatcatagtgcatggaggacatgaacattatcaattgcctagtttgcgtatgcaagagacatatcgcttttttatagatgctggagcggatgttgtggtaaaccatcatcaacattgttttagtggttatgagatttataacaataaatatattttttatgggttgggtaatttttgctttgataatcctgttaaaagaaatagtatttggaatgaaggatatatgttaagtcttaatttttctgactatggaaagattgatttctctcttataccatatatacaatgtgatcagttgcctaaggttcgtttattgaaggaaagtgaaaaagctgttttttttgataaaatttcttctttaaataaaattatccagagtccggatatgttgaaagactccttttatgctttctgtatgaccaagaggcgtttatatctgtctttatttgaaccttatccggggcgttatctcaagtatatttatcgtatggggtatttaccatcttttttattttctaaaacaaggttatttatccaaaactttatggactgtgaatctcatcatgatattgtgaaagaagtgataaagataaatcgaaaatga

SEQ ID NO: 893 - DNA, 183 bp, B.fragilis
gaaatattatgggggctcaccgacgaagtatataaacaatttatagaccgacagaagaccggtaagggagccaccttgccggtcttcattttattaactaatccggtcgactggattgagagaattactcttatctttgctatccgaaaggagaactgcgatgcagaaggattgcagagatga

SEQ ID NO: 894 - DNA, 1575 bp, B.fragilis
atgaaaggactattaacctccatactgaccgtacttacctttaccggactgcaagcccagccacttccatctaccccgaaattagtggtaggtctcaccatagaccagttacgtacggactatctcgaagctttttcaacactgtatggcgacaggggattcagaaggctctggaaagaaggacgtgtgttccggaatgccgaatatactttcagtggcacggaccgcgcatcagccatagccgctatttatacaggcaccactccttcggtcaacggcattatcggcaaacgatggatggatgtatcgacactgcgtactgtgagttgcgtcgacgaccccgctttcatgggcaattatacaaacgaaagctcttcgccttcccatctcctgacctctacgatagccgatgaactgaagatagccacccgtaacgagggattggtatatgccatcgctccattccgcgacgctgccattcttgcagcaggacatgccggaaatggcgcattctggctcaacaacacaaccggaaaatggtgtggaacgacctattatagcgagtttccatggtgggtaagccagtataacgaccggaatgccatcgacttccgcattgctgatatgacatggactcctgtccatccggtacaaagctacagtttccttcccgaatggagagatgctgcttttaaatacaaatttgacgacgatcgtgtcaataaatacaaacgactgattacaagcccttttatcaacgacgaaatcaatacgctgacagaagaactgctggataagagcacgatgggcaaagatcatgtccccgacatgctggcactgacctactatgcaggcaactacgcccataagagcgtacaggaatgtgccatggagatgcaggatacatacgtacgactcgatcggagcatcgcctctttactggacatcattgacaagaaagtgggtctgcagaatgttgttttctttattacctccaccggatataccgataccgaatcacccgacctgggactctaccgggttccgaccagcgaatttcacctgaaccgctgcgcagctttgctgaacatgtatctgatggctacctacgggcagggacagtatgtggaagcgtactacgatcagcagatttatctgaatcacaaactgatcgaagaaaaacaactgaatctggcggatatacaggaaaaagccgccgaatttttgatccaattcagcggagtgaatgaagtatattccggcaaacgcctgttattggggtcctggacaccggacatctcgatgatacgcaacagtttccaccgtaaacgctcgggcgacctgctgattgacgtattgccgggctggagcatcgtcaacgaaaatacatccgaccataaggtggtgcggaaagcgcatattccgtctccccttatttttatgggcagcggcgtaaaaccagccgtaatcaacacgcccgtaaccattgaccacatagctcccaccgtagctcacatattgagaatacgatctcccaatgcctgttcggcaactccgattaccgacatccggtaa

SEQ ID NO: 895 - DNA, 549 bp, B.fragilis
aactgttctcgatcgaatctgatgaatttatcatttgccgccattgactttgaaaccgccacaggatacatggaaagtgcttgtgcggtaggtatcgttaccgttacagacggagagattacagacgaatattacagcctgattcaaccaccggagaatgaatattggcgtgcaaatatgcttgtacatggaataacgccgggaatgacagagtcactcccgggatttcatgccatctatcccgaagtcaaaaagcgtttacaaggcaacgtagtagttgcgcacaatgaacaattcgaccgcaatgtactgaagaataccatgcggatgtacggactggattatgatgagttatcgcttccggaacgttgggaatgtacctgccgcatctatcgttctttaggatacaagccggtcaacctaagcgcctgttgcgaacgggaaggcatcgaacttaaacaccacgaagcactttccgatgcccggggatgtgcaaagctatatctcaatttccttgaaaaataccgtccgctcagtaccctatggtga

SEQ ID NO: 896 - DNA, 408 bp, B.fragilis
ttattaacgctaaatcaaaataacaaaatgtacttattattagttatcttaatggttattgcagccatactgatgtgcttcattgtgttgattcagaactcaaaaggcggtggtcttgcttcagggttctcatcatctaaccagattatgggtgtacgcaaaactacagactttctggaaaaagcaacttggggcttagctgcatttatggttgtgatgagcattgctactgcgtatgtcgttccgacttcttcttctaaaacacaagatgtcattatggaacaggcacagcaggaagagcagaccaacccttataacctgcccgtaggtactactgcaccgaagacagacgctgctgctccggttgaagcacctgccacagaaactccggctactccggcaaactaa

SEQ ID NO: 897 - DNA, 1266 bp, B.fragilis
ttttaccctagaataaccgaaaggaagacgtttttttattatttttgcatcactttattaaccctaagagatttcacaaatatgaaaagacacgtcttccttttggtaaccttgtttaccatgagcactgttgcagctcaacaacaaccaattatttcccccaaagactctatcccctctgtgatcgaacgcgtcaccggaaaagagaacaaaggattttccgctcacatgaatctccaattatatacttcatgtgctgcctcttttactgaaaatgagttagatgaagttgctttcaagttaaaccggtttaagctggaaatcataggaaatatcaaccggaagttctcttaccatttccggcaatcttttaataaatacagcaacccctttgctctggataatctgtcctcttccgtagagtatgcttatctgacctatcacctttccgatcgcttttccatcacggccggaaagcaatttcttatgctgggaggctatgagtactatgtcaatccgattaaagtacgtgaattcagcgagtttaataattatgtaaactgctttctggcgggagtatctgccacttggaatgtgactccgactcaagaactcaattttcagatagtcaacaaccgtaacggtggagacgcagatacttaccttcacggcctgccgacagatgtcgaagctaccaaagtacctctgatatcgaccattaactggaacagttattatctggacaaagccattcagttgagatacgccgcttcatggggacagcaggccaaaggaagaaatataatgtatcttaccgcaggcaatgtttacgaaaaaggtccatggatcgcttatatggatttcatgtactcccgacaaggaatagataataaaggcattatcagcgccttacctcgcatagacttggaaaacccgcagacagcccaacataccgagtattttaccacgattgccaatgtagactaccgcttccaccctaattggaatgcttacctgaaaggtatttacgaatccggaaaaatttataaagctaacggtatctttgaaaaaggtacctatcgccggacatggtgcggacaagtttgtgtggaatactatccaatgaggaacagcgaactattgatcttcttgcactatcaatacaaacggaataaactattgaaacccgcccgcaatttagatgctatagacccgaatacgcagcggatctcgctagggctggtatattccataccggttttttaa

SEQ ID NO: 898 - DNA, 2697 bp, B.fragilis
caaacaaatagaatgaaatatattatatacttcatgatgatgttgtatggttcattatgtcatgccatcgtttgcaaacacattgtagaaagaagtgaaacgaatactcgtaaagtgtatcagatccaaagggatgctctgggttatatgtggtttatgaaccatgccggaatcagtcggtttgatgggaccaagctaaaacactataaactgccggccgaagggcgaaccatggattattatatgggcaattgccggttgcttacagataatcggaatgggttgtgggtagtcacccgtaatggatatttatggatgtacaatccatcattggataaattcgaatgcaggaatcatctggttattccgaatgatgtttcccttcattttctctgcgtagataacagtagtcatatctggttttctgtcggaaaccggttgatagcctatcaaatactatctaatacttttcatcgggtggatcatagcctggcagcgatttcctgtatggtagaggtggctccgggagagtattttgtaggttcggatgaagggctgttcggaattacaataaagaattatgccgtcgacaggcaaaccggagaattgtccggtaaaagatatagccggatacatgaaatactttttcatccttatacccaaagattggttatgtttgattattcggaaggattaggggtatgggatatgaagtcggagcaattggttggtacttggaaccgattgttgaatagtcgggtcagtggtctgaggatatgggatgaccggactgttttggtagctacagatggtgagggaatatttcgtatggatatcgttaatccggatattacatcttttatacaaactgattttgagaatgataattcaattcgtaccaaccggattgctgacgtgtttgtagatgatcagaaacttatctgggtggcggattatccggaaggcgtatcaatgatcgatgtggaatctcctgatgattataaatggtacagggcacggtccggggacagtcattcactgaccaacaatcgggtaaatgcggttctgcatgattcggatggggatgtctggtttgcaacggatcacggtatcagttgttttcatccgtcgacaggcttatggaaccggattgttacgcctcttccttgtcagatgtatactgcattgtgtgaagtaaagccgggagagatatgtgccgggaactatgtacacggtttgttcttcatccgaaagaaaagtaattattcggttacaccgtatgtacgtatttcgggagtaaacgcattgtgtcgtaaggataaagacggtttttggattggaacggatgaaggggtgtttttttattgtccggaaaacgatagtatcgtggaggtaaaacgcttgtccggtttacacattcatgctttgcatcagtccgatgattgtctttatattgggactgaaggaaacggattaatggtctatcatccggagcatgagcagatggatacggttgctgctttaggaaccggtaatgtatatgctgtttggtcggatgatagcaggcggttaatgggaagcagtgatgggtttgctttctcgctcgatcttgtacaacattcatattacaggtttctgagtaaaggaattcggattacatcgggtactttcttaggtaatggaagatacattttgggcacctatcaaggcgcaattgagtatgataaacaaaaggctcgaccgctgcgtaaagcttgtttgggattttacttggacgaacttcgggttttggacaaagaggtgaccgtcgaaacggagaattctccattgaagaaagctctgaactgtacagctacgttacagttggagcacaatgaaaatactttttcgtttacggctactgccattcgctatactgaaaagcaggatatagcttacagttggaaactcgatcatacggattggagtgctccgtctgtagataatagaattcgtttttcgaaccttcctccgggtgaatatatcttttctgtgcgggcgttatccattgataacggtcggccgtttgcgcaaagaaatatgcacatcatcattcgtcaacccctttggaagacaggtggagctttcctttgttacggtcttttggcacttatgttgggctctctggccgtacgttcatggttcgtatggcaagacagaaacctttcaagagaacaagtacggttgtttgcgaatacgacacgtaacctttgtctaccacttacactgataaaagttcctttggaatatctttatgaaaagtcatcttccgaacttgttagtaacgtattgcaacagataaagggagtgaacaatttattggctgagctggaaaatatcagtcgtgtttctgctgctccggggcgtctgtcgcttgccgactatgagttatccatattcttgaaagagacagtagcccgaattagagattatatcagcgagaaggacattatgctccgttggacggaggagcctgcctttgctaccgtatgcctcgataaggataagatgtctgccattcttagaaacctgttaatggcttttacagacagtatggatcgaggtgacgaaattcttctgagtacttcgtgtaacaatcaaaagtgggagttgaggctggaatctgaggataacggctttcttaaaaaaaaattctaa

SEQ ID NO: 899 - DNA, 783 bp, B.fragilis
cgcaacggtagcaaactggtaattagaatgatttctgctaacttacaacaatggattcagcatccggaaacgctgaataaagatactttgtacgagttgcgaacgcttgtcacacgctatccttattttcagtcactgcgattactctatcttaaaaatctatatttgttgcacgatatctctttcggtgccgagcttcgtaaagccatattgcatgtggctgatcgccggaagctgttttatctgattgagggtgaacgatatattttgaaacctcggaaaaagaacgcacttcccgaaacagaagttttagaggaagagcccagcctcgatcgtacgctttccctgatcgatgcttttctggccaccgtgcccgaagaggtttcagcccagacaagcctggactatgcaacggactataccacctatttgctgcaagaagacgatacaccggaactggaagaaactcccaaacttcgcggtcatgaattgattgacggctttatcgaaagaagtgaagaagaaacatccatccgtttgcaaccggcagatgaaaataaagctatctccgaagaggaagagagcgagacgcatcatgaagaagatgaagatgatagctgtttcaccgaaacattggccaaaatatacgtcaaacagcatcgatattccaaggcacttgaaattattaaaaaattaagtttgaaatatccaaaaaaaaatgcttactttgcagaccaaatcagatttttagagaaattgattattaacgctaaatcaaaataa

SEQ ID NO: 900 - DNA, 252 bp, B.fragilis
aattcaggcagtattttcagtaatagcagttgttgtaagcgggctaatcggtatttatatggcgtatcaccaatttggtgtatgggctttagtcgtacagtccttagtatctgcttttatctcaacagtttccttttggatatattcaagatggatgccattatggactttctctatacaatcatttcaggagttattctcttttggatcaaaattattattagctggagttttacatacaatctattctaa

SEQ ID NO: 901 - DNA, 936 bp, B.fragilis
tattgtgaaagaagtgataaagataaatcgaaaatgaattataaaagaattttgaagaaccagacaacgcgtcttgcgatgttaagagctttgtcttttattccagatgctattatgttaagattgcaatattggataaaaacagggcataaattgaatctaaataaacctcaacgttatactgaaaaaatacaatcttataaatgcttctatagaaaccctttactgaaggtctgttctgataaatatatggtcagagactatgtagcttcaaaaggaatggctaaatacctcaatgaattgtatggcatatatgactctgctgaagatatctgttttgatagtttacctaatgagtttgtaataaaatccacggatggaggaggaagcaataatattattatatgtaagaataaagatgaattaaatatatttgaaacaattaagacagtgaactcatggctaaaattaaatagaaaagttaatccgggaagagagtggggatatttgggaggaaggccaagagttattattgaaaaacttattaaaaatattaattcggaaacttcacttacagattataaaatgtattgtttttgtggacatgtccatagtttatttgttctaacagatagggataaaggtgctaagataaatttctttgatcggaattggaatcctttgaatgtaaaatcagatagttatcctacttctaatcaattaatattgaagcctaaaaattttgatcgtatgatagaaatagcagaggttttatcagaggattttccacatgttcgtattgatctatataatattgatggtaatattatttttggtgagatgactttttattcaggaagtgggtattggggattcgtcccagattcttttgattttgaacttggtcaacagtttgatatttcatcttttatttaa

SEQ ID NO: 902 - DNA, 435 bp, B.fragilis
ggaactatgagcttgcataaatattcgattgttttattggcattattggcgttactctgcagttgccatgatgaagataaaggagatatcccacagtccgatgagcgaaccgcagattttattgtgaaatataaggatgatttcggaatacatacggattataaagctaaggtatatatctattatggaatatattcaatggatattgtaggctttcattatcttccggacggggtgctggatcatgaagggaaagaaataactcctgacatccgtctatctgctgatggaaaagaagatataaccttgttattggataatgctgaaaaggtaacggttattgttgaaagctcctattatgagggaagagtgggaataacaagttactcttcgggcgacacacctataaaagggaatattacgtttggggaatag

SEQ ID NO: 903 - DNA, 912 bp, B.fragilis
gatttaatgagagtatctgtggtaattccctcatataatagggctaagttgttattggagacgattcctacatatttgcaagaggacgtaattgaagttattatagtagatgacgcatcagttgataatacagctgaagttgtaaagaagattcaggaaaaatatccacaagtaaaatatatacgcaatgcggtaaataagaaacaaacctattctaagaatataggaattaaaatatcaaagggggactatatttatttgggtgatgatgatagtattttaatgcctaattctatccgttatttaaaagaaacaatgtataaatataatgcggatatctgtggtgcaaaagctctttatcttccaatggaatatgttaataaaatagatgaatatgttcaacttaatgatattcaattagttgataagaatgagattgttgatataaaaaagataaaagcttcatttaattactctactgcattacctatagttgttcctttttgtcaagcttgcgctttagtcaaaaaagagttagcgattcagatcttattcgatgaaaactttacaggtaatgcttatcgagaagaaacagatttcttcataagatgtactttacaaggagcaaaggtgatgtatgattcacgtgctgtacaggttaacttacctcgtcaagtagcaacagggggagcgcatagtagaggacgcattaaatggtacttatcgacaattgctaataattggtactttcttaaaaagaattggaagaatattcaaagttactataaattctcggataatatttataaaagacaattaatgtttgtattgaaaaatatttgttttgcctcaaaagcagtagttaaaatactaatgcgaaatttgggtttacttctgctttatgtatactaa

SEQ ID NO: 904 - DNA, 192 bp, B.fragilis
tgcattaggagccaacatttcaggagtaatcacttcggccatcattacaggcatttatataacgattataccttatttataaatcatagagttggtgacaagataattttggggatgactatagagaatcattcggtggttattggtaacccggaaagattgaaatctatagtcatccatgtgtttctatag

SEQ ID NO: 905 - DNA, 240 bp, B.fragilis
cggatgaggagtgtaatggaagggataagtaaacaagcggggcaattcgatgccggcaatggaggtctggaaggaatgaaacatgctactttattggatttaaacggattcttgtgtgacgattttcaagagttcttcgaaggagcttactttattatatttaagcttcccaccgtttgtcttcgcaaaatgttttttggcacattcgatctttgcctcttctattctccgatcttgtag

SEQ ID NO: 906 - DNA, 1128 bp, B.fragilis
agcaggaggagaaaactaacaaataacaaaatggaagataacaaaataaaaattggcatcactcagggagacataaatggggtaggatacgaagtcattttaaaaacgtttgccgaccccgtcatgttggaactctgtacaccggtcatttacggctctccgaaagtggctgcatatcaccgcaagtcgcttgatttgcctactaacttcagtattgtcaataccgctgcagaagctgcccacaatcgcctgagcgtggtcaactgtacggatgacgaggtgaaagtagagttctcaaaacccgatccggaagccggtaaagcagctttgggagcacttgagaaggcgatagaggagttcagggaaggcttgatcgatgtcatagtgacggctcctatcaataagcatacgattcagtccgaaggatttgcttttcccggacatacggaatacatcgaacaacgtctggggaatggttcaaaatcactgatgatcctgatgaaagaggatttccgggtagctttggtaacaggacatattccggttcgcgagatagcctcttcaataaccaaggaactgattcaagagaaacttgccatattcaaccggtcgttgaaacaggatttcgggattggtgcaccgcgcatcgcagtgttggcactgaatccgcatgccggagacgacggattgctcggtacagaagaacaggaaatcatttctcctgctattcaggaaatggctgccaagggaatcttgtgctatggcccttatccggctgacggatttatgggatcgggcaatttcacccattttgacggagtactggccatgtatcacgatcagggattggctcctttcaaggcattggccatggatgaaggtgtgaactacacggcgggtttgccggtgatacgcacttctcccgcgcatggcacagcctatgatattgcaggaaaaggcgttgcttgcgaagattcattccgtcaggctatttatgtagcgatcgacgtattccgtaaccgtcaacgtgagaaggaagcacatgccaatccgttacgtaaacagtattacgagaaacgagacgacagtgataaactgaagctcgatacagtagatgatgatatttaa

SEQ ID NO: 907 - DNA, 519 bp, B.fragilis
atgccggggaggtgcgtcttgtattttccggcggtcggtatacattgcattttatttttcaatctaaaatcatactgtgttatgtttagcttattgttatccacttttgccatgatggggcttaccttcgtcattggttttttcgttgccggggtgataaagttgattgcctctgcagctgattcgttggctttttatagttcgcaccaggaagaattggcccggctgaagcgtattcggaaactgcatcagaaagtagctacgttaataactgaaagtgctctgagtgatgaggagtatggcagtgatgggcgtgaagacttcagcaggggggtcacaaaacatcccggagataatcgtgggttttatcatggtgtcagtcccggtgaatcggagagaggtttaatggattatttttatccggaagacacaagaacgatgtttcttcggaaagaagaacagatgttacagcatgataaaaaaaataataagacatcctcaaccaataaaaaacaataa

SEQ ID NO: 908 - DNA, 372 bp, B.fragilis
aatatgaaaggtatttatgctatttcgttgttggtcgtttccaacatttttatgacatttgcctggtacgggcatttgaagctacaggaaacaaaaataatcagtaattggcctttgtatggcgtggttttgttttcatgggtgattgcgttggctgagtattcttgtcaggttcctgccaaccggctggggttcagcggaaacggagggccgttttcattgatgcaacttaaaattatccaagaggtgatcacactgattatatttaccgttttttctaccttattatttaaaggggagtcactgcattggaatcatgtggcagcttttgtctgcttgatagcagcggtatatttcgtgtttatgaggtag

SEQ ID NO: 909 - DNA, 1323 bp, B.fragilis
tctataattatgaagattgctatagttggtacaggttacgttggtttggttacaggtacctgtttctctgagatgggagtagacgtcacatgcgttgatgtgattgaatctaaaattgataatcttaaaaaaggcataattccgatctatgagccgggacttgaagacatggtgcaccgcaattacaatgcggggcgtttgaagttcactacttccttagcctcatgtttggatgatgttgaggttgtgtttagtgcagttggtactcctcctgatgaagatggcagtgcggatttaaagtatgtgcttgaagttgcccgtacgattggtaaaacgatgaaccattatgtactggtggtaacgaagagtactgttcctgtcggcacagcgcaacaggtgaaagctacgatccggggtgaattggataaacgcggtttgaatcttgaatttgacgtggcctccaatcctgaatttctgaaagagggagatgccgttgatgacttcatgaagccggatcgggtagttgtgggagttgagtctgagagagccaaatctatcatggagcgtttgtataaaccgttcatgatgaataattatcgtttgatctttactgatatcccttctgccgagatgataaaatatgcggcaaattctatgttggccactcgtattagttttatgaacgatattgcgaatctttgtgagttggttggtgcaaatgtaaatatggtccgtaaggggatcggtgctgattcccgaataggtagtaaattcctatatccgggttgtggatatggtggttcttgttttcctaaggatgtaaaagccctgataaaaacggccgataagaatgggtattccatgcgtgtgcttaaggctgttgaagaagttaataattctcagaaaagtattctttttaataagttgatcagatattttgatggaaatctttcgggaaagcgtattgcgttgtgggggctgtcttttaaaccggaaacggatgacatgcgcgaggctcctgctctggttctaatagataagatattgtcttgtggcggtcttgttaaagcttatgatcctattgctgttgaagaatgtaaacggcggataggggacagcatagagtatgccaatgatatgtatgatgcggttcttgatgcggatgccttgttactggttacagagtggaaagagtttcgtatgcctagctggggtgtattgaaaaagacgatgaatcgagctttgattatcgatggcaggaatatttatgataagaaagaactgcatgatatgggttttgaatatacgtgtattggacagtaa

SEQ ID NO: 910 - DNA, 2100 bp, B.fragilis
ggaccctctatctttgctgtctcaaaaacaaagattatgatgaaagtaaaattagcattactacttactcttataggaacacttcctttagcagcacagaatgtacggcaagaacaggacacagtctcttatatgaacgatgatcctttcaatcttgaacaaattgtggttacggcaacccgaacagaaaagaagattaagaacacaccggtcatcactcagataatcacctctaagcaaatagaagaaagaggaaccggtaacattcaggaccttctgactcaagaggttcccggacttaactttcaggaggttggctatggaaccagcatcgatatacagggattaggttccaaacacatccttttcctgatagacggcgaacgtatagcgggcgaaaacggtggcaacatcgactattcgcgaatcaatctttataatatcgaccatatcgaaatagtcaaaggagcttcttcggccctctatggttctcaagcgatgggcggagttatcaacatcattacgcgtaaagccaaaaagaaattcgaggcttccgcaggcatacgctatgcaggaagaaaccagcaaaactataaagatactcccaaagatcattcgcaatacaaatatcggattcatctggataaacccaatctgaacaccaatctgtctcttggattgaacctgggcaagttcaccatgaacaccgacgtactttacaaaagtttcgatggataccaattattcgataaaaaacctctcgtgaaatattttccggcctataacaccacaattaccgaagaactcagtaaaaccccgaccagtatatcgggatacgaagacgtacaagtagcccataaaatggactatcgtttcagcaaacggctcaaagtccagttaaaaggaagctattatatgctgaacaaatatgattttcaagcagataatatattcgagaaatcagaggactatacctatggcggaagcatagattacacgatttccgacaaatcctctttggtagcctctgttcataccgatcactacaaccgatatgataaatacgaactgaagagcggtcgtcgtctcgaatataaaaacaatattatccagccccgtatcgtatatagcactacggcgctcgataaacagaccattacgggaggattggaatattacagagaatcattattcagtgataaatttgaaaccggtgtgaaagaaaacaaaagccaatggtatgccaccgctttcctccaggatgactggagcatcaacaagcaattctccgtaatagcgggactccgctgcgactatcacgagaaatacggtaccaacctcactcccaaagcttccgtgatgtataagatctttccattcactgtccgctttaactatgcacgcggctaccgttcacccagcattaaagagttgtacatgaactgggaccatctgggcatgttctggatatatggcaacagtaaactgaaacccgaaactaacaattatatctctctttcgggagaatatgtgaacagttggatcaatatcaatgccaacgtttatagcaactggttccgaaacaaaatagaaggaatgtggagcaatgaccaaacggaactccattatatcaatataggaaaaagccgcctggcaggagtagagaccatgtgcaaaatacaaataaacagacatatcaatgtgcatggagcatacaattatctgtacacaagcaaagatgcggatggagtccgattgagctcttccagtccacattccggtaatattcgtgctgaatataacacacgcatcccacgctatgccaccgttgtcaacctgtccgggaatattatggggaaaaagaaattcgatgtgttggatgaactggaaatagacggaaagaaggtagaagcctactatcaggctaaagtaaacccttattgtctttgggatctgacagtatctcaatatatcatgcagaatctgagaatcacagcaggaataaccaatttattcgattatacttcagatcgagtgactttcaatacttccacttcaccgggaagaaactattttatcgcatgtaattatacactttaa

SEQ ID NO: 911 - DNA, 1179 bp, B.fragilis
ttcatatctattgcaaaagaaatgactattgcatttgtttatcgaaattttccttcattgggaggggttgaaagggttatagtcattttggcaaatgaaatggtaaagcaagggagtaaagtagttatttattctttagagcaaggacttaatgcttattccctggattcttctattgaaataatttgtttacctcaaaaaaaaatattggagtcaaaagaaaatgtgaattttctaataacacatttatgtgaatataaaatcgaattgctgtttaaccatgattctgtgaaagatagtattgaactctgcagaagagtgaagaaaaagataaatattcctgtagtaacacttcatcatggacaaatatatttgccatggaagtcacaatgggctattttgaaagataaatatagtttgcgtgtatgtcttaaaaaaatattttttcctttttttgtgcttgctactaaagtaaggaataatttgcatcatcgatataatatcaaggtatgtgatgtatatgtttttttggcagagtgttataaagatcaattaggaatagataaaaaagtaatggctattccaaacccattatcttcttctttcttttttgaggatgattgctatcagagcaaatgtaatactgttgtgatggtagggcgtattagtgattttcataaacgcattatattagctttgagaatctggaaggagatagaaaactgtgaacaatttgattcttggaattttgatatagctggagatggtcccgacttttatttaattcaggatactatttgttccttagggcttaaaagagttcgtttacttgggcaagtcaattcatttgatgtttataaaaaagctaaaatattacttcttacaagtgcttttgaaggatttcctctggttttaaatgaagctaaacagtgtgcatgtgtaccaattgcaatggatagttttgaatctgttcatgaactaattaataatggtgaggacggattgattatttcaaataatgatttaaatacttttttggagggattaaaatatttgatgtcacataatgatattcttcgtgaaatgtcaaaaaaatcagtgctaaacactcgtaaatatgaggtctccagattatgcaatatctggatggatttatttaagtcaatagttaataactaa

SEQ ID NO: 912 - DNA, 789 bp, B.fragilis
actctctatatatcaaatcaaatgcagctaacattaatggaacagaaaatctcaaaatattctaccgctacaatcgttagcctgctgtgcctcttattcagccttccgctccaagcacaacagcaaagacccggtgcacgtcctgctgtcaagcagaaagcaaaagaggagataaaagcggatacgattcccttttacaatggaacgtatgtcggtgtggacttattcggattgggcagtaaactactcggaggagattttctaagttctgaggtaaatgtgagagtaaacttaaaaaagaaatttattcctacagtagaaatcggtttcggacaaacagatacctggagtgataccggtatccattataaaagtgccgctccttattttcgcgttggagctgactataatgttgttaaagaatatttgtatgtaggactacgttatggatttagcagtttcaagtacgacatctcaagtacacctttttctgaccctatttatggaggcagtatggctaatcccggattgatagacggcatttggggaggaagcgtaccttatcattacaacggactgaaatctaacatgcaatggcttgagctggtggccggagtcaatgttcaaatctataaaagcttctatatgggatggaccttacgctttaaatttaaaacagcgggctcgatcagcgaacatggaaatccatggtatgtaccgggttttggtgaatatgattcctcaaacataggtatcacatatacactgatttataaattaccattttaa

SEQ ID NO: 913 - DNA, 1035 bp, B.fragilis
aatcctaatattcacttaaaatcaagcacaattatgaatgtcgaacctatgtatctgactatcttcttgatagcgggaggtattatcttcctggttcttttctttcattatgtacctttttttctatggctatcagccaaagtatcaggagttaatatctctttggtacaactttttctgatgcgtatccgtaatgttccgccatacatcatcgtaccgggtatgattgaagcacataaagcaggtctgagcaacatcacccgtgatgaacttgaagcacactatctggcaggcggacacgtagaacgggtagtccatgcattggtatctgcatcgaaggccaatatcgaacttccattccaaatagctactgcaattgatcttgcaggtcgcgatgtcttcgaagccgtgcagatgtcggttaatcctaaagttatcgacacaccacccgtaacagctgttgcgaaagacggtatccagctgatagccaaagcacgtgtgacggtacgtgccaatattcgccaattggtgggtggtgccggcgaagatacaatcctggcacgtgtaggtgaaggtatcgtttcgtcaatcggttcctctgaaaaccataagtcagtacttgagaatcctgattccatatcaaaactagtgctgcgcaaaggactcgatgccggtactgcatttgaaattctctctattgatatcgctgatattgatataggtaagaatattggtgctgccctgcaaatagaccaggcaaatgccgacaagaatatcgcgcaggcaaaagcggaagaacgccgcgcaatggctgtggctaccgaacaagaaatgaaagccaaagcggaagaggcccgtgctaatgtaattcaggcagaagcggaagttccaaaggccatggctgaagctttccgtagtggaaatctcggtattatggattattataaaatgaaaaatattcaagctgatacatcaatgcgtgaaaacatagctaaacctatcggtggagctaccagtaaaccgttgagcgattag

SEQ ID NO: 914 - DNA, 738 bp, B.fragilis
tcagcagatattccgcttatactccgcaggctaaagacttgtttatgttgggctacaaagccggcgaccgcatcactatcggtggttggattggagagtctacaacgatcagataaatctatgttgcgacaacaaagtaacagtttattaaataaaagtttgagcataacaattgtcttcggggcaattgttatgcttcttttattttcttcctgtggtgggagaaataaggcgatggccgatgccattaccgagcgggattcactgcctgttatggatacacggggggtaacgacccttatatccgattccggtgtcacacgttaccgggtcaacactgaagaatggttgatctttgataagaagaaaccctcgtattgggcttttgagaagggcatttatctggaacagttcgattcactctttcatatagatgcgagtataaaggcggatacggcttattattatgatcgtgaccggctttggaaacttattggaaatgtagatattaagagtctgaagggcgatcatgtgaccaccgagttgttatattggaatgaagccaccaagaaagtgtataccgataagtttgtccggatggaaaaaccggatcagattatgaccggatatggctttgagtcagacgatcagtttatgaagccggttgttcataacatatccggtatagtatatatcgatgaagatgccgaaaaggcaaaaacagattctgtaaactaa

SEQ ID NO: 915 - DNA, 747 bp, B.fragilis
ataacggatatccccatgaaaaacatattcactttactgattttatctgtatgctttttgtgtgccaacatatcgggtagggcacagaacaaattttcggatatggaggtcaatcatgtccgggtggctacaccgggacttttttccaaggagaattgtgtcatgctggatctgaagtccctgtcacggaattactctttccctttgccgggaggcaaagtcatttcgggctatggaacacgtggaggccatagcggtgacgacataaaaacttgtgcccgcgatacgattcgtgcagcttttgacggggtggtacgtatggctaaaccttatggtgcgtatggcaatgtgattgtgatacgacatcccaatgggttggagacggtatacagtcataatgtgaagaatctggtaaagagtggggatgtggtgaaagccggaatggctattggcctgaccggacgtaccggacgggctactaccgagcatctgcattttgagacgcggattaacggacaacactttaatcccggtcttatttttgatatgaagaagggaaccttgcgtactgattatttgcaatgtacgaagaaaggtaagggaattgttgttaaagctttgaaaagcgaaaaagtccttcctaaatataaaactctttcgcctttcctatatgaactgcccgggattaaaaaaccggtatggaatataccagccctagcgagatccgctgcgtattcgggtctatag

SEQ ID NO: 916 - DNA, 204 bp, B.fragilis
tccgtatgtattccgaaatcatccttatatttcacaataaaatctgcggttcgctcatcggactgtgggatatctcctttatcttcatcatggcaactgcagagtaacgccaataatgccaataaaacaatcgaatatttatgcaagctcatagttccttataatttattagttctcaatatgatattacttccaaatatataa

SEQ ID NO: 917 - DNA, 1158 bp, B.fragilis
tatttcatcttttatttaataatattaatgtataaccttttcatcgtagttaacgttgattggttttttctctctcatcgcaaagatattgcactaactgctcaaaagtctggttacaatgtcactatcgtaaccaaggataccggaaaaaagaaagatattgagtcacttggcctgaaggtgatcgatttacccatgaatcgttcgggacaaaacctgttagaggagctgcatacttgttggttcctttaccatctttatcgtcgtgagaatccggatattgtgcatcatgtcggtttgaaaacgattctttggggtactttggctgcgaaattggctaatatccatgggatcgttaatgccgttagcggtttaggtatatttttttcagagggaaaccggtctattatttcgaaattacttcctaaagtacttcgtttttctcattatcgtaataatgtcgctgttatttttcaaaatgatgaagacaagtcattgtttttaaaacatcagatcataaaggaatctcaagcttataaaattaaggggtccggggttgacttgaaacagtataattatactcctgaaccggaggaggggaagattaaagttctgttaacagctcgtatgattgtagagaaaggtatctttatcctgacagattccgctataaaacttaggaagcaataccagggtaaggttcagttcttattgtgtggcggacttgatgataatcccatggcaataaaagaaagtgaattacaagcggtatgtgacgggaagtatatcaagtggttaggttatcggacggatgttttggatttgttaaaggactgccatattgtcgctttcccttcttactataaggagggactgcctaaatccttgattgaggcaaccgctataggacggcctattataactactaattcgatcggatgtaaagagactgtaattgatggttataatggatatctgattcccataaaagacagtgatatgttggcttcccgattaagttttttatttgaaaataaagatgtaagacagagtatgggacgtaattcccggaagctggctgagaaggacttttctattgatgacgtaataaagaaacatttggatatttatagaacattagttattggaactttatga

SEQ ID NO: 918 - DNA, 1422 bp, B.fragilis
tggagcatctttcggataacgcttttgaccgtcggggagagaacaatcctttctttaagatttcgagtggaaaccctgactgcagacaatgcttttattaaaaggtattgggagacgtcttataagcggatcgggtattgtaaccgtttcttggtcggtatccagaataactcggaatcggaaaagaaaacacggatgattgcggaagcccgtttcctgcgtgcgacacagtatttttaccttgccagctatttcaaaaatgttcctttggtagagaatgtgctgacgggtgaagaagccaacaatgtgacaaagacctcacaggccgatatcctgaaatggtgtgtaaccgaatttacagcagctgcggccgatttaccccgtttctccgccattccggcgggagaagccggacgtgcttgtaagcaggccgctcttgcttttctcggacgtacctgcatgttgcagaaagactggaaaagtggagcaaaggctttccacgatattatggaattgggagataatgcgataaacgccaactatcaggagctgttttatccttctaccggaacttcgaacaaggagaatattttctacatccagtatttggaaaactatctgggtaccggtctgccgcagcatgcactttctgctaaagacgggggatggagcctggtcaatccggctgctgatttatacgaatcgtatgaatttaaggatggaactcctttcagctatgatgatccgagatatgacccgtctaatttaggaaaggatcgcgatccgcgtctggattatacaatttactataacggtgccatctttatgggtacagagtataagatgagtcctgactacagtgcagccaagaaggagaagctcgattatacgagcgaggcttccagaactggctttatgatgaggaaatattttgaagaatcgacacctataaacgatgtacagagcgcaaacggactgactccggttattcgttatgccgaagtgttgttgggctatctggaatgcctggttgaagataatcaaacgatcactcaaggaatattggacgagactatcaatgcagtgagaggacgtgcaagtgtgaacatgcctccggtaaccgaggtaactcctgcgaagcttcgtgaaatcgtgcgtcacgaacgccgcatcgagttggctatggaaggtatccgttactgggatatcatgagatggggaattgcacacgaagtattgtcccagaaaatttggggtgcgccttacccgggttcgactcagtatgcgactacgaccaaagaggttgacccgacaggaaactaccgctggtatgtgggcaaacgtgctttccgtaatccgacggattatacatggccgatccctcagtccgagcaaaatattaacccgaatttacgtgactaa

SEQ ID NO: 919 - DNA, 2868 bp, B.fragilis
aatcagctcatgttaaaatcaaaatatctgtttctttcacttatttgcctgctgacatcgttccgactccatgctcaatttatggattacggctcggatcctgctaaattcaaatggaatatcgcgagattaccccactacaatctggtttatccgcaaggaaacgattccatggcttaccgttatgccctctttctcgagaatgtttatccacacatgtcaaagaccattggaaaaccgatcaaagctaagtttccggtcattcttcatccgggcaacatgcaatccaacggaatggtatcctgggctccccgacgaatggaacttattacaacgccttcttcggatctgaataaccaaagttgggataagcatctggtactgcacgagtcacgccatgttttccagacaggaaaggtaatgcacggcattttcaaaccgctctattatataataggtgaacaggcagccggagtagcctcttttttcttgccggtatggtttcttgaaggagatgccgtaagtacggagactgccatgtctaacggtggtcgtggacgactaccggaatttaacatggtttaccgtgcccaaatgttaggaggaaaaaagaactattccttcgacaagtggctaatgggatcttacaaaaactatactggtacctactatgcactggggtttgatatgacctcttatgctcgtcaacgctacggagccgatatttgggataaaagcaccagtagatacattcggaacctactgttcgaaggttcatttaagcattatacgggcagtagttttaagcgtctccaacatgatacgttcgacttcctgcgtgcagagtgggagaaacaggatacttgtacacagtccccgcaatatctatcacctacaaaagagacttatacctcctatcgatacccacaacccatcaacgattctatagtgattaccgtaaagtcgggattgaaagatatcaactctttagtgatcatcaataatggcagagaaaaacatctggactatataggtagtattaatagccgtttgagctatcgaaacggccgggtttactggagcgaactagtacccggactacgttggacacaccagaattactcaattataaagtactatgatctggataagaaaaacataaaagccctcactccccgacaacgttatttatccccggccattgacgagcaaggacagcacattgccgtttcacgtcctacagtcgaaggtaaaaaccaactcgtgctgatacaagcagaaaaaggtaatgaactcgctgctttcgacgttcccgataatgcatttatcaaagaactgacatttgcaggaggcgacacaattatctcgatagctgtcgcagattccggtatccgcctgttacaattcaacttcggaaacggaatatggaaagaactgctaaaaacagcttccgccaatatcacttctcctgtttggaaagatggaaaaatctttttcgaatcgggagccaacggcatcaacaacatctacagcctcaatccggcagacggacaagtccgccgaatgacagctgcccgcttcggagctttcgatccttcttttggatcgtcagacggacgtttgttcttctctgattaccaagccgatggatatcgcattgcctcactcccgactgacagtatgctctttgaaaaggcagatctcaaccggccggcttccatgccatttgttgaaacacttgccgctcaagagcaattcaacctggactcggcacgtctgacatcagtcgatttcaatccgaaacgttatagaaaagcggaacatacgttcaaaattcacagctgggcccctttctattatgatgtggctgaggcaatgaactcaggtgccagcgatctgagtacaatagtaaaacccggagcaaccctgatgtcccaaaataccctgaacacagccatcatgcaggccggatggtatatagacaaaggctatcatcatggtaaactgtcatttatctatcaaggctggttccccgttatcaatctgtcggtagactatggtgataaagctttcaatgtagactggacacagaatgacaaagggcaagacattacacagggccattatacccaacgaaatctggtggaagcagaagcacgtgtctatctcccttttaacttaacacacaaccaacgaatacgaggcatacaaccggctctgacttattattttaccaataataaatatcaggaatatcacagtcggaaattccataacttccaatatatcctaccggaaattctattctatgattacagacgaaaagctcagcgagacattctcccccgcacaggctatcaattacgtttgcaatacctgaagactccattcaattctgaaaattacggaagcctgtatgccgcccgcctgactacttactggccgggaatcatcaggaatcatgggctgatgatccgtgtcggctatcagtatcaggatcttgacaacaaagcattataccttcccaaacatcttttagaaaaaccccgaggataccatttccagtatcaaacccgccaacaatgggccttcaaaacagattatgctttacccctgctgtcacccgattggagcatcggctcacttatttacatccgtcggttgcgtgcaaacctcttttatgatctatcgcgcaatcaagccagttctaaaagtaggtggagtaaccaaagttcatacggaggcgatctgattttcgactggaatgtactacgaatgagttatccgcttacaacaggcatacgcttgatacagccgatcgattatggcaaatttcaagtagaggcactgttttcaatcagtttctga

SEQ ID NO: 920 - DNA, 249 bp, B.fragilis
ttattcatcatgaacggtttatacaaacgctccatgatagatttggctctctcagactcaactcccacaactacccgatccggcttcatgaagtcatcaacggcatctccctctttcagaaattcaggattggaggccacgtcaaattcaagattcaaaccgcgtttatccaattcaccccggatcgtagctttcacctgttgcgctgtgccgacaggaacagtactcttcgttaccaccagtacataa

SEQ ID NO: 921 - DNA, 1521 bp, B.fragilis
aagttcaccatgaagatttttccaagtagcagcatcaagaaactggatgcttacaccatagaacatgaaccgattgcatcgatcgacctgatggagcgggccgcacaggcactgaccaaagccatcaccgaacgctgggacatcacaactcccgtcacggtatttgccggaccgggcaacaatggcggagatgcccttgccgtggcccgaatgttggcggaaaaggaatacaaggtcgaagcctatctgtttaacccgaaaggggaactgtctgccgactgccagaccaacaaggagctggtagagacgatggataatgtgaagttcagcgaagtaagcacacagtttgtacctcctgccctgacaatggatcatctggtagtggacggactttttggttcgggacttaataagccgctaagtggcggttttgcggcagtagtgaaatatatcaatgcatcgcctgccaccgtagtcgccatcgatatcccctcgggactgatgggggaagagaacacatttaatgtaaaagccaatatcatccgtgcccaattgacattgagcctgcaattgccgaaactggctttcctctttgccgagaattccgaattcgtaggcgaatggaaactgttggatatcaacctcagtcgtgaagcgattgaagaaacggaaagcaattatgccttattggaagcggaagaaatacacgctctgatcaaaccccgtaacactttctcacacaaaggaaactttgggcatgctctgctgattgccggttcgtacggcatggcaggcgcgtcgatactggcagcccgtgcctgtatgcgttcgggtgtaggcttactgacagttcatgcacctatacgcaacaatgatatcctgcagatttcggttccggaggcaattatcgaatcggatgccagcgatacctactttgcctgccctacagatacggatgactatcaggctgtaggaatcggtccgggcatcggacgctcggaagagaccgaggctgcactgcttgaacaactcagtggttgccagacacctctggtactggatgccgatgcactaaacatattggccaaccaccgccacgcactgaccacattgcccaaaggctctattctgactccccatcccaaagaactggaacgcatggtgggcaaatgccagaactcatacgaacgactgatgaaggcctgtgaactggcccgaaccgccaaagtacatatcatattaaaaggagcctattcggcaattatcaccccctcgggcaagtgctatttcaactctacgggtaatccgggtatggcaacagccggaagcggagatgtattgacaggtgtcgtgctggctttgctcgcacagggatatccggctgaagaagctgccaaaatcggtacttatgtacatggtctggcaggtgatttcgcacgcaaaaagcaaggcgttatcagcatgacggcaggagacattatcagtaatctgccattggcttggcgtctggtaagcgaataa

SEQ ID NO: 922 - DNA, 2154 bp, B.fragilis
atcgtattaatcaaaatggcaacattacaaaacattagatccaaaggacccctgttggtgatcgttattggtttggctttgtttgctttcattgcgggcgatgcctggaaagttctccagccacaccaatcgcatgatgtaggcgaagtcaatggagaaactctttctgctcaggactaccagaacatggtagaagaatataccgaggttatcaagttctcaagcggaatgagttcattgaatgatgaacagaccaatcaggtgaaagacgaagtatggcgtagctatgtgaacaataaactgattgaaaaagaagcgaagaagctcggtattactgtttcgaaggctgaaattcaatcaatcattaacgaaggtgtgaatccgttgctgcagcagactccgttccgcaatcctcaaacgggcgctttcgataaagatatgttgaagaaattcttggctgactactctaaaatggacaagaccaagatgccgtctcaatatgtggaatactatgaaggaatgcacaaactttggtcatttgtagaaaagacactgatccagagccgtttggcggaaaaataccaggcactggtgactaaagctcttttctctaatccggttgaggcacaggatgcattcgacgcaagagtaaaccagtcggatgttctgttggctgctgttccttattcttctattgtagactctactatcacagtgaaagagtctgaactgaaagatctctataacaagaagaaagaacagttcaaacaatatgttgaaacacgcaacatcaaatacatcgatgtacaggtgacagccagtgcagaagacagagctgctatccagcaggaagtgactgattatacaaaccaactggctactgccaatggtgattatactactttcatccgttctaccggatcggaatatccgtatgttgatttgtactataccaagaaagctttcccgtcagatgtagttgcacgcatggattcagcttcgattggacaagtatatggcccttactacaatgcaggcgacaatactatcaattcgttcaaggtgttgtctaaagtggctgctgccgattctgtgcagttccgtcagattcaggtttacacagaagacgctgctaaaacaaaagctttggctgacagcatctatactgctattaagggtggggccgactttacagctttggctaagaagtacggacaaacaggtgaatccaactggatttcgtctgctaactacgaaaatgcacaggttgatggcgataacttgaaatttatcagcactatcaacaatctgggagtaaacgaactctctaacgtagcattgggacaaggcaatatcattttgcaggtgactgataagaaagctgtgaaagataaatataaagttgccgttatcaagcgtgcggttgagttcagcaaagaaacttataataaagcttataatgaattcagccagtttattgcagctaacccgacagtagacaaggttgcggccaatgctgaagaatcaggctataaattgctcgaaagaaatgatctgtatagctcagaacacggaatcggtggtatcagagggactaaagaagcactgaaatgggcctttgctgcaaaaccgggtgaagtttccggcttatatgaatgtggcgaaagcgaccgcatgttggttgttggtctggttagcgtgatcgaagaaggttatcgtcctttggcccaggttcaggatcagttgagagctgaaatcattcgtgataagaaagctgagaagatcatggccgacatgaaggctgccaatgcaactacaattgcccagtacacatcgatggccaatgcagtaagtgattctgtaaaacacgtaacatttgcagcgcctgcttatgtagccgctttgcgtagtagtgagccgctggtaggcgcatacgcttcggtttcggatatcaataagctgagcgctcctatcaagggtaatggcggtgtgtttgtgttgcaggtatatgccaaagataagctgaacgaaacattcgatgcccaatcagaagaggctacattggaaaacatgcatgcccgtctggcaagtcgttttatgaacgatctttatctgaaaggcgatgtaaaagataaacgatacctgttcttctaa

SEQ ID NO: 923 - DNA, 1284 bp, B.fragilis
actataataatggtaggatataaacagacactttgtgcgcttctgctcacgatattattacccggagtggcaatcgctcaaaataatacaaactctccttatacacgatatggctatggtcagttggctgatcagtcatttgcaaacagtaaagcaatgggagggatcgcttacggattgcgcgatggatcacatatcaatccgttgaatcctgcttcttatacggctattgattcgttgacctttctttttgacggagggttttcgatgcaaaatacaaactttagtagtgaaggcaccaagttgaatgcgaaaaattcaagttttgactacatagcgatgcagtttcgtctacaccagcgcgtggccatgagtatcggtctgctgccctactcgagtgtaggctataatatggccaaggcgaacaacgatgttgcatcggaagaagcgcggagtgtcacttcatttgccggagacggaggcttgcatcagctttacgtaggtttgggagtgaaggtgctgaaaaacctttcagtcggcgccaacgtatcgtacttttggggggagatcacgcgtcaggcgcgtattacttttccttataatgacaacgcttttgcttttcagcatgtagactatttgtctgtgcgcgattataagctggacttcggcgcgcaatacacacagcagctgggtaggaagcatgcggttacattaggtgtagtgttctcgcctaaaaaagatttgcataacgaagcttatgtacaaagatcgacgcttacgaactccaacagcacgcaggccgtcactacgaatacggtcgatacggtggctacctttggaatgcccaatagctttggggtgggacttacgtacgagtatgacaaacgtctgatcgtgggagctgattttaatttgcagaagtggggcgacgtgacctatatgaatcagccgaatgctttttgtgatgcgatgaaaatttcagtgggtgccgagtatatgccgagtcgtttctcgcgtagttatctggcgcatatcaaataccgcgtcggaggatattattcggaaccttattataaaataggaggggagagagcctctcgtgagtatggagtaacggccggtttgggattacctcttccgggttcacgctcgctaatcaacgtttcggctcaatatattaaagtacatggtctgaaagccggtatggtagatgaaaatacattgcgtttgagcatcggaatcacgttcaatgaaggctggttcttcaaacgtaaagttaaataa

SEQ ID NO: 924 - DNA, 657 bp, B.fragilis
actaaaacaataatgaacaacaaaaacaaattcagattcgccattctattatttggcgtactttcagcgtttatcaccaccgcttgctcagacaacaatagtcccgacgaccctgcacaaggagaaaacacgttgccggtaaaacaagtaagcctgagtcggaaaacagcatacggaaacgactggatctattattcacttgaaaaaggaaaagaagtaagcgtcagtgaagaatcccatgccgaaaatacagactgggacatcgcattcaatcgttacaatgtgcgtaccaacagcggtgcatccggcaaaggaaaaggtggagcattactcactaacattaaagatttggcagcctgtacgacagttccgcagggaacatttactgtcgacgcagcctataccatcactgctcccggcacaggtttccctcctcctaccatggagtccaccgctaatgaggttctctgtaaagcaatcacttttgccggccctcctcccacttacaccccaagcgattacgtatttatcgttcgcacagccagtgggaaatatgccaagttgaaagccaagagtttttatgatgacgaaggcaaaagcggtatttattcatttgaatatgccattcagccggatggcagtacaaatttaaactaa

SEQ ID NO: 925 - DNA, 1458 bp, B.fragilis
ttgtatatgatgattaaaaatttaaaattggcagcattaaatagtttaatgtggaatgctgttgagaaaatgtcggggcaagcattacgctttatattgaccattgttatagctagattagtttctccagctgattttggattgatagcaatgttgtctatttttttatctgtagctcaatctttcattgattgtggtttttacaacgctctggttcagaaacaggatcggacagaagttgactattctactatgttttattcaaatgtgttgattagtgttgttgtatatttttttctttattggagcgctccatatattgccagtttttattctcagcctgaacttaaacagatcactagggtaatgggggttagtttaattatatctgcgttcagaattgttcagcaggctaaattagtaatagcactcaattttagaattcaggcagtattttcagtaatagcagttgttgtaagcgggctaatcggtatttatatggcgtatcaccaatttggtgtatgggctttagtcgtacagtccttagtatctgcttttatctcaacagtttccttttggatatattcaagatggatgccattatggactttctctatacaatcatttcaggagttattctcttttggatcaaaattattattagctggagttttacatacaatctattctaatctgtatacaatagtaattggtagaaaattttcatctgttgatcttggcttttttagtcgtggacaaactatggcctattttgtaccttctaatatgacaaatattgtaacaatggctatgtatccaatattatgttctattcaggatgattatgttaaattgaaaaagacatttaaggtgtatattcgattggtttgttttattttttttcctataatgataattcttgctgtattatctgaaccaataattaaaattgtattaaccgataaatggttaccatcggttttttatgttcaaatattgtgtattgcttatatgtgggatccattaatgagaataaatgctaatattttaagtgttgttggccgaacagattattcgttgaaaagtgaaataattaaaaaggttatctcggttattgtactatttattactataccttttggaatagatgttatgtgtatcgggttagctttatattgtattatagatttattggtttcaacatattatgtgaaaaggattattggacttggtttctgggatgaaatgagaaatatttatgcattctttattctgtctttagttattggaggagtagtgtttgttgttaatatatttgtggagtctgatcttctcaaaatttttataggaactttggttggaatagggttgtatatatccatgtgtatcatattccgaattaaagaggtatttgacttttggagtattattaattcatatctattgcaaaagaaatga

SEQ ID NO: 926 - DNA, 579 bp, B.fragilis
attaacaagatgctgaacattgtaattttcggtgctcccggttcaggaaagggaacacaaagcgaacgtattgttgagaaatacggaattaatcacatttcaacaggagatgtattgcgtgcagaaattaaaaacggcacagaactgggtaaaacagctaaaggctacattgatcagggacagttgattccggatgaattgatggtagacattctggcaagtgtgtttgatagtttcaaagatagcaaaggggttatttttgacggtttcccaagaactattccacaggctgaggcgttgaaagtgatgttgaaagaacgtggtcaggacatctctgtgatgttggatctggatgttccggaagaagaactgatgactcgtctgattaaacgtggtaaggaatcgggccgtgcagatgataatgaagagaccatcaaaaaacgtttggttgtatataatacacagacttcaccgttgaaagaatattataaaggcgaaggcaaataccagcatatcaatggtcttggaaccatggaaggtatcttcgaagatatttgtaaagcggtagatacattataa

SEQ ID NO: 927 - DNA, 474 bp, B.fragilis
ttctattggatattattactcttctatacaaataaaaaccgaaaagaatcgacgaatcataattcattcctttttaaaatgaaaaattctctgtgtaattctgtgtcctccgtagtgaagaaactcttggagtatggcgaggacggtactcctgtctatgtgaatgaacttactgcgttaaatcaagaactccgtaacttgtgtgctgatcttcttcttcagaaaggagaatctcccgaagaagaggctgaaatacttgttactttgttcaaaggttacgataccatgctgtttaatttttcctctgagaatgaacaggttattcaagaattattggatcgttcaatgactgttttagaaaaactaccagcctctgtattgaaatgtcagttgctgctggagtgctttgagcagacgggagatgaggaactgataagagaagtgaaatttacttttgagagttgtggtatttga

SEQ ID NO: 928 - DNA, 1965 bp, B.fragilis
aagttatactttattattttatctttgttcgcgtacagcaagacaaactttatggctatggcacacacactggattcattcccggataccggagaccttgagaatttgaaagataattatcagaaaatcacttctgtcctggcaggacatcagattgcattttgggaatatgacattcctacaggagagtgtaatttcacagatgaatatttccatattttagggttgaaggaggccggaatcatattcagagatattaatgacttttatcggtttgcccatccggaggatgttatctcttaccaaacgacttttgcgcggatgcttgaatcggaaaccaaaatctcccaaattgtggtacgttgtgtagggaggcaaggagaaacaatttggcttgaagataattttattgcttataagaagaataaggagaatggctctgataaaattatagcatatactgccaatatcacttcacgttgtgaaaaagaagtccagatcaggcagcttgaggaacgaaaccggaaaattattgaagcactaccggagttcatatttatttttgatgataatttttttattacggatgtattgatggcacccgatacagagttgttgcatccggtggaagtgttaacaggagcagatgggcgatctatttattcttctgaggtcagtgacttgtttattagcagtattcatgaatgcctaaaaagtgggaaattaaaagaaatagagtatcctgtggatgtcgaagccggcagacatttttttcaggcacgcattgctccgtttgagggaaataaggtgctggccttgattcatgatattggtgatcggatgcgacgttcgcaagagctacttgaagccaagcaacgggcagaagaggctgatcggatgaaatcagtatttctggccaatatgagtcatgagatacgtactcctttaaatgctattgtgggcttttcggaaattatagctttgactgaggatgaaaaggagaaagaagagtatttagggatcattcagcagaatagcaatctactgttacaactgattaatgatattctcgatttgtcacgaatcgagtcgggtaagtcggaaatgcattgtcagttgacggaaatgagcggattggtagatgaagtggataaagtacatcgtcttaaaatgaaaaaaggagtcaagctgaatgtgattcgtccatcagaggaaatttggatttcgacagataggaatcgggtgacgcaggtattgttcaatttcttgtcgaatgcaattaaaaataccattgagggtagcattactttcggacttgtaaaagaggaagaatgggttaaactttatgtaacagataccggctgcggtatttccaaagagaaattacctttgatatttacccgttttgagaagttgaatgattttgtacaaggaacagggctgggattacctatctgtaagagtattgtagagcggttgggtggtcggattgaagtggaatccgagcttgggcaggggagtactttcattctttatttgcccaataggcaagtacaggaagttgtggttggcgaaagagaaaacgcagcaggtaatatgggagtggagaaccggcagaagaagatactgatagcggaagatgtggagtccagttatctgcagattaatgcctttctgaaaaaagaatatacgattctttgggtgcctaatggagaagaagctgtgaagagtttcatacgcgagaagcccgacttgattttgatggatatccgaatgccggtgatgaatggtattcaggcaacagcaaaaattcgtgctatctcgcaagagataccgattatagcaattacagcatatgccttttgtccggaaggagagcgagctcttgaagcagggtgtaatgaagtgattgcaaaaccatatcctctggagaagctgaaagaaacgatcgaaacttatttatag

SEQ ID NO: 929 - DNA, 633 bp, B.fragilis
ccggatagctttattaactttaacaggcataaattccataccaaacaatattatttgtacctttgtgcgctatttattaataaaatgacagaaagcagaagtaacttacaaaaatatgccatgcattttggcacctatatgggagtatactggatacttaagttcattctattcccattgggattgtccattccgtttcttttattcctgtttttcgggcttactttaggagttccgttcatgggatattattatgcacgtacctatcgtgacaaagtatgtggcggctcgatccgcttcctgcaagcatgggtattcatcgtttttatgtatatgtttgcggcactcctcacggcagtggcccactacatttatttccggttcatcgaccatggtttcattgtaaacacttacatgggaatgtttgacgaactgaccaataaagaagtaccgggaatagaagggtacatcagccaactgaaagaagtgatggaaatgatcagtagattgacaccgatagacattactatgcaactgatgtcacagaatgtgttctatggcagcatattggctgtccccactgccttgtttgtgatgagaaagcccaaatcaccggaggtgcaacctctatag

SEQ ID NO: 930 - DNA, 3885 bp, B.fragilis
aattttatagtaaaaatcatgaaaaacgcaattggtaattgtaggcagcgaaaagcagtgctgttcgccctcgctttgcctctgatgttttccggttcgcctgcgcaggcaatgcacaggtccgaaatcgttagagaagtgacacaacaaaacttgaagatcgttagtgcaaagaaaatcaatccgacaacgattgaagtattattctctaataatcagagaatgacattcgatttctacggggaaaacatcttcagagtatttcaggacaatgccggaggaatcatccgtgatccggaagcaaaacctgaagcacaaattctggtaaacaatcccagaaacacagtttctacactcaacttgaatgatggcagcaatctcatctctatcactacggggaaaatcaaagtggaaatcgacaagaatacttctttgatgaaagtgattgacttggaaaagaatactgttgcctttgaagaggtagaacccgtactgttcgataagggaaaagtgactgtaaccctgaaagaaaatcccaatgaatatttttatggtggcggtgtgcagaacggacgtttttcacacaaaggaaaagccattaatattgtaaacgagaatagttggactgacggtggagtagcttctcctgcgccattctattggtcgaccaatggctatggtatgatgtggtataccttcaaaccgggtaaatatgatttcggtgcagacgagaagggaaaagtgaaacttacacatgattctccatatctcgatctcttttatatggttagcgacggagctgtgggcgtgttgaatgatttctatcagttgaccggtaatccggtgttgctgcccaagttcggtttctatcagggacatttgaatgcttacaatcgcgactattggaaagaagacgaaaaaggaatcttgttcgaagatggaaagcgttataaagaaagtcagaaagataatggcggaatcaaagaatcattgaacggtgaaaagaataattatcagttctcggcccgtgcagtgattgaccgttacaagaatcacgatatgccgttgggctggctcctgccgaatgatggatatggtgccggatacggacagacggagacactcgacggaaacattcagaatctgaaaagtctgggtgactatgcccgtaagaatggcgttgaaattggattgtggacacaatcggatttacatccgaaagaaggcgtcagtgcattgctgcaaagagatatcgtgaaagaagttagagatgccggtgtgcgtgtgttgaaaacagacgtagcatgggtcggttggggatattcgttcggattgaatggagtggcagatgtgggtcacattatgccttattacggtaacgatgcacgtccgttcattatttcacttgacggttgggccggtacgcaacgatatgccggaatctggtcgggtgaccagacaggcggtgtatgggagtacatccgtttccatatcccgacttatatcggttcaggcctgtcaggccaacctaatatttcttcggatatggatggcatctttggcggcaagaatatgattgtcaacaccagagacttccagtggaaaactttcactccgatgcagttgaatatggacggatggggatctaatgaaaagtatcctcacgctctgggcgaacctgccacttctatcaatcgctggtatctgaaactgaaatcggaattattgccttacacttatagttttgcaaaagaggctgtaaccggtatgccgcttatccgtgccatgttcctggaatatccgaatgcttacaccttgggaacagctacgcagtatcagtttatgtatggtaccgattttttagtagcccccatttacaaagctaccaaagcagatgctaaaggcaatgatatccgtgatggcatttatttgccagaaggagagtggatcgattattttaccggagagaaatatcagggtaactgtgttctcaacaattttgccgctcctctctggaagcttccggtattcgtaaagaacggagctatcatcccgatgaccaatcctaataataacgttgctgaaattaataagggacttcgtatctacgaaatctatccgtataagcacatgatgaccgttgaatatgacgatgacggtatatctgaagcatataaagagggtaaaggaaccactactttcattgaatcgaatgttgattcaaagaataatgtgaagatttctattcgtcctacacagggtgatttcgacggctttgtaaaagagaaagccacagaattcagagtaaatgttactgctaagccgaagaaggtttctgctcagataggtaaaggcaaagtgaagttgaccgaagtgtcttctatggatgatttccggaaaggtgaaaacgtatacttctatgacgctgctcctaatttgaataagtttgctacaaagggcagtgaatttgagaagaaggttatcactaagaatcctcaagttcttgtgaaactggccgctaccgatattactaaaaatcaagttgtaatggatatcgaaggcttccaatatgcacctgccgataattacagagtaacctccggttcgttgaccgctcctgctgcccgaattgctgccgaagatattgaggcttataccttgaagccgacatggaacaaagtgccgaatgctgatttttatgaaatagaattcaatggcatgctgtatacaacaataaaggatactgagttgctgtttgacggactggctgctgaaacagactatacatttaagattcgtgccgtaaacaaggatggctattcggattgggctgaattcggtgctaagacaaaagctaatccgctggaatttgctcttcacggaatcaagggtgaaacaactgcgaagaatcaggaaggatttgatatcgatcgtttgttcgattttgccgagctgggtgatatgtggcatacgaagtatggagcaaaagcactgccttatgatatgattatcgatctgcgaacagtgaaccagctggataaattcgaatacctgccacgtaccgatggtggtaacggaacgatcctgaaaggtactgtatattatagtatggataaggaaaactggaccgaggccggagcaatcgactggaaacgtaatggtgatgtgaaagtatttacatttactgaacgtccgactgcacgctatatcaaactggctgtaacagaaggtgtaaacaactatggttcgggtagggaattgtatgtatttaaagttcccggaaccgagagccgtttgcagggtgatatcaataacgatggtaagatcgacaataacgatttaacctcgtataccaactataccggtctgagaaaaggtgattccgactatgaaggctatatcagtgtaggcgacattgatcagaatggtttgattgacgcttatgatatttctgtagtggcaacacaattggaagatggtgtaagtgaagagccgattgagaaactggatggtaccattgaaatcagtactgctaaacggaattacagtaagggtgatgttgttgaagtgcttgtaaaaggtgtcaacctccgctctgtaaatgcgttgagttttgcgttgccatacaatcagcaggattatgaattcgtgggtgtagaacctctgaacctcaaagctatggaaaatctgacttatgacagactccataccaatggtacaaaagcactctatcctacatttgttaacctcggagctaaagaagccctcgaaggaacaaacgatctgtttattctgaagctgaaagcgaaacgcgctgtgaagtttgatctgaaagctattgatggcgttttggtcgacaagaacctgaacacacgtaagttttaa

SEQ ID NO: 931 - DNA, 1050 bp, B.fragilis
atatttgtagtaaatatgcccaaatatccgcttttaggaatgacccttaccgaattgcaatctgtcaccaaagatttggggatgcctgcttttgcagccaaacagatcgcttcctggttatacgataaaaaagtgacttctattgatgaaatgaccaatctgtcgttgaagcatagagagttgctcaagggagagtatgatttggggatatccgcgcctgttgatgagatgcgttccgtagatggtacggtgaagtatctttatcaggtgagtgacaatcattttgttgaagcggtgtatattccggacgaggatcgggcgacattgtgcgtgtcttctcaggtaggctgtaaaatgaactgtaagttctgcatgacgggtaaacaaggatttaccgcaagtctgacagccaatcagatcttgaatcaaatcgcagcattgccagagcgggataagttgactaatgtcgtgatgatggggatgggcgagcctatcgataatttggatgaagtattaaaagcactgcatatcctgaccgcttcgtatggatacggatggagccccaagcgtattactttgtcgtctgtaggattgcggaaaggacttcaacgctttattgaagaaagcgaatgtcatctggctatcagtctgcattctccttttccttcacaacgttctgagttgatgccggccgaaagggctttctcgattaaagaaatggtcgatctgttaaaaaactatgattttagtaaacagcgcagactttcgtttgaatacattgtttttaagggcgtcaatgattcgctgatttatgctaaggaactgttgaaattgctgcgtgggcttgactgccgggtgaacttaatccggtttcatgccattcctggggtagacctcgagggtgccggtatggagactatgacgtcatttcgtgactacctgacctcacatggactgttcactaccattcgggcttcccggggagaagatatttttgccgcttgcgggatgttatcgacggctaaacaggaggagagtaacaagaattaa

SEQ ID NO: 932 - DNA, 228 bp, B.fragilis
aactgtgcagttcagcagatgatacctgcttttgcgtcgctttcgttcatcgtttataaagaaagggaggcagagcagatgccccggatggaagacaaacagcaagtaattggagcctaccgtggggtgttcggagaaaagagcaaggaaagcgatgatgcatcctgcgatacccgctgccgcaaacactgcgatatccagtccccaaagactctttttcttgcgtag

SEQ ID NO: 933 - DNA, 207 bp, B.fragilis
aatgaggaagtggtaaccacttatgtaggtgcaaagatagataatattcgtcatatagaaagaaaaagagggtggattttagatattttattcattccggaaagaaacacaggagattatactaactttgtattttcagaatgtaacaaagacaaccaacaaaatctcaaaacaacatctattcattatggtcaagaaaatcattag

SEQ ID NO: 934 - DNA, 198 bp, B.fragilis
cgcacaaaggtacaaataatattgtttggtatggaatttatgcctgttaaagttaataaagctatccggtcagaaaaaaaacatttttttttcgattttaaatatctgaaaagtaggagcttaccggtaaagcatgcaaaaaaataccgatcccctattgcaggtttaataaaaatacctacctttgcacccgggtaa

SEQ ID NO: 935 - DNA, 183 bp, B.fragilis
ttttttctattttcattgtttctcttgttttttagtctctgcaaatttactcacttatgggaagcggaagaatcactattaataggtattccgttcgggttccttccctataaatcagtatcattacttttatattataaaacaaagaaaagagaagaaaggttcaatcgtcttctattttga

SEQ ID NO: 936 - DNA, 192 bp, B.fragilis
agagaacaatttagtattaccggcaatgccggaccttataaaacagcaacccatgtcgttatggaatttctgtttggaacttcatgtcggtcgttgttattccccattcttaggtgttttttcagatctattcgtttttatttccggccttctgctaacgttaatccttatttcgggatatatcgtatataa

SEQ ID NO: 937 - DNA, 198 bp, B.fragilis
gaagtgtttttcacttcagcatatatagcagcccctgcaaaaacaggacatgcttcttttaactctttcgatacaataatggtatacataataaatcaaaattttatctatcagctatttatcataatgcccgacaaaatacgtccggactttatgcccaatcttcgcgctgaaaagaaatcctcatgccggatgtaa

SEQ ID NO: 938 - DNA, 1260 bp, B.fragilis
atattttattcattccggaaagaaacacaggagattatactaactttgtattttcagaatgtaacaaagacaaccaacaaaatctcaaaacaacatctattcattatggtcaagaaaatcattagtatctgtgctgccggtatgattgtagccagttgctcccccaaaaagacaacagctcagccgacagatccgtcaaccactgacagtgaattaacaatgctggtcggaacttacacttccggcaacagcaaaggcatctatactttccgattcaacgaagaaaccggagaatcgctcccactgagtgatgcggaagtagcaaacccttcatacctcattccatcagcggacggaaagtttgtctactccgtcaatgaatttagcaaagaccaggccgcagtcagcgcctttgccttcgacaaagaaaaaggaactctacacttattgaatacacaaaaaacaatgggagccgatccgtgctatctgaccaccaacggaaagaacatcgtcacagccaattatagcggtggaagtattaccgtctttcctatcggacaagacggagcattgctacccgcctcagacgtaatcgaatttaaaggttccggtccggacaaagaacggcagacgatgcctcacctacactgtgtacgtattacccccgacggtaaatatttactggcagacgacttaggtaccgatcagatacataaattcaatatcaaccctaatgccaatgccgataacaaagagaaattcctcacaaaaggtaccccggaagcttttaaagttgctcccggttccggcccccggcatctgatattcaattcagacggtaagtttgcctaccttattaatgaaatcggagggacggtaatcgcttttcgatatgctgacggaatgttggacgaaattcaaactgttgcggctgacactgtaaacgcacagggaagcggtgacatccaccttagcccggacggaaaatatctctatgccagcaaccgcttgaaagcagacggagtagctatctttaaagttgatgagaccaacggtaccctaaccaaggtaggttatcagttaacgggaatccatccacgcaactttatcatcactcccaacggcaaatacttattggtagcttgccgcgacaccaatgtcattcaaatatttgaaagagatcaggctaccggattattaactgatatcaagaaagatataaaagtagataaacctgtttgcctgaaatttgtagactga

SEQ ID NO: 939 - DNA, 1797 bp, B.fragilis
actatgtgttcaaaaataaaacatatattactgactgcgtgctgtttcacaggcgcaggactgatgacaagttgtaatgacgggtttatggatcgctttccggaaacgagtattacagagaaagtctttttttcttctcctgctgatttggagacttataccaatggcatgtacggctatatcggtgcaagctattcggatactccttccgacaatatgctttacccagaagataccgatatttataaaatgatgcgcggcgaatatcgggcggataatataggtaaatggagctggagcaacattcgtacagtcaattttatgttggctcggacaggtcgtgtagaaggagatcgcggtgagattgatcattatattgggttggcacgtatgtttcgtgcactggtctattattcaaaggtgaaagattattcggatgtaccttggtatagccatgacctgcaaacgacggacattgatttattgtataagccgcaggaccctcgagcattggtggtagactctattatggcagatcttgactttgccgtaactcatatgaaaacgactaaaagcacgactcgtatttatcgtgatgcggctttggctgtacaggcacggattgctttgcatgaaggaacgttccgtaaatatcatccggaactgaagctgaatgacggcgaccgattcttgaaaatagcggtagaggcatgccagaagattatggacacaaaaagttacagtttgtctacaaccaaagagagtggtttaccggcctatcagtcacttttttgcagtacggatcttacacagaatccggaaatgattctggtagctgactacgacaaggcgttaggacgtctgcacaatgctcaggctcagtttgactacaacaccggtctttcccgtagcctgatggaagattatttagttgttaaggatggacataccgagtattttcatcaagtggaaggctataaaacgaagacagtacttgaagtctttgaaaacagagatccccgcctggaacaaacatttatgaaaccgggtgttttgaatgtgggaaccactgaacctcatcgtacgaaattgaacttgggaggatatcctcagattaagttccgtccgctgacattcgatcagattgactggggaaaatcgtatacagatttgcctattatccgttatgccgaggttttgttgatgtatgcagaggcaaaagccgagctgggtatactcacacaagatgatgtcaaccagacaattaacctgatcaggcagcgtgcaggcatgccggatgcttcgttggatgattggctggctaatatcgatccggtacaggatgaacgttactccaatgtacagtcagcacagaaaggtgctgttttggaagtgcgccgtgaacggagaatcgagttggcatgcgaagggttcagatatggcgatttgatgcgttggggatgtggaaagttgtttgaagcagctcccgaaggagcttatattccggggatgggatactatgatgtgacaggtgacggtcaaccggatgtcgctatagtagaaaagaaagcagatatagataaaattcccgaagaagacaagcaaaagtataaactgacagtttatgctttggaaggtaataccatcggacttaccgaaggaacaaaaggctatatctatttggttgcccaacataataagtatacttttgtatctccaaaatattattactatccggtagctaccaaagatataactgttaacgagaacctctatcagaatccattctgggaatag

SEQ ID NO: 940 - DNA, 396 bp, B.fragilis
tattccgaatcagcgggatcctgcataatgccaaccaccggattctgtccggggtcaccttgctcccccttattcccgttggtaccgtcgacaccatctttgccatcggtaccatccacgccatccttaccgtccgtaccattcgtaccatctgcaccatctttaccatcggtaccgttctcaccatcttttccgtccgtaccgtcggtaccgtccacaccgtctttaccatccgtaccatctacgccatccttaccgtccgtaccgtctatgccgtctttcccggcatctccatccggaccggtatctcctttcttcccgttacggatagtaatcggagcacttttggagaaggagatagtataccccgcaccatccgccagttcctcgatatga

SEQ ID NO: 941 - DNA, 204 bp, B.fragilis
ggtataggaccttcttatttagtaaactcattcaaatttgcaagtccgaactatccgtttttatacattagatcaaatattttttttaaacctcttagagatttcacctcacaatgccctccctaccgtatagataccttctgttatttaagcatattggaaagttacacctgctggaatatgttcataccgaaaaaaatgtaa

SEQ ID NO: 942 - DNA, 891 bp, B.fragilis
gatattggtacatttttgtttttttataatatacatcaacctatgaaaaccttaattgaaaatttgacttctgatttgctacccaatcagatttttcaaaccggatttagctttttaatcatcttaaaagggaactccttattgaagttggatagcaatgttttgatttttattatgagtggtactatgaaagtttcctctgctcagcaagagttggctaccgtcagagagcggcatatctttttctgggataaagaagatgactatacctgcgagatgctttcggactcacaggtcatcttatttgcatttggtgatttaatagtacatgatttattgacattccgtcctttcggagccatttcggatagttctgtttcaaaagatgtgggacttaaatttgccgagcctttgaattcttttttacagcttcttgcacagtacatggagatgaatttatatgatctctccttgtatatagcgaagcagcgggaactgttctatatcctgaattctgtttataatgagcaggaacttgccattttgttcagttccttgacggaacagtcgtccaggtttaaagaacagatactggagaactatctcagtgcaaaaaatgtgggtgagttggccagcctgttaggctatggcgtcactaattttcgggcaaagtttaaagaacagttcggagtgtcggtctaccgttggcttctcaatcggaaatcgcaacatatcatttaccgtattaccgtatatggtgatgagtttagccagattatcgatgacttcggattttcatctccttcacactttaataaattttgcaggtcacaatatggactgacaccttgcgaacttcgcaagaaattgaaaacaaacaataattcttaa

SEQ ID NO: 943 - DNA, 993 bp, B.fragilis
caggaggtaacttctgtcatatctccatgtattattttcaataatagaataggtatgaataagtttatatatatttttgttgcaattgttgcaataagctttgcttcctgtacgcaagaacgtgcaaaagagaaagaattaaaagttttgtcatggaatgtatggcatgcgggacatgctaaaaattatcctgaaaaaggatgtgaaggtactatcgggattctgagaaagagtcaggccgatgttattttgatgattgagacttatggtgcggctccaatggttgcagactctttgggatatgattatgtattgttatcagacaatctgtgtatttatagccgctatccgattaaaaaaacatatcttttccctgactccatttctacattcaattttggaggagtcgaaatagacatggatggcacaccggtccgtttattcgatacctggttgcattatttacctgatatgcgcttggtacctaccgaacaatcggaaacagatattctcgcatgggatgatgccggtacccgggataatgaaatacgccgcatactctctgtcttgcagccgatgattcgtcagactgacagtattcccatgattatgggtggagatttcaatgtgcattcccatcttgattggactgatgcaacgaaagacatgtatcatcatggtggtgcagttgtggagtggactgtatctaaagagatgcaaaatgcaggtttcaaagacagcttccgcgaaatacatcccgaaccggaaaaaaatataggaactacatggatctatgataatgaagataaaccactccgatccgaccgtattgattttatctattaccaaggtaagaccattcgtgcaattacctccgaatcttataatcaggagttgaccaagcctttgaaatttatgggagaggagttcttttatccttccgatcacggctttgtgatgactacttttaagatatcaccattagaaaaatag

SEQ ID NO: 944 - DNA, 1296 bp, B.fragilis; identical to SEQ ID NO: 845

SEQ ID NO: 945 - DNA, 252 bp, B.fragilis; identical to SEQ ID NO: 860

SEQ ID NO: 946 - DNA, 540 bp, B.fragilis
cgaactattaatgctgtatatatgaaaaaacattttgtatggttgcttttattatttccgcttctgctgaccggatgttatggagaagaagataaagagaaggaccagggagattatatttgggatttcataaactataatatttatttttctgtgaaggatgccgccggcaataacttgctggacccacaggttgcgtcgaatatattgggtaatgagattactgtggaatatggggataaatcctttccattggaaaattctgtggatacccgctttaatatgccccgcccgttgggattgagaaaagaagtgctgggggaagcgaaagagcgtgtgctttcttttggtgagttttctccggaacatcaatataagggagagacctttacgattcattggggagatggaacgaaagatgtggtaaaattcgacttatatatcacctggaagaaacagaaccctacaatacataaaaggctttacttgaatgacaaagaatacagtaaggattctttcctgataaagatcgtgaaatag

SEQ ID NO: 947 - DNA, 279 bp, B.fragilis
aatctttctaatatttctgcctttcattttattaccttacaaaaccaaaaactcttctttataatcaagatatcacccaatcacaagacgcgtgaattacactatcgcaaaatccacacatttttattcagcccatctccttcggaccgtaaaaaagagtttctacacattttcaaaatacaaaatgacaggattgtaagtgatcatgaaaaaacaagttgtgatacctattatgtgcgttttctcttaccatccgggattctgtaccagtttttttga

SEQ ID NO: 948 - DNA, 2136 bp, B.fragilis
atcttttacaaagatatgaataaatttaaatggagaagctttttaagctttttcttaacagaaagaaacattcgtttagttagactaatgtcttttattttgtttctatttgtttttcagggagtttatgctcagcaaacccgcatcaatcttcatgtgaaacaagttcccctaaagcaagtgcttaaatcgatcgaatcgaagagtgaatacactttcttctacaatgatgccgaaattgacatgaaccgtaaagttacggtacaagccaataacgaacgtattgatgtgattttatccaaaattcttccggactgcaaatgtgtagtggagaatagaaagattattttggttcccggtgcggagaaacaaaataccccaaatgataatactgcgaaaacgaaagagataaccggtacggttacagacacacgaggcgaaacgttgataggtgtaaatgtaacggtattgggaactactaccggtgttatcactaatatcgatgggaaatattcgttgaaggttccggcaggtaagtcacttaagttttcatacgtcggctatatcgcccagactgtaaaggtaggtgataaatcagtgatagacattgtattggaggaaaacagtaaagcgctggatgaagtcgtggtagttggctatgctgttcagaagaaagttaatctttcgggttcggtagcaactgtttctaccaaagcgatcgaggaccgtccggtattgaatatgggacaagcgctgcaaggtgctgttgccaacctcaatgtatcggtcggtgatggtgaagcagatgattctccttcttataatattcgtggtaccacctcattgaatggaggttctccgttggttgtcatcgacggtgtggtctctaccagtgatcaactgaatcgtatgaatcctgttgatatagcaaatatttctgtattgaaggatgctgcgtcatctgctatatatggttcacgtgctgcgtttggtgtcatcctggtgacaactaaggatggtagcaatgaaaaacttaccgtcaattataacaacaattttgtattacgtaccaatacccgcatgccggaaattataacagatccttatctggtggcaaccactcgaaatacgatggcatatccatggtataatctttataacgaggagcaactggcctatgcgaagaaatgttctgaggatccttctacttctccttatttcttgaatccggatggattttatacttactttggtcgaacaaactgggttgacgaggcttacaacgatgtaggtttttcaactatccacaacattgatatttccggaaaaacagatcgtatttcctattacttttcgggaggatacaatcggcagaacggtatgtttaagtatggtaatgacatttataaccgatataacctgcgtaccaaattacagtttaaactgacagactggtggagcttgaacagtaatgtcagcctgacgacttccgattatgattatgcgaatgccatgaccaacacttataaacagatgtatcgtaagaatccgatggatatggttaagaatcctgatggaacttggacagatgccagtgtcggtacattgggagcattggccgaaggtggtcgtgctaccgactggaaaacaaatacaaatatcaacttgtcgactaagatagatgtgatcaaagatgtcttttttgtacaaggaacatttgccttttcaaatacaaaaaccagaagtaattggtataatttgcctgtgacttaccgtaacggaccggaattacctgttttgacatttaatccgatttcgaccgtatccgatgcttcaagcagtaactccgatacgaaacatattctatttgatgtatatggtaccttccaaaaaacatttgcgaagaagcatgctgtcactgctgttgtgggtttcaatcaggaagagtataaatatgattacgtaaaagcaaatcgtaaagaactgatttcaagttcactgcctactattaatctggctacaggtgatatgaatatgtcccagagtataacgacctgggctctgagaggtgcttttgcgcgtttgggatatatttataacgacaaatatatttttgaattcaacggacgcctatga

SEQ ID NO: 949 - DNA, 1536 bp, B.fragilis
ttatttatgaagaaaaatttattgtatttattcgcactgatctgttcggtgagtttattggttgcatgtaacgatgatgatccagaatatattcaggatggtgaatttgatggtgtctatttaggtaccttggatgtagatgctgcaggagttataaaagttgatgatattcctcaaaaagtttacataacaaaaacaggcgagaatcagtttaagatggaactgaagaactttagttttcaaacaatggagttaggaaatatctcagttgataacatcgcagttattaaaaagggtaatagttgtacttttagtggtaaagcgaatttaactttagcagttggagcatgcgatgttactgtatcgggtactattgaggataataaattggatatggacattgcagtggttgctgctggtacattaaatgttgcagttgattttgagggaactaaattagctgcagataaaagttcagaagctaagatcttaacttttacttttgcaaatgaatttgttacttctcaacctgttattgattctgaaaataaaacaataacttttgttgtatcagatcagatgcctgaagagcaattgaaagcgttaattccagaatttactatctcggaaggagcttctgttgacaagaagagtggtgtagctcaagatttctcgcagcctgtaacatatactgtaacatctgaggatggtattgttaaaatggtttatactgtttctgtttcaggaaaagaaaaatatttaagctttaatgaatgggaaacaattaaatcttccacgagtggttctttggaacaatatcagaacccgaaaggtacttatggtacaagtaatccgggggtgatgactattaatgaaatgtttgggcaagttggtattccttcttttgagtattgtgttgctcctgttgatggcagggtgggaaaagctgctcaattaaaaacattgcatactgcgattgtcgctaatgggatagattataatgcagcttttggaggcctaatcccttatattactgctggttctttatttactggtacgtttaaaacagatatgtttaatccgttgaatagtacaaaatttggggtaccattcgttggagaacctgtaacatttacaggatggtataaatatgctccgggtgagatttattatgataatactaataaaattgtagagggacagactgataaatgttctatttatgcggttttatatgaagaatctttggatagcaaaggtaataatattccattgactggagattataaaaataaagaagtatatatcgggtcttcaagccgagttgtgatgaaagctgaattgtctgatgggtcggcaaaagctgaatggacgcaattctctgttccttttaaacctgttggagataataaatatgatgcaaataaaaagtattatgttgctgtgatatgctcatctagcttcgaaggagattactataaaggtgctccgggaagtactttaattgtagatgatttttctatcctttcaaaataa

SEQ ID NO: 950 - DNA, 804 bp, B.fragilis
ttattgaagaaacaaatgaaaaaatataaattctttatagctatattgactttctcaattctacacagcatctcagtaaaggcacaagaagagagaaataaaggtatcatatggtcttctcttagaggattagaatatgaagtaaaagcaggatttagtattggcggcacttccccattaccattgcccaaagaaatacgttctatagatagctacaatcctaatatggccatagccattgaagggaatgcaaccaagtggtttggttctgataaaaaatggggaatgctattagggctccgtttggaaaataaaagcatgacaactaaagctacagtgaaaaactataatatggaaatcatcggggatggaggggaaaaagttagtggtgtatggactggaggtgtgaaaacgaaagtcaaaaattcctaccttacaatacccattcttgcaaagtataaattaactaagcgatggaatctaacagtaggtccttatttttcatatatgcttgaaggagatttttctggtaatgtatatgaaggttatctacgtaaaacagatccaacgggacctaaagtggaattcacagatggtaaagtcgcaacttacgatttctccaatgaccttcgtaaatttcaatggggtatgcaactaggaggagaatggaaagcttttaaacacttaaatgtatatgcagatctctcatggggattaaatgacatctttaaaaaagacttcaaaacaattacatttgctatgtatccaatctatcttaatttaggatttggatatgcattttaa

SEQ ID NO: 951 - DNA, 1248 bp, B.fragilis
  unsure (8),(16),(29): Identity of nucleotide sequences at the above locations are unknown.
aaagtctntgagcctntgaccgagtggtncagttttctgaagttgagaggttcctatggtagtttaggaaaccaggatgtggatgcttatgcatatcttgccacgatgggatcaggaaaaatcagtcagatactggataagcagcaaccggtatatgtgggagctcccggattggttgccggtaacttaacctgggaaaaggtaactactaccaatcttgccttggatgccaatttctttgataaccgtttaagcataacaggtgaggtatatgtacgtcgtacaaaagatatgttaacccccggagttacgcttccaagtgttttgggaaccgacgtgcccaaacagaatgcagccgatttaaagacggaaggatgggaattgactgtgggttggaaagatcagttcaagttggccggaaaaccgttctattatgatgtaaacttcaatctggcggatagccgtgcttatattacaaagtacgaaaatcccaagggattgctgggcgattattatgtaggaaaagagattggtgagatatggggtgtagaaactttagggttctttacttccgaagaagacattaagaatcatgccgatcagtcatggtgtacttcttatccgggtacccgtcctttggcaccgggtgatctgaagtttaaagatgaaaacaaggatggtaaaattactgacggagcatggactttggaagaccatggcgattataaaattataggtaatagccgtgctcgttatacatttggtttatcggccaatgcacagtggaatggattcgatctcagcttgtttgcccagggagtaggtaagaaggattattatccgggtacgggtgacctctatttctggggtatctatgcacagccttggaccaatatcaccaaaggtaatatgtatgaccattggacggaggaaaatccggatgcgtacttcccccgtatgaaagcttatgtggcggaaaatacggatagagaatgtggagtggtacagaccagatatttacagaatgcagcttatatgcgtctgaaaaacctcacagtaggttatacacttcctaaggtattgttgaataagataggaattgagcgcttgcgcattttcttctccggtgataatttgtgtgaattttcgggtttatacaagcattacaaagtagatccggaaagcttaggtgacattgtctatcctcttcagcgttcttattcattcggtttaaatgttacattctaa

SEQ ID NO: 952 - DNA, 606 bp, B.fragilis
cattataaagaacagatggaaacagcagaaaacaagtacatcactgtagcttacaaactgtatacaacagaagatggtaaaagagacttagtagaagaaacagcagccgaacatcctttccaattcatttcaggtttgggcactacgctcgaagcttttgaatcacagatagtaaaccttcataaaggagacaaatttgaatttactattccttttgccgaagcttatggtgaatatgacgaagaacatgtaatcgatcttcccaaaaacatctttgagattgacggaaaattcgataacgaacatatctatccgggaaacatcattcctttgatgaactcagaaggccagcgcctgaatggtagtgtagttgaagtaaaagccgatacggtagtgatggatatgaaccatccgttggccggtgaagatttgactttcgtgggcgaggttaccgagagccgtccggctacaaacgaagaaattcaggaaatgattaaaatgatgaccggcgaaggcggatgcagttgcggaagctgtggcgacggttgcggtgacgactgcggagacagttgtggagacagctgcggttgtggacattgccattaa

SEQ ID NO: 953 - DNA, 1383 bp, B.fragilis
aaccattcactcatccggataggatattctttggttaaatggatggtttataagagtatatttcctacttttgtgcaaaatataaaccttggacagatgactgaatcagaaagaaaacagataatcgctttaatacagcgggaggtgattccggctatcggatgtacagagccgattgcagttgcattgtgtgtagcaaaagctacagagactttgggggccaaaccggagaaaataaaggtattgttgagtgctaatatcttgaaaaatgcaatgggagtaggaatccccggtacgggaatgatcgggctgcccatcgctatggctttgggtgcgttgatcgggaagtccgattatcagctcgaggtgctgaaagacagtactccggaagctgtagaagagggaaagaaactgattgatgaaaagcgtatctgtatttcgttgaaggaagacattacggagaaactttatatagaagtgacgtgcgaagccggtggtgaacaggcgacggctatcatttccggtgggcataccacctttgtttacgtggcaaagggagatgaagtactgttgaataaacagcagacttccggggaggaagaggaagaagagactctggaacttactttacggaaggtgtatgattttgcgttgactgctccgttggatgaaatccgctttattcttgagacggcacggcttaataaaaaagcggcagaacagtcttttcagggtgattacggacatgcgttgggtaagatgcttcggggcacttatgaacataaaattatgggggatagcgttttctcacatattctttcgtatacgtcggcagcatgtgatgcccgtatggcgggagccatgattcctgttatgagtaattcgggcagtggtaaccaggggatttctgcgactttgcccgtagtggtatatgccgaagaaaacggaaagtcggaagaagaattaattcgtgctttgatgatgagtcatttgactgtgatttatattaagcagagtctgggacgcctatccgccctctgtggctgtgtagtggcggcaaccgggtcgagttgtggcattacttggttgatgggaggctcttataagcaggtggcttttgccgttcaaaacatgatagccaatctgaccggaatgatttgtgacggagctaaacccagttgtgctctgaaggtgacgacaggagtgtcgactgctgtgttgtcggcggtaatggcaatggagaatcgttgtgttacttcggtcgagggaattattgacgaggatgtcgatcaaagcatccgaaatctgacgcggattggatcacagggtatgaatgaaacagacagggtggtgctcgacatcatgacacataaagggtgctaa

SEQ ID NO: 954 - DNA, 1065 bp, B.fragilis
atacgggggcttatcgcggtaagcgggctttgggagcacctgtattctcaagcgtggcagttagtggtaactgtctgtttgttgccgattttggcggtaatatttataattttaagttacacaattaaatgtatatacaaaatgaaaaagatatctatactatttatattttccttgattcttggtttatttgtcagtgaagtaagcgcggccggcccacgtttgaagcaacgtcccaagcatgtggtattggttgcttttgacggattgagtgctgttgctatccgtaatcatcccatgcccaatttcaatcggttgatgaaagaaggagcttctacattgaataaccgttctatcctcccttcatcgagtgctcctaactgggcctccatgtttaccggagtaggaccggaacttcacggttacactacttggggaagcaaaacaccggaaattcctccttttatcaccaaccaatatggccgttttccgggactgtacggattgttgcgcgatacacatcctaaagcggaactcggttatatttacgaatgggatggcatgaagtatttagtcgattcgcttgccatcaatcatttcgtacatgctccacagacaaaagatcatcccaagggagcgacacaattcgccgtcaattatctgaaagagaaaaagccgatgtattgtgctgttatatttgaatatcctgatcataccggacatacctataaatgggaatctaaagagtattatgaaaagttagatgaattggatgggtatttaggtgaaatagtagcagctattgaagaagccgatatgatggacgaaacagtgattattttgaccgcagaccatgggggtatcggtaccaatcatggaggaaaaacgctcaatgaaatggagactccacttgtcttttatggaaagggggtgaaaaagaattataagattactgaaagcacgatggttattgacgtacctgccacagaagcctggttgttgggtgtagagcctcacgaagcttggttgggcaatccggtaacaactgcattttttactaaataa

SEQ ID NO: 955 - DNA, 192 bp, B.fragilis
ttagtaatttttaattttcattctaaaacggagcaaagtaacagctttatttccatccaaacaaggtctatcttacgtattttatgttctaaatttaagattaagttggttatcgagcgaaatcgtattaaaaaaaaattaatctatgattcgaatcgagcaaatataatatatctccatcatcatctttaa

SEQ ID NO: 956 - DNA, 1680 bp, B.fragilis
agcggctccttgcaatcgagcggcgaatactcaaacatcattataacgagtgcttatgccgatctgaccggtttggacaatccctggccggctgtttctgatgaattgaaatctgcacagaacaatgtgaagacgattccgacaatcggttatcatgccggatcggcaactttgtcacgctggagtctttataagcagatacgacaggcgaatgagttcattgcctatgcccacgttattccgcagaatggcgatgtggctgactttattgatgaaaaagaactggctcttttgaaaaatgaagcacgtttcttacgtgcctattatcattacctgttgtttgagttatatggcccaattcctattatgaccgaaattgctgatccctcggccgctgatttggactattacagaaatttggtagatgaagtagtcgcttttatcgataaagaacttaatgaatgctatgacctacttccggagaaagaactgaatccggatggcaccatcaataatgagcgtgcggcagcgccaaccaaaggggcggcattggctatcttggctaaattgcatgtatatgcggcaagtccgttgttcaatggtggttatcccgaagctattgctttgaaggataatcaaggcaagcaacttttcccggcaaaagatgacacgaaatggaagactgcattggatgctttacaacgttttatcgattattcaaagggacgctactctttataccaagtaatgaaaaatggtgaaatcgatccggctgagtcactttatcagttgtttcaggtaagcgttaacaattccgaagctgtttggcaaagtagtaagaactcctggggaggcgtaaatggtgagggtcgtgagcgtagatgtacaccgcgtgcaatttttagcggattcagttgtgtcggagtcctccaggaagccatcgatgactttttgatgagtgatggcaagagcattgaagaatcgggtttgtataaagaagagggcattggtgaagacggtataccgaatatgtataagaaccgtgaacctcgtttttaccaggatataacttattccggcaaagtatggcaaaaaacagataagaaaatttatttttataaaggaatgcctgacgataattctaaagcagatatgagttattcgggatacttactttataaaggtatgaaccgtgacttgttgaatcagggaaacaatccgaaatccaaatatcgcgcaggtatgttgttccgtttggccgatttctatttgttatatgcagaagctttgaatcatgtaaatccgggtgatgcacgcatcattcagtatgtggacagtgttcgttatagagccggtattcctttgctgaaagatattaagccgggaattatcggtaaccgggagttgcaggaaaaagcgatccgtcacgagcgtcgtatcgaattgtttgccgaaggacaacgctattttgatgtgcgccgttggatgtgtgctgaagaggagggttataaacaaggtggtccggttcatggtatggatatgaatgctaccgatcttgaaggtttcatgaaacgtactgcttttgaaactcgtatttttgaaaaacgtatgtatctgtatcccattccgttggcagagatacaaaagtcaaaaaaactggtacagaatcccggatggtaa

SEQ ID NO: 957 - DNA, 1137 bp, B.fragilis
aaaagagtaatgaataaaggatttatactaaaagccctgtttctgttatgctttcttttctcacaaacagcccaaggacaatctttcactcccggagagatatggcccgataatcaccaggtacatatcaatgcgcatggcggaggcattttatatgaaaacggaacctattattggtttggcgaacacaaaacagaaggtgaagccggaaatttagccaatgtaggggtgcattgctactcgtccgatgacttatatcattggaaagactgtggtattgcactatcagtgatagaaaatgatcccggacatcccatttctaaagggtgtattctcgaacgtcctaaagttatatacaaccctctcactaagaaatatgtcatgtggtttcatcttgaacccaaaggtgcaggatattcgggagcactaagcggaattgcccttagcgaccgggttacaggcccttacacctttctaaaagctgtccgtcccaatgccggttcatggcccatcaacgtactgcccattcataaaaccacccgcagaccttctgcagaagaagaacgtcaatgcaccggaggtagtcttcctgcccatccggacagcctcaacatattgggccgcgacatggagcaggggcaaatggcgcgtgatatgaatctgtttgtcgatgatgacggtaaagcttaccatatctactcctccgaagagaatagtacgttgcacattgccgaactggatccgacctatacaggctatacaggcaaatatatccgggcctttattaaccggttcatggaagctccggccatgttcaagaaagatggtaactattaccttattatgtccggctgtagcggatggaatcccaatgccgcacgctctgccatagcttcttccatttggggagaatggaaagagttaggaaatccttgtataggtcaggatgcagaccttacttttcattctcaaagcacttatatcctgccggtacaaggtaagaaaaatcagtttatatacatgggtgaccgctggactccacaaaacgctattgacgggcgctacatctggcttcccattcattttgaaggtcccaaaccgattatcgaatggaaagattcatggactttagactaa

SEQ ID NO: 958 - DNA, 1359 bp, B.fragilis
aaacaaacaataattcttaaattgaagcttatgttaaaaaatcattgttgtatggggacaggatgcagaagagccatccttttccttcttttttttccgctgtttggtaccgggtttgcccaaacggaaacgccggttaaggtcgataaacctcttaaatcgtattcacattggtattttggagcagaatatggtgtccctttcctgtttggcgattttacttcattctcggcggataaaaactatgtcggatctcagtttggagggtttgccggttatcaggttaattcgtggataggcatagaggcatctgcgcgaaccggatataccagaatgggggcgaaatcttacgcgggtgattaccttatgaatgccgacgggatgacttattatacgaatcaggattttaatacctggaagtacaaggatgtgttttcgaaagtacactttacgaatattggtttgcagatgaatctgaatgtgaataatttctttggccctaaccggggaaatcgtcgctggacggtattactgagtcctgccgtctatgcacaacatttctctacagagttaataaataaggcagataaaagcccattatcaggaaaaaagacggataagtggaacatcgggatagggggagatgtgtctttgcgttataagatttcccgggcttttgatgtacagttgcgtacgggaattatatgggtcaataacaataagatggatggtatatctacgctgattaagtcgaaagaccactttatgaccagtgccggactctctttgatatggaaggtgggtaaaaagaaagaagacaatgttctctatgcctcaagacgagcggcggatgtggagatcagatatatagaggagcgtgcggtcagcttgcctacccctgcttgttgcgttgaagattcgatagagaaggagcggatgaaacgggagattgcttctttaaatatgcagttgcaacaggcgcacacggtagtgaaggagaagaccggttctgatccgatactgggattcaacgaattgcctccggtctattttaagagaggatcggcttatctgaatgtagccttgtacaaaaatgaattatgccgcatcgtgcaaaccctgaaaaagtatcctgagctgaaagttattctttcagggcatgccgaccataccgggaatccggatattaatcaaaaaatctctttacagcgtgccgaagcactggcagcctatcttgaaaagaaggggatagatggcaaacgtatcgccgtgaaaggagagtgcatagatatgcttacttccgatccgaataattacagcgtacttgccaggcgagttattgttgaaatccaaaaatga

SEQ ID NO: 959 - DNA, 582 bp, B.fragilis
tactttaaaatgaaggaaaacacaatgtattcgaatcttgaatcggtagaacaattatttcggcaatattataaggtgttgcgggtatatgcgttccgttttgtgaatgattgggatattgcagaagacgtagtgcaggatgtttttgttgctttatggaataaacgtacagatattgaatttgatggcgcggtaaaagcctatctttttaaggctgtctataataaatcgcttaatatcctttccagtaagaaatataccgaagaagaatccgtagaacaattttccgatcaaatcgaagcactgcaaattctggagaataatcaggaaaactcgttgttcatgaaagaactccagagtgaaattgaaacttttatcgaaacacttcctacgcaggtaaaaaaggtatttatattaagtagaagctatggtctgaaaataaaggaaatctccgttcagctcgatctttctccaaaaaccgtagaaaagtatttgacccgtgctttgttggaactacgtactcatcttaaaaacaaggatttaatgagtcttttattcttgctttatctctgcttgaaataa

SEQ ID NO: 960 - DNA, 1131 bp, B.fragilis
aatccaaaaatgaaaactatgattagaaagaaaatatatctgttgttgttattgatacctttgctgcatggctgtaaagagtccgatttcaacgatttacttgacagacagggtgatcagaggaaagaattgcaagagttgacagatctatgtaaaaaactgaatgaggatatttataatcttcaggtgattgtcaataccgacaggataggagataacattactcatatcgaggaactggcggatggtgcggggtatactatctccttctccaaaagtgctccgattactatccgtaacgggaagaaaggagataccggtccggatggagatgccgggaaagacggcatagacggtacggacggtaaggatggcgtagatggtacggatggtaaagacggtgtggacggtaccgacggtacggacggaaaagatggtgagaacggtaccgatggtaaagatggtgcagatggtacgaatggtacggacggtaaggatggcgtggatggtaccgatggcaaagatggtgtcgacggtaccaacgggaataagggggagcaaggtgaccccggacagaatccggtggttggcattatgcaggatcccgctgattcggaatattactggactataaaaataggttccggtgaaccttattatctggccgacaatgatggaaacagaataaaggcaacctctacggtacacgatggacaaacccctcaactgggagtgaagcaatgggaaacgtccgccgggggcgacgataactattactggacgcaaaagattggaaccggtcccgagacatggattgaagcggatggaaagaaaatagttgccaatgcaaaaaatgctgtgtccgtgtttgagaaggtggacttgaaggagccggattatgtggaatttactttaagcggtggagcaacccggttcagattacctataggaagaccggttattgaggttccggagggacgtaaactgttttttttcaaccggggcgggtctcaggcgattgctttcagttgtaagggtatctcaaaagagcaattgtcggtagatgttccgaaggggtggagagcgacagtcgattctgaagcggtagctagtcttcaccgacggggctgc

SEQ ID NO: 961 - DNA, 1137 bp, B.fragilis
actaaaaggattattaatcaaaaacagaatcgaatgaaattaaagaatctgatagcctgtttctttctgggctttataatggtttcttgcatacaagacgaagcacctaatgcagaagctgcaattgacgcatgcaaaggatccgatgatgtcgtcttgacagatattaatgcagaagcaaagagaataagtatatatgtatacaaaactgctgacatcacaaaacaaaaattaaattttgtattaccacaaggagcaacaataaatccccctagtggaatagaaaatgattttaccaccccacaaaagtatactgttacatcagaagatgggaaatggtctgctgtctatactgtagaattcgtaaaatcagaactccctacaaattatcatttcgaaactctcacagaatcatctgcaaacaaatatgatatattttacgaatttcaggagggtacttccacagaaccatctaaaatagtacaatgggctagtggcaacattggatacgatttgacaggaatggctaaagaatccaatgattatccaacagtacaagtaaatgatggaaaaattgggaaatgtctgaaattagagacaaaaaacactggaagttttggggcaggagtaaatatgccaatagctgctggtaacctttttattgggaaatttgatgtatctaacgcacttgctgatgcactaaaagctactcaatttggtttgcctttttataaagttcctcaatccttaaaaggatattataaattcaaagcaggagatatattcacagaaaatggtaaacctgttgaaggcaaaaaagaccaatgtgacatttatgctattttctacgaaacagataataaccatgaaatgttagatggctataatgcactgacctctcccaaattgatatctgttgcacgtattgaagatcctaaagaaacagatcaatggaccgaatttaatttgcctttcataatgaggccaggaaaaactatagatcaggctaagcttaaagctggcaaatataaactaagtatcgtattctcctctagcattgaaggagatcattttcgtggtgcagttggaagcaccctttatatcgatgaagtagaacttattttcaaagaaaactaa

SEQ ID NO: 962 - DNA, 1059 bp, B.fragilis
atttcacttgtattactaatagaggagctaaaaatgaagaatgaaattaaagacataaatgaagttatcatacgttttctggatggtacggctaccggtgaagagaaagtttttctgttcaactggctgaaacaatcagaaaagaaccggaatgaattttccgaagtccgtgatttatggcttttaggcaacacgatagctaccgacgatctggaaacagagatagcgctagagcgatttaaaaatcggatacagtcaacagaatccggtttacgtaaaaacagattcgttttccggaaacacttcgttccgttcttgcgtgtggcagctgtctttttgatgttatttactgtatggtctgtcttttattattggggtagcagttcggtcccgaaacagccggatgtcatgaatcgtttgttgactgccaatggaagtaagggacgatttgttttgccggatagtacggttgtatggcttaattccaatagtttattggagtatcctgaaacgtttagttcgtcagcccgtgaagtcagtttatccggtgaagcctattttgaggtacggaggaatgagaagcttcctttccgtgtgcaagccggagagatgaaagtagaggtattggggactcgttttattgttgacaactatcgacggaaatccggggttgaagcagtattggtagaaggtagtgtgaagattgccggttgtaagatgaatcattcggtagtgttgactcccgggcagttgattaattatgataagaagagtgaacgtacgaaagtacaaatggtgaatacggatgattatatcagttggattcaaaatgaactgacttttgataatgataagttggctgatattattattaatttaaataagtggtatggggtggatattgaatgtccgtcagagtttgctgaaaaagtatttatgtcgttctctgtcaggaatggagagaatctggatgaaattctgaaagcgatgactttggttgctccaataagatattactgggagaatggtatcttacatattcttcccagaaagcgatag

SEQ ID NO: 963 - DNA, 2475 bp, B.fragilis
tatgataaattaataaatatgttgaaattatttataagcatggctgctttattcctgggagtcggtagctctgtgttcgcacaaatagaaggaaaagtttatatcgatgcgaacggcaatggcatttgtgatgcgggagagagggggctaaaaggagtctgcgtacaagatggtctcaatgtggtgaaaaccacagatgatggtcatttcatacttccgggacataaagatacacgttttgtaactttgactgttcctgatgggtatcaggcatcaacctcccattacctatcttttgacggaaccggaaaaaagtatgaattgggtatctgcaagacctcggtaaataccgggaatggatattcgtttgtacaaattacagatacggaaacttctctatacggtgattggatcgataacttgaaagagtacgtgaaaaccaatccgactgcttttattatccataccggtgatatttgttatgaagctcatcaggattttcatggacattatcttcgttccgtagatttgggaattccgacctactattgtgtggggaatcatgatctgcgtgccggaaaatacggtgaagagttgtggcaaagtcattttggtccttcatggtattcgtttgatgtcggtaatgtacattatgtagtaactccgatgctgggtggtgatcatgcaccttcgtacaggcgttccgacatcatccgttggctgaagaatgatcttgcacaaacggataaagggaaaagaattgttttatttaatcacgacttatggttttggggagacgatttgctcttcaaagataaaaatggcgaacagatagactttgctgattacaatctggatgccatgatttacggacactggcacaatcattattataagcagttgaagtcaggacttcatacttactgctcatccactccggacaaaggaggaatagaccatggaacttcttgtttcagaatttacaatgctgataccaaaggtaaattaagttcagcaactcgttatacttatatagacggaatattgacttctgcctatccggcggaaggtgaaactgtttcagttcctgacggaaaaatgacggtccggatcaatgcttaccgtactatatcggatgcgaagaaggtgacggcttctgttgaacgaaacggaaggcttgtatcgactgtgacgcttatgcctgaaacagactggggatggagcggggcagtccgggtatccggcggtaagcaacgcctgttggtgactgccgagtttgaagatggaactcgtttgacgaagagagtagactatactgtaactaagcagccgttatcggtcattgcgacatctgatgtctgggcagggcttcgtggaaatgccgcacacaaccaactggtgaatgacagtgtatctttacccttgcaaaccaactggattcagaatgtcggcagcaacatttacatgtgctcgccgattgttgcgcagaacaaagtctttatcggaaccattgatgatgacaaagcgaagaaatgctatgtaaaagcctatgatgcgaccacaggacatctttgctggacctttgtcacttccaattcgataaagaataccattgcctatgaagatggccgtatattcgcttcggatgcttcgggaatgctttatgccatagatgctgaaaaaggaacagcttgctggcaaacgcaattgccggtttctttgctgccgcttctcgacgaaggattggccgtagccgatggtgtggtatatgccggacatgcaaaaggtacttgtgctgtgcgggctgtcgacggaaaaattttatggcagaataaagcctgggacggaggcgagggaaccacttctacctttaccgtgggtgcgggagtgttagttgcatcggcccattggaacgggcttttcggacatgacatcagtaatggtgctttgttgtggaagaagcgtgatagtaaaattcgttttcgagacggatcagctactttctatgatggtaatttctatttagcttcatgtgagaatctgtatgtaatcaatccccgttcgggagatattctgaaaatggcagaaacttcttatgaatttaattcggcttgcgctccgcttgtgacggataaatatctgattgtttctacttccaataaaggtgtggtcgcttttgaccgcctcacttttaaggaagtctggaattatcgtaccgggacaagtcttttctataccgttccgtattcacataatcaggaatgtacggtcgaggtttcgcctgtccttgtaggttcgactgttctctttggcgccagtgatggatatttgcatgccgttgacctgaatacgggggcttatcgcggtaagcgggctttgggagcacctgtattctcaagcgtggcagttagtggtaactgtctgtttgttgccgattttggcggtaatatttataattttaagttacacaattaa

SEQ ID NO: 964 - DNA, 894 bp, B.fragilis
gaaaatggatttaaagaacgaaaacagatgaaaagaataataataggaatgattgcctgcatttgcgcaatcaccgtaatggctcaggttcagacacacgacataaaaggagtagtattcgatagacgacagcaacctattgtgggagcattggtcaccgccaaaggaaccaatatcagtacaatcaccgatgtagatggcaaattcctcttgcaggaggttcctctttcggtaaagaaagtagtcgttacatccatcgggatggagacccgggaagttgacttgaatgtaccggtacagctgaccggaaaacgtaagaaggtctcgtttgtggcacatgccggtcttagtatgagtaaatatacgatatatggttccgactttaaagtgggatatgaattcggtctgggtatcgaggtgcgtatgtcgaagcgttgggcttttcagcctaccttgcaaatctgtaatcacggagctgagttcaatgccgaaagatatggcgtgaaatatcaggagacttggaatccggtatcactggatttgccgatgttgttcattcttcgttgtccgatagcccgcaaaatgaatctggcattttctatgggacctgttttttcgtatggttttgcagggaaagtgaaagctagcgagacaggcaaacccgatgaagagtatgatatttatagcagtgagtatgaatacgactattccggtgggaaacattctttgctgcatcctttcagctttggtgtagcctatggcataggggtggaatacaaaaagtggctggccggtatttcaggaaagagcatgtgtctggggcaggatgatgaaggctttgaagcaaaagagcacaatctggtacttaccttgggagtcactaaccgtaactga

SEQ ID NO: 965 - DNA, 258 bp, B.fragilis
acggaaaaatcgttctgtagggagttatgggtttgtcttatggacggtgattccgctcgctttctgatagaatgtcacaagataggtgcgattgcttcgctgaagtatttccttgaaggaaagctgtgtctttctgttgttcctttaagtgcttcggacacttcacaaccggaacggaaaacgcaagagtcaggggagaaaaacaggacaatagacctgatggacaaaaacaataggagatatttgaaaaagaagtaa

SEQ ID NO: 966 - DNA, 1980 bp, B.fragilis
aacggaactccgtatccggaacaacctgaatgcctggctgcgggataccacggtgcttatcatcacccaacgcatatacaccatgcaatcggccaaccgggtcattctgctggacgacggggagatagaatccatcggcaccccggaagagttgttggaacggtcggaaatgtatcgggaaatatattactcacagcaaatcgttatctgaccatggcacacggagatcatctgaaatacagcggaaagcctaaggcgggaaagaaaacatttctacgcctgatatcgtacgtggcctgtgaccggcggttactgattgtgatcggtgtgctgatcgtgatcagcattgcggccaacctcaccggatcgtacatgcttcgcccgattatcaacgactacatcctgccgggcgactttcagggactggtgcgcatcctgctgttcctggcagctatctacctgacaggagtggcggctacttacatcgaatatatcctgctgaacaagataggacaacgcaccgtgacccggatgcgtgaggaactgttcggcaagatggaacgtctgcctgtcagatacttcgacacccatcagcacggtgatgtcatgagccggtacaccaacgatattgaccgcatcagtgacgcattgaccgacagcctgtccgatatgctgtccagtgcactgacggttatcggtattttctgcctgatgatctttatcagcccgacactgacagcggtaacgctgattactgtccccctgatgttcctcagtgccaaaggcattgtgaaacggagccggaaatacttcaaagcgcagcaggaagcactgggaatgatgaacggctatgcggaagaaatgatcagcggacagaaagtggtgaaagtattcggacacgaacagaaggtggaaacagacttcgggatactgaaccaaagcctgaaggacaaatcgttgaaagcacaattctactcggggctaatgatgcctgtcatgcaaaacctcaatacgctgaactatgtgatcatcaccattgtgggggctttactggccatcttccgcggattcgacgtaggcggactggcagctttcctgcaatattcacggcagttcggccgcccgatcaatgaactggcaagcctttacaacagcatacaggctgccatagccggagccgaacgtatcttcgaaatcatagatgaagcgcccgagaaagcggatgttccggaagccgtcacactgaaaaatataaaaggagacgtagccctgaagaatgtgtatttcggctaccgtccggagaaaaccatcttgaaaggagtgtccctgcatgcaccggcaggaaagaaaatagccctggtaggcgccaccggagccggaaagacaacgatattaaacctgcttccccgctttttcgatattcagtcgggagagatcaccatcgacaatcacccgatcgaccggatcgagcgcaacagccttcgccgttcaatggctatcgtgttacaggacacccatctcttcacaggtacggtacgggagaacatccgcttcggacgcctcagtgcgacggatgacgaggtagtggcagccgcccgcctgaccgctgcccattcgttcatcaaacgcttgccgcaagggtacgatactttgctcgaaaacgacggagccaacctgagccaagggcaacggcagctattgaacattgcccgtgccgcagtggccgatccggccatcctgttgctggacgaagcaacgagcaacatagatacacgcagtgaaatcttgatccagcggggattggacctgttgatgcaaggacgcaccagcctgatcatcgcccaccgcctgtctacgatccgcaatgcagataccatcctggtactggagcacggagaaatcatcgagcaaggcagtcatcaggaattacttgcattgaagggaaaatattattcgctgaatgaagagcaattcaaataa

SEQ ID NO: 967 - DNA, 195 bp, B.fragilis
agaatcagcgccgcattgagtgtggcaagtaccagtccggttgccacaaagggcttccgggaccagtgcaaccatcggttaaacgggcgtccgatgatggaacagatcgtgaaaatcagtttcggtgaagcaaataggaaaaagacaacggcaaaacgccctatccataacgtatgttgctcggcgtattcatag

SEQ ID NO: 968 - DNA, 1725 bp, B.fragilis
atgaaaaaatactggcaaatactgaagaagtacaaaataagcctgctggcatgcccgttgctggtactcgtgtcggtgatgtgcgaaaccgttcagccgatgtacatggcggatattatagacaacggagtgatgcaaagagacctctccgtcatcactgccgtgggcggaaagatgatactgatctccattgtcggactgattttcagcattgccaatgtctacgtatcttcccatgcatccattggtttcggaaccgatctgcgcaccggccttttcggcaagatacagcaactctctttcttcgacatcgaccggttcagtacggcttcgcttattacccgcctgaccagtgacatcagccgcatccagcaagtcatcatgatgtcgatgcgcctgatgctgcgctctccgctgatgcttgtcatggcggtgtttttcgttgtacgcatcaatctcgaactggcgggtgtcctgctggctgccatccctatattgggtttcagcgtattctttattctccggaaaggtttccccttcttcctgaaggttcagcagaaggtggatcaactgaatgaggtagtacgcgaaaacctgattaacatccgggtggtaaagtcatttgtacgagaggacttcgaagcacataagttcaaagacaagagcgaaagcctgcgtgatacggtgattcatgcttccaacatcattgtctccatctttccggtaatgcaactggtgatgaacctgtctatcatcgctatcctctggatgggaggccacaaggtgatgaccggagagctgaaggtaggcgaactgatatcgtttgtcaactacctgggacaggtgttgatgtcattaatgatgctttccatgatcatcatgtcttatgcccgtgcttctgcctcgtcgaaacgtattttagaggtactggacacacaaccttcgctgaccgacacacccgaaggcatgcagagcacccgagagattgaaaaaggagagatcgccttcgagaaggtcagcttccgttatggcggcggagagacggacgtattacgaaacatcagtttccacatccgcccgggcgagacagtggccatagcaggtgctaccggatcggcaaaaagttcactcgtgcaactgatcccccgcctctatgatgtcagcgccggagaaatacgcattgacggcatccctgtacaagactataacctgcgcgaactccatgcccgcatcggaatggtgctgcaaaagaacgaactctttacgggaaccatcgccgaaaaccttcgctggggaaaaccggacgccacgcaagaagaactcgaagtggcagcccgtgccgccgaagcccatgagttcatctgctcgttgcctgccggatacgacacactgctgggacggggtggaatcaacctttccggcggacagaagcaacgcatctgcatcgccagggccttgctgcgtaaacccaagatattgatactggacgacagtaccagtgccgtagactctgaaacggaactccgtatccggaacaacctgaatgcctggctgcgggataccacggtgcttatcatcacccaacgcatatacaccatgcaatcggccaaccgggtcattctgctggacgacggggagatagaatccatcggcaccccggaagagttgttggaacggtcggaaatgtatcgggaaatatattactcacagcaaatcgttatctga

SEQ ID NO: 969 - DNA, 1266 bp, B.fragilis
ataattgctaactttgtttcaaatttcaatagcatgatacgtatactacatacagccgattggcatttgggacaaacctttttcgggtatgaccgcacgcaggaacacgaacattttctggactggctggccggtgtcctcactaagaacaagattgatgtactgattgttgccggagatgtctttgatgtttccaatccgtctgctgcttcccagcggatgttctatcgtttcattcacagggtgacgactgagaatccgcgattgcagttggttgttgtggccggcaatcacgattcggctgcccggctggaatctcctctgcctttgttgcaggagatgcgtacggagattaaaggaattgtccgtaaacagaatggcaaaatagattatgagcatttactggtagaattgaagaatgcggcgggggaggtagaagccctatgcctggcggtacctttcttgcgacagggagactatccggtggtagagactgaaggcaatccgtatgcggaaggggtgaaggaactgtatgcccgtttgttgaaatatgcgttgaagaagcggactgacggacaggcattggtggctgtcggacacctgctggcaaccggttcggagattgccgagaaagatcatagtgagcgcatcatcatcggtggtctggagagtgtatcgcccgagtcttttcccgaacagattgtttatacggctttagggcatatccacaaggctcagcgcgtatcgggcagggagaatatccgttatgccggcagtcccttacctatgtcgtttgccgagaagcattatcaccacggagtggtaaaagtgaccctggatgaaggttgggcggttgagatagagaaacttgaatatactccgttagtgcgtttgctaagtatccctgccacagaagctgcggctccggacgaggtgctggatgaattgcgcgggctggaactaccggaagatgaaccgatgccctatctggaagtcaaggtgaaactaagcgaaccggagccgatgttgcggcagcaagtggaagaaatactggaaggcaagccggtccggctggcccgtatcgtttctttctatcggcaggcggcagaggggagcgtggaagaagaaaccctgaccgccggattgcaggagatgaatcccttacagattgtgaaagcaacctttgagaatagttaccaggcggagatgccggaagaactggtaaatttgttccaggaggcttgccggaccatcaatttagaatga

SEQ ID NO: 970 - DNA, 1143 bp, B.fragilis
acaaagatgaacaagagaaaattactaggcttgctctgtctgatgacattgctggctacctcctgtgataataaaggagattattggggggctatggaatcttctaaagcaacattaacgttggagcggatttgtgatatggctacgctttcacaagattccgtggaattgctgtccaatattctggggatgaatacagaagaactgtatcggacagacgtggtcatgatagggaaagtgacaagtgaagaaaccggattctaccagtatcccagatttctgatagctaaagatcgagagatgaaagaagtgcttacggaagcttatgtacatcgtgatacagaagggactttttatgctttcctggaatcgaatatgctccccgtgggcgaaacttattattgcgccatggttgattataattatggctataacggacgtccgggattgctggaccatgtattgggcggaaatacgcgtggcgaacgttacagtgaagtgaagccattccgcctttcagggttgccaagattggttgtgcacgatgcacattttacaggatacagtttctatttatctgcggaggtccgtttcaaaagcaatggcggaattatagaacagggcgcttgttacagttctactaaaagaatccctacggttgatgatcagaagacattggcacgggaaacccggaattatgactattcgtttttagaagtagaggtgaccgatctgcttcccaatacacattattatatacgtccctatgtgactactgaggaagggacaggctacggaccggtagttgagtttacaaccgaaccgggtacggaaccgattattgattatttcacgatgtatatagataccgataggtcggtaaacctgtatgccactttctatatagataattatcagattacgcactacggatacagctatggcatttattctccagaaacgggaacggtgacggatgaacagaagatagaggttcctcttgaggataatcacggacaacagcttagtaaagtcattaccggattgcgtccgggaatactttatgctttccgtgtttatgcggaaaatggagtaggggttacttacagtggttaccagaccgttaagattcccgtagaataa

SEQ ID NO: 971 - DNA, 2991 bp, B.fragilis
tctgtggtgaaagcaaaccgaataaccatgaagatactaaccatacgattaaaaaatctggcttccattgaaggaacttttgaaattgatttccaagccgagcctttacgctctgccgggatttttgcaatatccggacctacaggagccggaaaatctacgatactggatgcgctctgtctggcgctgtatgataagacaccccgcttctccgcttcggtcgagagtctttatatgtcagatatcggtgagagtcgggtgaatcaggccgatgtgaagaatatccttcgcagagggacgggagagggatttgccgaagttgattttttaggagcatccggacactgttatcgttctcgttggtcggtacgccggacaggaagccgggctaacggtgctttgcggtcgcagacgatacaagtgaccgatctgactgccaatcaggaactacagggaacgaggaaagagttgttggcacaattggtgactttggtcggtttgacttacgaacagtttacccgtacggtgctgcttgcccagaatgacttcgctactttcttgaaatcccgtgagtctgccaaagccgagttgctcgagaagctgaccggaacggagatatactcccgtatttccagtgaaatctatctgcgtagcaaaacagccgatgcagaactgaatcagctgaagagcaatgccactctgatcgaactgctttccgaagaggaaatcactcttctacggaccgaaaaagagagtctgaccaaccttcgtgaacagggaagcaaagcattgatagacctgaatgcacagctatcggtgctgcatactttgaaattgcagcaggagcagcgtgataagaaagtgcaggatatgcggctggatgaagaaaaaagtaagaagctccgggaagaatatacacgccagtccgactctctcattcgcttcaggggacagtgtgaagctgtgcaacccgatcttagccgggcacgtgaactggatgttcagatccaatcactggtcagccaatctaagcaggtagaggagatactgcaaggtgctgaaaaggcagcgaatgcacaagccaataaattgcaatctgtgcagggagccctgcatacttcctgccattcgttgaagaatctgacgggagagatcgagctaccggttacggaagagaccgggctatttcttgaatctgtccggaacaggctgaaagagcaggaagaccaacttgccattcttcaggaaaagaacgaagcgcgtgtgaaccgtctgaatgcttttgggattgaagcggtgactgacgagcaagcccgatggatgcaggaacaaacccgtttgcagaatgcccgccagcagatgttggaatggagaaaagcggggacagaggccgaacgtctgaaagcacaacaggaagagatggggcacaaacaagaacagatgcggaaagagataacccttctgaccacccggttgtcagagaaggaggctgaactgaaagtgctgcaacgcctttttgagaatgcccgtatcgcgatggggaaagacgttcggaccttgcggctgaatttgcgtgagaatgaaccgtgtccggtatgtgggggcactgaccatccttataggaatgaggaacaggtagtccatagtctgtatcagaacatcgaacaggaatatcaaaccgcatctgctgagtatcagcaactaaataaccggaatattgccttgaaacaggatttgcttcatctgtcggaattgtccggagagataaccgtacagttgcaggcgttcctccaagaggctgagcagaaacgtccttcgtctgaagaggagcaaaatccggactattttgagaaacaattgcataccgtgcaagggaagctaaatctgctcgcggagaaaatgcaccaataccatcagctctacaaggaatggcaacagcatgaggggcagatcaggacggttcgctcggcttgtgaggctttgcgcgaaggggtggcccgttgccatctgttgatgcagcaagttctggctgctaaagagcaatttgaactactgaaaacggcggaaacgactgctcgggagcagttccgagtggtcagtgaacagttgataactctccgtcaggaacgggctcctttgttgaaaggcaaatctgttgaggatgcggaagccgctattcggaaaaaagagaaacaattaaacgattccgtggaacaggtgcgcaaggagggagaagaagtccagtcgcgtatttccggtatgcagggagagattaggcaactgaacagctccatcgacgaattgatgctccggaaagaacagatagccgatccggaacatttgccggagacgatcgcccgccagcaagccaccaatcaggagaccgaacggcgtctgtcgaccgtcgaagcacgtcttttgcaacaggagcaaaaccggaagaagctgaagcaactggagcaggaactgaccgaaaaacaggagacagccaaccgatggggaaaactcaataaactgattggcagtgcggacgggacaaagttcaaggtgattgcccaaagctatacgttgaatctgttgctgatgcatgccaacaagcacctgtcttatctatcgaaacgttaccggttgcagcaggtgccgggaacgctcgccctgcaagtgatcgactgcgatatgtgtgacgaggtgcgtaccgtctattctctttccggcggagaatcttttctgatctccctggcgttggctctcggcctgtcgtctctttcgagcaataacctgaaagtggagtcacttttcatcgacgaaggtttcggttcgctcgatgccgacagtttgcgcacggtgatggaagctctcgagcaattgcagatgcagggacggaagatcggagtcatttcccatgtacaggagatgagtgagcgcatcgccgtgcaagtgcaactccatcgtgcggcgaatgggaagagtgctatcactttgacaaattga

SEQ ID NO: 972 - DNA, 297 bp, B.fragilis
cgtgtgaacgatttcaatattcaacagaatatgatcaccagtgccgaagaagcactagacctctctatcctggcttataacgagactcgtcagcggtttatcatcgggaaagcagatatcaacagtctgacgctgtctctgaaccgtcagcaagaggcacaacagaattacatttcagccttgcaaaactattggctgaactattataagatacgtaaactgacgttacatgactttgctaccggaatctcgctgactgacaagtttgactatgcgggaggacaattggtgcgatag

SEQ ID NO: 973 - DNA, 1092 bp, B.fragilis
agaaaaagtttaataaccattatgaaaacccagtatccctcttatacgctttgtctggcattgacaatgctgacagcttgttcggtgagaaagaaagagagtgcctctgaaaaaggagtggaaccgtgtttgcccgacacgaaaaacgaggtgtctgtcatgacgctcaaaaagcagatattcaatcatgaattggtgagtaatggaaaaatttctgcccggggaatggctgacctgagatttgaaagtggtgaagtgatagcccatatttgggtaaagaacggagaccgggtacgaaaggggcagaagttggcggagttggacaaattcaaacttgacaaccagttgtcgcaatcggaagacgctttaaaaaagtcggaattggaattgagggatgtacttatcagtcagggctatccggcagacgacattagtcaggtacccgaagagacaatgaagttggcaaaggtgaagagtggttatgatcagagcaaatcacaatatgaaatgtcgaaatacaatgcagagcacgctactttgaccgcaccttttgacggagtagttgctaacctgttttcgaacccctacaatctggccagtacttcggatgtattctgtacggtgatcgatatgcagggtatggaagtagattttactgtacttgaaagtgagttgccattaataaagaacggagataaggtagtgatcaagccctattcggatgccgcaacagtacacgaaggaagtatttcggaaatcaaccctttggtagatgataaaggaatggtgaaggtgaaagcccgggtgaacggggccggtaagctgtttagcgggatgaatgtacgtgtcagtgtacatcgttcgttgggagagcagttggtgattccgaaaagcgcagtcgtacttcgttcgggcaagcaggttgtatttaccctgaaagatgggaagatggcccaatggaactatattcataccgctttggaaaatgcagacagttatagtgtggccgacggactgacagaaggagatacggtcatcgtaagcggaaacattaacctggcacacgaagctccggtcacaatcattgaataa

SEQ ID NO: 974 - DNA, 588 bp, B.fragilis
gatatggaactggatgacttgaagaaatcgtggaatgctctggatgaacacctgaaaaacaaggagttcattgaagaaaaagagatagcacaactgctgggacgtgcccgtaacaagatgaacagcatcgaccggttcaacaggaaactgcgttttgcctcgatcggcatactgacattagcggtgctcttctggatatgcgccgacacacttacagaccttttttattggatagccctctcactgtgcatcccggctctttgctgggatttgtactccgcccattacctgagccggacccggatcgatgagatgcctctggtcacagtcatctcccgcatcaatcggtaccatagatggatggttcgcgaatggatcataggtatcctctatctgcttgcgatggctacttttttctttttccacaggcaagtctggcaatatggtgctgcgggaattatcgtcagcctgatcgtctgggccatcgggctcggaatctgcctatgggtatatcgccggaacataagacatataaaagaaataaagaagaacctcaacgagttaaaagaattaaatcatacagcttaa

SEQ ID NO: 975 - DNA, 1038 bp, B.fragilis
aacatccgctgggaagcagcagacggattggaaacatcaaagacatctccggcaacaatcagtacatcaatcttgttcttagtgaggacaccggccagccagtccagaaaatgttcgtgttcctgcgtgcggtcatacccgaaaaaggtttgtcccaaatgccaatcggctgtatgtagtatacgtatcatgctattgaaatttgaaacaaagttagcaattattcaggacagcaatattattttgtttatttttgcacaagctaaaaccaaaatcattatgaagatactatactatatttatcaaatctgcattgcattgcccattttgttagtattgactatcctcacggcggttgtcacaatcgttggttcattgctgggaggagcccacatctggggatattatccggggaaaatatggtcacaactgatctgcctttttctgttgatcccggtcaaagtgcatgggcgcgaaaagctacatgaaagaacttcttacatctttgtccccaatcatcagggctcattcgatatctttctgatttatggttttctgggacgtaactttaaatggatgatgaaaaaaagccttcgcaaaattcctttcgtcggaaaagcatgcgaaagcgcaggacatatctttgtagatcgctcgggaccgaaaaaggtacttgaaaccattcgtcaagccaaagactccctgaaggacggagtatcattagtggtcttcccggaaggagcccgttctttcaccggacacatgggatattttaaaaaaggagcttttcaattggcagatgacttacagcttgccgtagttcccgtaaccatagacggctctttcgaaatcctgccacgcaccggcaaatggattcaccgtcatcgcatgattctgaccattcatgatcccatcccccccaaaggacaaggagcagataatatgaaagctactatggccgaggcttacacagctgtagaaagtgcacttcccgataaattcaaaggaatggtgaagaacgaagatcaggatcgatag

SEQ ID NO: 976 - DNA, 1173 bp, B.fragilis
gaaaatatgctgcaacgagttttaggctttctgatagtaatccttgtactgccggacatttatatttaccggacatttatcaaacaactgactctaagtcttttctggcggattctgtacttcttccccactcttttcctgatggcaggagtcgtgtcactggctttctttgccaactatgaatacgccgagcaacatacgttatggatagggcgttttgccgttgtctttttcctatttgcttcaccgaaactgattttcacgatctgttccatcatcggacgcccgtttaaccgatggttgcactggtcccggaagccctttgtggcaaccggactggtacttgccacactcaatgcggcgctgattctttacggatcgatggtcggcaaagaccgtttcgaagtaaaggaggtcactttccggtcttcccgtctacccgaagccttcaacggataccgcattgtccagttgtccgatatccacatcgggagttggcagggaaacgccaagagcctgcaacggatggtggacctggtgaatgcacaaaaaccggacttaatcgtattcacgggtgacctggtgaacaaccgggctgcggaattggacggatttgaagagatactgtctcaactgcatgccacagacggcgtctactccatattagggaaccatgactacggaccttactatcgctggaaaagcaagcgtgaccaggtaaacaacctgaacgacctgaagaaaagacaggccgacatgggctggatactgctgaacaacgagcacaccctgctacaccggggaaatgacagcattgccctaatcggggtagaaaacgaaggagaacctcctttctcccagcacggcgacctgcccaaggcacaggcaggaacaaacgggctattcaagctgttactaagtcataaccctacccactggaggcgtgaagtgttacctcaatcggacatcgatctgatgttggcgggacatactcatgccatgcaactggccatcggacatcactcgcctgcctcctggatttatccggaatggggaggtatgtacatggaggacaaccgggggctgtacgtaaacgtcggcatgggattcgtaggtctgcctttccgcttcggagcatggccggagattaccgtgataacactggataaatga

SEQ ID NO: 977 - DNA, 543 bp, B.fragilis
ccaaataaaagtaatcctaaaagaagatcaatgaacctgaatccggcgcatatcaacgagcctgtacaaaaagagttcctctcggtaatcaaggaatacgagcgggttatctacaaagtatgctatctgtataccacccggaacgctacgctcggcgatctttaccaggaagtgattctcaatctgtggaaagcttatcccaaattccggaaagaatgcaaaatatcgacctggatttaccggatagccctcaacacttgcatcagcttcatccgcaaggaaaagaatgtgccggaaatcgtcgcactgacccgcgaagccgactggatgacagaagagaaagacgaactgacggaaatgctgcggcaactgtaccggatgatcaatcaattgggacaactggacaaatcgatcgtactgctttacctggaagaaaaaagctacgaggaaatagccgaaatcaccggactgactgtgaccaatgtagccactaagctgagccggatcaaggacaaacttaaaaagatgaaaaaggaggaataa

SEQ ID NO: 978 - DNA, 3252 bp, B.fragilis
ctatgcgggaggacaattggtgcgatagtgctaactaacattgaaacgatggataatccttctaaaataaaaacgcagacgaaagcctcttcttttacgctgattgtcgcctttatatgcgtggcgttgatcggtctggccttaatccccctgcttcccgtaaagctgaacccttcgagaaccctgcccggttttacggtgcagttcagtatgcccggtacttcgtcgagggtggtggaaatagaggctaccagtaaactggaggctatgttggcacgtatcaagggcataaagaatatctattctacctccgataatggttcgggaagcatcaccattgaattggataagtatgcggatatagatgcggtacgttttgaggcttctactattatccggcagacctggccgcagcttcccgatggagtgagctatccttatatcaggatgaagcgcccggacgagaatgcttcccgcccttttatgtcgtttacactcaacgctccttctactcctatcttgattcagcaatatgccgatgagcatatcaaaacaagactggcacagattcagggcatctataagatagacctgagcggagctactcccatggagtgggtcttggagtatgatagcgaacaactgagacgattgggaattactttgagtgatatccagcaggctgtcagccgctattatctgaaagagttcctcggtacctataatgtcgaatcatctacagggggtaaagagtggatccggttggcgctgatgcctgaaacaaaagatgagggttttgatgcatcccgtatccgggtgaagagtgccgaaggtaaattgatcagtctggacgagcttgtaactgtgtcccacatggaagaggccccccaaagctattatcgcatcaacggacttaactccatttatctgtcgataacagcagaagaaactgccaatcaattgcaattgagcaaacaagtgaaagaagagatggaggccatacaaaaggtgttgcctgccggatatgaaattcacaccagttatgatgcgacggaatttattcacgaagaattgaacaagatttatctgcgtaccggccttacggttctgatcttgctgttctttgtgctgattatcactctgaatccgcgttacctattcttgattgtagtcagcctgagcatcaatattgcggtagcagtcattttctattatctttttgggttggagatgcagctctattcgctggccggtattacggtttcgctcaatctggtgatagacaatacgattgtgatgaccgaccatatcctgcaccggcgtaacctgaaagcctttatgtctatcctggccgctactctgactacaatgggagctttggtgatcatcttcttccttgacgagaagatacggttgaacttgcaggactttgcagccgtggtgattatcaacctcgccgtatccttgtttgtcgctctgttcttcgtacctgccctgatcgaaaagatcgggttgaaaaagaggaaacgccgtcggacccaatcccgcttcttccttctccgggcctctcttccgcgaagaataacggtttactttacccgcttctatggctggatgatacgtaaattgtgtcgttggcgtgtggctgtctgcatcttgttgatactattgttcggacttccggtgtttatgcttccggataaagtggagggtgaaggacgtgccacggagtggtacaacaaaaccttgggatcgtccacttacaaagagaagatcaagccgatagtcgacaaagcattgggaggtagtttgcgcctgtttatccagaaggtatacaacggcagctattttacccggaacgaagaagtcgtgttgtatgtatatgccaatcttccgaacggcagtacgttggagcagatgaacgaactgatcaagaagatggaaatctatctgagccagtttaaagaaattaagcagttccagacctcggtatacaatgcccgtcggggtaatatcaatatctattttaccaaagagcatcagaatagcggtttcccttatacactgaaagccaacattatcagtaaggccctgcaactgggtggaggtagctggggtgtatacggcttgcaggatcaggggttcagtaatgatgttcgtgagggagccggttcgtttcaggtgaagatgtacggatacaattatgatgaactgtacgagtgggctgaaaagttgaaagccaagttactgacgcaccgacggatcaaggaagtcatcatcaattcgtatttctcttattggaaagacgattatcaggagttctattttaatctgaaccgtgaacgtatggcgcaggagaatatcaatgccaatattctgttctccaccatccggccgatatatggtaagaatatggagatcggctcggtagtggcggaaaatggttcggaaaagataaagctttcttccaagcagtctcaggaatatgatatctgggccatgcaatattttccgtatggaacagacgataaacagtataagctgtctgaactggccactatggaaaaagggcagatgccccaacaggttgccaaggagaaccagcagtacaggctatgcctgcaatacgaatatatcggttcgggcgagcagggaaacaaaatcctgaagcgggatctggaagaattcaataaagagttgccgatggggtatacggctcagtcggagagagagagctggggttggggaaaaaaggataataagcaatacttgcttttgctggtagtgattgccattatcttctttactaccagtattctgttcaactctttgaagcagcctttggccatcatatttatcattcccgtgtcgtatatcggggtattcctgacgttctattggtttaagctgaactttgaccaaggtggctttgcttcgttcgttttgctatgtggtattacggtgaacgccagtatctatatcctcaacgaatacaatgccatccggaggcgtcatccacgaatgtcggctttgagagcttataccaaagcctggaatgcaaaaatccttcctatcttcctgacggtggtttccaccatcctgggttttattccctttatggtcggtacggataaggaggcattctggttcccattagcggcaggaactatcggaggattggtgatgtctatcatcggaatctttttcttccttccggtattcgtgttgaagaagagggttggtaagcgttga

SEQ ID NO: 979 - DNA, 1653 bp, B.fragilis
tggtctattattttcaccggtaacatgttggttactgttctgtatatgttggtatatcgtaccgggatcaaaggtggtcgaaagtggttgaggttgaaaattaataatcctttgaaagaacatactctggaccgtttctacgataagggtatcgattgggtattcagtcataagacgttgagtgtattgttctgtgccatttcttttccgttatgtatcttctttttctactttatcgataaagaaagaatgccggatatcgacgaaaatgaattgattacccgtattgaatggaacgaaaacattcatgtggacgagaatcaacgccgggtcgacgaattgttccgtgagttgcagggagcatctgtggagcagacagcgtccatcggattgcaggattacattttgaaccgggaacaagagttgtcgtcatcggaggcggaactttattttaagaccgaaacctcgaaagagattgctccgttgcaggaacaaatttatcagaagctgaaagaacgttatcctttggctgtgatttcattctctcctcctgaaacagtttttgagaaactgtttgtgaccggtgaggctgatattgtggccgaattatatgcccgcaataaggacagggcacccggccccggtactttgcgtggattggagcaaacattcgggcagaagacaggaatacctcctacaggtattgctttcgaaaaccaattgaacctcagtattaatcaggaaaagctattgttgtatcaaatctcttataacgagttgtatcgtgtgctgagaactgctttcaaggaaaacagtgtagctatgttacactcttatcagcaatatctgcctatcagcattgcaggagacgaaaagacggttaaccaggttttacaggaaaccttgattcagacacaaccggacagcaagacgggagaggtgaactttattcccttacgggagctgataaaagtaactcccgcagaagatttgaagagtattacagccggaagaaatggggagtatattccttataaattctatggagtggagaatgcggagaagttgatgacccaggttaaagaaacatctagcgagacaggagattgggacatcgccttttcgggaagcttcttttccaatcagaagatgctggacgaactggtggtcattctgttcatctcccttttgctgatgtatttcattttggcggctcagttcgagagtttcatgcagcctttgctggtgttgatggaaataccgattgacgtggcgtttgcattggtattgctttgggtgtgcggacatacattgaacctgatgtcggccatcggattgattgtgacttgcggtatcgtgatcaatgactccatcctgaagctggatgccatcaacgaattgcgtaaggagggagtaccattactggaggccattcatgaagccggacgaagaagattacgaccgattatcatgacatcgttgaccactatttttgcaatggtaccgttgctgttttcgttcgaccttggttccgaacttcagaaaccgctgtccatagccatgataggtactatgacaatcggtaccctggtgagtttgttcatcatccctttgttgtattggtttatttatagaaataaagaaaaacgatag

SEQ ID NO: 980 - DNA, 459 bp, B.fragilis
agtacccccattgcaaacacccataacgatatgatgcagaaccccgattattttgaacgtacccgcagccggttacatcccaagaaataccgattttatttctttgattacctttactattgcggtgaccggtggtcgaaaagaaattctcgtgtatggggaagcggagtgatatttaattattggacattttgtatatgggggcctgttgccttttggacaagattaaatgggattcatctttttagcgagagcatagatgtgacaattgtttttgccggcatgttactccctttcgtttgtacccgtctacgataccggaaagaccgggtatcggctatcaggcaccattaccgccggagtgcctggagaagcatcattcctccccggctggtggtgttcggatggtttatcatcctattgcttgaagtgataggagcaaagttatgcgaggcataa

SEQ ID NO: 981 - DNA, 1461 bp, B.fragilis
cacagaacaattatgattaaattcctgatacaacgtcccattgccgtattgatggcttttacggcttgcttcatagtggggttggtgacgtacttcacattaccggtatcgctgttgccggatatctccatcccggagattaccgtacaggtatcagctaaaaatacctcggcacgtgaattggaaaacacagtcgtgaagcctgtccgtcagcaattgattcaggtggctgccctaaaagacatgaccagtgaaacgcgtgacggtgcgggtattatccggcttagttttgattttggtaccaatacggacctggcattcatagaggttaacgaaaagattgacgcagctatgaactatttgcctaaagataccgatcgtccgaaggtgatcaaggcaagtgctaccgatattccggtattctatctgaatctgactttaaagacagacagtgcttatgaagagacggatcagcaggctttcctgaatttatgtgagttttcagaatcggtaatcaaacgccgtatcgaacagttgccggaagtggcaatggtagacgttaccggtttgctggaaagacaattgcagattgtacctgatatggataaactggctatgcttgaattatccattgaagatattgagacggctctggcgcaaaacaatgtagagccgggaagcatgaccgtacgggatggatactatgaatataacatcaagttctcaactctgctccgtactgcggaagatgtggagaatatatatatccgtaagggagatcgcatcatacagttgaaagaattttgccggatagcgatagtaccggtcaaagaaaaaggagtatctgtgtcgaacggtaaaagggccgtgacgcttgccatcattaagcaggccgacgaaaacatggacaatatgaaagatgctctgtcggaaacaatggattatttcaaaaagatctatccggatatcgagtttagcgtgagtcgtaatcaaaccgaactgctggactatacaatatccaatcttcagcagaatctctcactcggttttgttttcatttgtatcgttgccgtactcttcttgggagatgtcaaatctccattcattattgggctgagtatggtggagtctattgtcatcagtttcttgtttttatacctgtgtaaaatgtctctcaatatcatctacctgtccggactgatcctggcactgtgtatgatgatcgacagttcgattatcgtaacggataatatatcgcaatacagggaaaagggttattcgttgcggagagcctgcgtggcgggaacaagtgaggtggtgactcctatgctgagttcttcgtttacgacaatcgacgtatttgtacctttggtatttatgagtggtatcgcgggtgctatcttttacgatcaggcttttgccgttagggtaggattgatggtctattattttcaccggtaa

SEQ ID NO: 982 - DNA, 1293 bp, B.fragilis
agaaaaacgatagatatgaagaaaagatattatatagtaatagcagccttgctgtttggggcttctgtagcgaaggctcaggatcatataaaactcgatttgcagaagacgatacaattggccaatgacagttcactggaggcattccgtacgcagaatatgtatctttccggttactgggagtatcggacttacaaggccaatcgcctgccgagccttactttgaatatgactcctgccgagtataaccgggatatcaccaagcgatacgattcggaaaaggacttggatgtttatcgtagccaacagtcgttctatgcatcgggtaatctggctatccagcagaacttcgatttgaccggcggtactttctacctgcaatcgcaattgggatatatgcgtagttttggtgggaacaagacaacgcagtttaccagtgtacctatccggttgggatattcacagagcctggtcggatataattcgttcaagtgggagagaaagattgaacccttgaaatatgaaaaagtaaagaaagagtttgtgtataatgtggaagccgtatccgtgcaggccactacgtatttctttaacctggctatggcgcaggccgagtataacctggccaaggagaatatggtttcttcggatacgctttatagcattggagtgcaacgccagaagatagcagccatctcgaaagccgacttattgacactgaagttggatgtggtgaatgcacgcaatacgttgcagaacaaggctagtgccctgaaacgcgccatgttttcactggtttcattcctgaacctggataagaatacggttattgatatcgacttgcctgtccggcctcaggaattggtgataccggtggacaaggcattgcagatggcacatgaaaacaatcctcagttactggggttaaagcagaacgtactggaagccgaacgcaatgtggacaagacgaaaaaagagtcgcgtttcaatgcgagcgtgaatgccagtatcggtttcaaccaggtggctgataattttggagatgtgtaccacaaacccatgcagcaggacttggtatcggtcagtgtcagtattccgttggttgactggggggtaaggaaaggtaaatataacatggcgcgcaataacctgaatgtggtgaaaacttctgcccgccaggatgaaatcagcctggacgaagaagtgatcatgacgtgtgaacgatttcaatattcaacagaatatgatcaccagtgccgaagaagcactagacctctctatcctggcttataa

SEQ ID NO: 983 - DNA, 486 bp, B.fragilis
caaatggaagtacccttagtggataaagattacttgcttgagagaactcccggcaatggaggatggacttatgcacccattcccgaagtgccgcaagataaaaaggcacctttcggctgggtgaaagtaaaaggaagtattgatggtgtcgaaatcaaaaagcaccatttgatgccaatggggaatggagaattaggactttctgtaaaagctgaaatccgtaagaagatcaaaaagcaggcgggtgattatgtacatgttgttttgtaccttgatgaagagccgtcggagattcccgaagaactgcaattgtgtttgcaagacgaacctcgagcattggaatttttcaattcactggctgaaaacgagcggcacaattatgtgaaatggatctattctgcaaagaccgatcgggcaaaagtagccaggatggccaaagcgattgacaggcttgcaagcaacctgaagtattacgataaaggctga

SEQ ID NO: 984 - DNA, 1170 bp, B.fragilis
attaattcctctttatttatgaaagttttagtaaccggtgcgaaaggttttgtcgggcggaatcttgtatcccaattgcgcaatattcaaagtggcaaagcaaaaaattacgctttgtccggaaacgagttgatcatttttgaatatgatgtagatagtgacccttctgaattggatgactattgccgacaggctgattttatttttaatctggccggtgtaaaccgtccactggatcagtctgaatttatgaaagggaactttggttttgcttctacgcttcttgcttcattgaagagacatggaaatacttgccctatcatgatatcctcttctacacaagccgctttggataatccttatggagcctctaaacgggcgggtgaacaattgttgtttgagtattcccgggaaacgggatcgaaagtgttggtataccgttttcccaatgtctttggtaaatggtgtcgccctaattataatagtgcaatagctactttttgctataacatagcacatgatcttctcattcaggtcaatgatccgaatgtggagatgaatcttgtatatatagatgatgttgtggatgaattaatctctgctttgatgggcaatgaacatcgggaaggagcttattgtaaagtatctgctgtatacactgttactttgggagcaattgtggaattgctatattctttccgtgagaaccgtaacaatttgggagttccccatgtgggagatgcttttactaagaaactttactccacctatctctcttatctgccgaaagatggatttggctatcctttgaagatgaatgtggatgcccgcggcagtttcacggagattatccgcagtacggaccggggacagttctcggttaatatttccaagccacatattacaaaaggtaaccattggcatcataccaaaaatgaaaagtttgtggttgtaagtggccaaggtgtcatccgttttcgtaacatgtatgattcatcctctgagattctagaatattttgtttcaggtgataagcttgaaataattgatattcctaccggttatacccataatattgagaacctgggtgatacggatatggtaacttttatgtggtgtaacgagtgttttgatcccggtaggccggatacttattttgaagaagtttaa

SEQ ID NO: 985 - DNA, 201 bp, B.fragilis
agacaaatatcaaaaatatataaacaatcacaattacacagctatcatttgaagaaaacaatatcacccggtgctagacaccaagcacacactctgaaacataaaattattcgcaaagccagttctttaaagtaccacctatatttatccaataataattattacatcatttttcttatacagtctagttggaagaactga

SEQ ID NO: 986 - DNA, 1899 bp, B.fragilis
tctaatggatttaaagacaaatcctgttttcctaaaaacgaatatacaatgatggactctcatgacactaaccaacctttgaaacaaggggaattagaagaagaaaaaaaagcagttgaggtttctgaagaaattacagaaactccggctgaagaaactattgtggaaaaaccgacagaaaatgcttcgaaactaagcactaaagaagaggtgctgctccggttaaaagaagttgcccaagatgctgaaaatgcaaacaagcaagaactggatggtttaaagcaaactttctataaaattcataatgccgaaatcgaggctgcgaaaaaaacgttcgtagagaatggtggtgccgaagaagaatttattgctcagcccagtggcgtggaagaagaatttaaaagtttgatggcagctattaaagaaaaaagaagtgccttggcagctgagattgaaaagcaaaaggaagaaaatctacaagttaaactatcgattatcgaagagttgaaagagttagtggaatcacccgatgacgccaacaaatcctacaacgaatttaaaaagctacagcagcagtggaacgaagtgaaattggtgccacaagctaaagtgaacgagttatggaagaactaccagttgcatgttgaaaagttctatgatatattaaaactgaataatgaattcagagaatacgacttcagaaaaaacctggagattaaaacacatctctgtgaagctgccgaaaagttggccgatgaacaagatgtagtctccgctttccatcaattacagaaactacatcaggagttccgtgacaccggtcctgtcgccaaagaattacgtgacgaaatatggaatcgctttaaagccgcttctacagccgtcaaccgtcgccatcagcagcatttcgaagctctaaaagagaccgaacaacataatttggatcagaaaacagttatctgtgaaatagtagaagctattgagtttgaccaattgaaaacatttgcggcatgggaaaccaagacacaagaggtgatcgccctgcaaaacaaatggaaaacaattggttttgctccgcagaaaatgaacgtgaaaatctttgagcgtttccgtaaagcttgtgacgaattctttaaaaagaaaggagaattcttcaagttgctgaaagaaggtatgaatgctaatctggaaaagaaaaaggcattgtgcgaaaaagcagaatctctgaaagatagtacagaatggaaagaaacggctgaaatcttaaccaagctccaaaaggaatggaaaacaattggccctgtttctaaaaaatactcggacgctgtttggaaacgtttcattactgcatgtgattatttctttgagcaaaaaggcaaggccacttcttctcaacgttctgtagaacaagagaatctagaaaagaagaaggcaatcattgcccgcttaactgctattgacgaaacgacggatgccgatgaagcaagcaaagaggttcgtgaattgatgaaagaatggaatggtatcggacatgtaccgtttaaagagaaagacaggctttataaacaatatcacggtttgattgaccaacttttcgatcgatttaatatcagtgcatcgaacaaaaaactgagtaatttcaagtcttctatcggcaatattcaaagtggaggctcccagtcactctaccgtgaacgtgagaaattagtccgtacatacgaaaacatgaaaaatgaactccaaacttatgaaaataatttgggcttcctgactacctcttctaagaaaggaaatagtcttttgacagaaatcaaccgcaaggtggaaaaattaaaatccgacttagaattagtattgcagaaaataaaagtaatcgatgaatcaatcaaagaagaataa

SEQ ID NO: 987 - DNA, 342 bp, B.fragilis
ggagggacatctatgagacaaggagtcgtatacttgaataaagaacgggtaggcattattacggaattatcttctaacgaatataaatttcgctatgatgacgaatatttcaatgatccatcaaagccctccataagcctgacattgacaaaacaacaacaggaatatacttcccattatctatttcctttttttgccaacatgctgtcagaagggcacaaccgcatcgttcaggcaagattattgcagattgatgaaaaagatgattttggtattttattagctacagcacataccgacacggctggggctgtaaccataaaacctctcgactatgattga

SEQ ID NO: 988 - DNA, 1032 bp, B.fragilis
agtattatgtcactttttaaagataaatctctcttgattaccggtggaacaggctctttcggcaatgcggttttacgtcgttttcttgattctgatatcagggagattcgtatattctctcgtgatgaaaagaaacaagatgatatgcgtcactatcttcagaacccaaaagtaaaattctacattggcgatgtccgtgacaagcgctctgtggatggagttatgaatggagtggattatatcttccatgccgctgcgctgaagcaagtcccttcctgtgagttttttcccacacaagcggttaggacaaatgttctcggtacagaaaatgtgttggattccgccatagctcacggtgttaaaaatgtggtggtactttctaccgataaagctgcctatcctataaatgcaatgggtatcagcaaagccatgatggagaaagttgctatcgccaaaggtcgtcagttgggtaattgtggaggaacaacgatttgctgtacccgttatgggaatgttatggccagtcgtggttctgtgatacctttgtgggtagagcaaattaagaaatgtaatccaataacaataacagatcccaacatgacccgcttcatgatgactttggatgatgctgtcgacttggtgatttatgcctttcagcatggaaaaaatggtgatttgtttgttcagaaggcgcccgctgctactctggatgtattagccgatgcattaaagtctctttaccatagtaacgcggatgtcaaagtgattggtacccgtcacggtgagaaactctatgaaactcttgttacccgtgaagagatgtctaaagcagaggatatgggtgattattatcgtatcccatgtgatacgcgtgatttaaattatgataagttttttgtggaaggaagtgaggaggtctccaaaatagaagattaccattctcataatacccgtcgtcttgatgttgaggggatgaaagaacttctcttgaaacttgattttattcgcgaagatcttggccttgaaaaatag

SEQ ID NO: 989 - DNA, 1245 bp, B.fragilis
acaaaatcgtctggagaaaatcctgataatatcgaaatgaatattttgtttctgacccttaaccgtgtttcagatctttctgaacgggggatatacacggatttgatgcgggaatttatttgtcatgggcatagggtctatatggttgttcccgccgaacgtcgctttcatgaatctacttcaataaaagagagttgtggcgctcaaatgttgagggtgaagacattgaatatccaaaagagcaatgtggtggagaaaggcatcggtacattgttattggaaatgcagtatcaatgtgccataaagagatattggaaggatatccggtttgatttgatactttattcaactcctcccattactttcaatagggtcatcagttcacaaaagagacgttgtaaggcgaaaagttatcttttattgaaagatatttttcctcaaaatgccgttgatttgggaatgttttcaaagagaagcttaatttatagacttttccgtaaaaaagagaaggatttatatcagatatcggactttataggctgtatgtctcctgccaatgtggattatgtgttgacacataatccggaaataaaggctgatagagtagagatatgccccaatagtattaaattgttagagaagtcattaatggcttcaactgtaagaaaaaacatattgcagaaattgcatattccaattaataagactctttttatatatggtggcaatttggggcgtccacaaggtttgattttcttgttggacgtgatagccgcaaatgaggaacgtaatgacagttatttcatcattgtaggcagtggcactgaatatggcaagataaagtcttggtttgaggcgaatcatccggataattcaatgctgctttcttcacttccaaagaaagagtatgatgatttggtaaaggcttgtgatgtcggtttgattttccttgatagacgttttaccatccctaattacccttcccgtttactctcttatttagaaaaccggatgcccgttttattggctacagacctgaatacggatatcggacggattgctgaacggaatggttatggcttttggacagaaaatgggaatttggatacatttatggaaatggtggattccttatctgcagacagagaaaaaataaaagtgatgggcgagaaagggtatgaatacttgaagtctaattatacagtagaaagagggtaccggatgataatgaaacattttgagtag

SEQ ID NO: 990 - DNA, 183 bp, B.fragilis
ctgcatctgttagaactccaacagttacagaacctagtttggaagcctctcttattatatttaaatgacctggatgaatcatatccgcactcattccaacataaacttttttacatttttccatcttacatagaatttattagaaaaaacaaacaggaagtgttagttataacaatttattaa

SEQ ID NO: 991 - DNA, 489 bp, B.fragilis
agaatttcccccctcagctccccccaaaggggaggaagaagagcggaagggggattctgcttatctcccgataccgggatacgccttcaatacaatgacgcacaattactcgggactgatggacacgctaaagagattgagcattaccgacaccggggaagtaaactccatactcaggctgtcggactatgggaggaagggaacgacggtatggaaactgattgccaacacttgctggagcgacatcggagccaaaggaagatacctgatagcggcgctaaacaagacgaaaagaaggtagcagagagtgtcagtcccctatttgtagttgacaaaaaagcaaatatacaggcttttgaccagaaagggattcagcgaaacaaagaagtaaaaagtgtgcttaacgaactaaaacacagtgtttttaaagcacaagatttctctcgcccaaagctttgttttaacgctacgttaaagcttgttctttaa

SEQ ID NO: 992 - DNA, 186 bp, B.fragilis
gaatgcctaccgaaagataggaatcttttctcatttggtaatggagtaaatattgtttctttaattgattcggtaaaaatgatttttcgactaaatcttgtacttgttctgccttttggcaaaagcttattagctctttatgaactcttttggggggaatgccgatgcggataccaaattctatga

SEQ ID NO: 993 - DNA, 297 bp, B.fragilis
  unsure (56): Identity of nucleotide sequences at the above locations are unknown.
aaagcagctacggcaaccgcatcattgccactgaatgggatacacacaagaagctntcgttcctggtatacatttatattaaaaggaatagataatgtagggctgctgaatgaaatcacacaagttatttcacgccagcttaatgtgaatatccggaaactggatatggaaacggacgatggcattttcgaaggaaaggtcgggttgtatgtgcacgatgtggaagatgtaaaagctatttgcaacaacctgcgcaagattccgaatataaagtcggtgacacgtgtagaaaactaa

SEQ ID NO: 994 - DNA, 1164 bp, B.fragilis
aattctaacaccatgctgaaatcaaaatataaaatctatctgttactactctgcctgacaggttgtgtttcagaatacaacgcacaactaccttcttccgatgaagaattgctggtagtaaccggcgacattatcgctaatacagaagccatattctcattaagcaaaagtattccactatccgaagacatgccggaagattatcgaaacatttatgccagaattgctgtagtaggcagcgacggctatcgaagtgatttcggaacggctcttggtgatggtaaataccaggtcagtatcggtgaattgcaggatgatgtatcctacggaatagagatagaatacgacggagagatttatacctcgtctccttccacaccgatggtatcttctgaaatagacagtgtttcgtggatacaaccagaacctgaacaagcactttctatacgggtatcgacccatggtgatcccggaaaaactcaatactacatgtggaactatcgggaagactgggagataagagccagctacattacaacttgctactttgatccggatatgaaccgcatctatgaagacagcaattatccaactttctattgttggaaaaaggaaatatcaagaaatatattgattggctctacggaaaagttgaaagaacatctgatcataaataataagctactcgatgtgccggtcaatgaagacagattcactgtactatacagcatacaggtacagcaacgggcattgagtaaagagggatatgaatattacttgaatgtacagcaacagaatgaagaaatgggaggaatctttactccacaaccctctgaaatccaaggaaacattagttgtatcagtcagcctggacgaaggacgatcggttatgtaggcgtctataaaaacatctctgaaaagagaatatacattcatcccaacgaaattaaacgtcctcctctatacagtggctgtgaagaagtgtcggatagcgaaatggatgaacagggctatagcacatatctgataagataccttgtcggttatcgtccagtcggtacaggcactcacattgaccactgggccctacggagatgtacagaatgtgaagccaacggaggaagtaaaaacaagccttcattctggcccaacgatcatcaataa

SEQ ID NO: 995 - DNA, 366 bp, B.fragilis
ttgagaaacactctacaaacaaaaagaaatctctgtcattctaaaatcaaaagtacaaatagccgtaatcaaattcacaatatattgggaatttccttgcttatcaaacaaatacttagtatttttgtttcaaattcacaatatattgggaatatgaaacaaattggaatacagattcgccaacgaagaaaaatgttgggtataaatcagcaaacacttgccgatttagcacaaatcagtatcaatactataacaaaaattgaaaatggagaaataaatattaattttcaaaagctctatgccatattggaggtattaggattagaactttctctgaaaattaaaaataaggagggacatctatga

SEQ ID NO: 996 - DNA, 2046 bp, B.fragilis
  unsure (1088),(1885),(2007): Identity of nucleotide sequences at the above locations are unknown.
attatggacactgagaaccagaaagaaatagctgaagagcagatgattgaacaagcgtttcaggaattgctgaacgattatcttgctaccaagcaccgcaaacgtattgagattataaccaaggccttcaatttcgccaatcaggcacataaaggcatcaaacgacgctcgggggaaccgtatatcatgcaccccattgccgtcgcgaagatcgtatgcaatgaaataggccttggctcgacttccatttgtgccgctttgctgcacgatgttgtcgaggacaccgattatacagtagaagatatcgaaaatatcttcggggccaagattgcacagattgtcgacggactgaccaaaatctccggaggtatttttggtgaccgggcttcggcacaagcagaaaacttcaagaaactcctgctcaccatgtctgatgatatccgggtgatcctgatcaagattgccgaccgcctgcacaacatgcgtacactcggttccatgttgcccaacaagcaatataagattgcaggcgaaaccctttatatttacgcccctcttgccaatcgcctgggactgtataagatcaagacggaactggaaaacctcagtttcaaatatgaacatcctgaagaatatcaggagattgaagaaaagctgaacgcaacagccgccgaacgcgataaggtattcaacgaattcaccgctcccatacgcgagcagttggataaaatgggattaaaatatcgaatcctggcacgtgtgaagtccatctactctatctggaacaagatgcagaccaagcatgttcctttcgaagagatttatgatcttctggctgtacggatcattttcgaaccacgcaacatagatgaggaactgaacgactgtttcgatatttatgtttccatctccaaaatctataaaccgcatcccgaccgtctgcgcgactgggtgagccaccccaaagctaacggataccaggcactgcatgtcactttgatgggcaataatggccagtggatcgaagtccagatacgcagtgagcggatgaacgatgtagccgaacagggatttgccgcccactgganatataaagaaagaggaggcagcgaagacgaaagcgaactggagaaatggttgcgtaccattaaagagatactcgacgatccgcagccggatgccatcgactttctcgatacaatcaaattaaacttattcgcctcggagatctttgtcttcaccccgaaaggagagctcaaaaccatgccgcagaactccactgccctggatttcgccttctcactgcacacggatataggaagccactgtataggtgccaaagtgaatcataaactggtgcctctaagccataagctgcaaagtggtgaccaagtggaaatcctgacatccaagtcacagcgtgtacagccgcaatgggaagtgtttgccactactgcgcgtgcaagggctaagattgcggctattctgcgtaaggaacgaaaaaccttccagaaagaaggagaagaattgttgaatgaattctttaagaaagaagagatccgcccggaggcagccgtcatcgagaagttgtgcaaactgcataacatgaagaacgaagaagagtttcttgtagccatcggtaacaaaaccatcgttctgggagatgccgacaaaaatgaactgaaagagaaacaaagcagcaactggatgaagtatctgactttctcttttggcaataataaggataaacagcaggaggaaaaagaaccgcaggaaaaggaaaaaatcaacaccaaacaaattctcaaactgacggaagatgccctgcaaaagaaatatatcatggccgaatgttgtcatcccatccccggtgacgacgtactgngatacatggacgagaatgaccgcatcatcatccacaagcgtcaatgtccggtagcggccaaactgaaaagcagctacggcaaccgcatcattgccactgaatgggatacacacaagaagctntcgttcctggtatacatttatattaaaaggaatagataa

SEQ ID NO: 997 - DNA, 888 bp, B.fragilis
tctaaaaaaacaaatatggcaatagcatacgacgggatcaattattttccggtgggcgtaaacttcatggaagagaacgcaatggaagtgatagaagcaaaatatggaataaaagggtcggcaattgtgctgaaactgatgtgtaagatttacaaggagggatactacatacgatgggatgaagaacaatgcctgattttcgcaaacaaagcaggaagagaggtgcaggcagaagaggtgcaggggatcatcgagattctgttcaccaaaggaatactggacagaaacagttatcaggaaaacggaatactgacttcggaaagtatacagaaagtatggatggaagcgacaaagcgaaggaaaagagagttgtcggagctcccttacctgatggtgaaaccggaaaaagaaaatggaaaagccgacactcccccggcactacaagaaattcagcaaccagagctgttcaaaaaggaaaaaacacctgttaacccgaaaaatgtagtacatcatgtagccgttgacgcaaaaaatgcatgcaattccggacaaagtaaagtaaaagaaaagaaagcagaggaaaataaagaatttcccccctcagctccccccaaaggggaggaagaagagcggaagggggattctgcttatctcccgataccgggatacgccttcaatacaatgacgcacaattactcgggactgatggacacgctaaagagattgagcattaccgacaccggggaagtaaactccatactcaggctgtcggactatgggaggaagggaacgacggtatggaaactgattgccaacacttgctggagcgacatcggagccaaaggaagatacctgatagcggcgctaaacaagacgaaaagaaggtag

SEQ ID NO: 998 - DNA, 366 bp, B.fragilis
actacgaaaacaaacaacaagaagaaaaaaaaagaattcaaaaaaaacaaaacgggcaacaagcaaatctctgacaatagagaccttaagtcaaacagaggacgaaaaaaggagaaacccatacaagggattgttttgaaacactacgaatgcttaaagctactaatcacactctatcaagatggggcaatgggtataaaaaaggagacatcacaagttgcattagcacgatatatagacgacaaaaaactattagggaatattcgaaatggaatattcattccattgaagttcagcactattctaaaggaaacaaacaccatctggaacgaaatgctacgagataaatccattggcataaaatag

SEQ ID NO: 999 - DNA, 360 bp, B.fragilis
atgaacgaaacgaaagtattaatagaaaagataaccgaaggtatacaagaaaaaaaaggtaaaaacattgtcatagcagacctgacaaacatagacgacacgatatgcaaatactttgtaatctgtcaggggaactctcccagccaggtcattgccattgtagattccataaaagaatttacccgcaaaggtgccggcaccaaaccctctgccatcgacggacagcgaaatgcagaatgggtagctatggacttttcagatgtattagtacatgtattcctaccggaagccagaaacttttataatttggagcacctgtgggcagatgccaagttaactacaattcccgacattgattaa

SEQ ID NO: 1000 - DNA, 225 bp, B.fragilis
aacctctcgactatgattgaattaacttgctgtccttctactttacaaaagggattctcaacctattcgcctgttgcattgaaagagctgttcaatagccaaaaggtaaaccatatactgccatacaatggcatggacaataatgaaacggaacaaaaagaatttcaggataacaacaaacacatgtctatatccggagctcaacaaaataagtccagccaatga

SEQ ID NO: 1001 - DNA, 1104 bp, B.fragilis
ttaatatctgccatggaacatcctgagaataacgaagcgtataaaggtttggttgtgaatgcaggcattgaacaaccgtcatctgtaaatccttatctgaaacggaaggtaaagaagcgtcaattgtcggttagtgagtttgtggagggaattgtcaagggagatgtgacgatcttgagtcaggctgtgactttggtagaaagtgtgcgtcctgaacatcaagctactgcccaggaagttattgaaaaatgtctgccttattccggaaattcaatccgtgtaggtatcagtggtgtaccgggagccggtaaaagcacctcgattgatgtctttggattgcacgttctcgaaaagggaggtaagttagctgttttagccatcgacccgagcagtgaacgcagcaaaggaagtattttgggtgataaaacccgtatggagcagctttcagtgcatcctaaatcatttatacgtcctagcccttccgccggttctttggggggagtagcccgtaaaacccgtgaaacaatcattctgtgtgaagcggccggcttcgataagatatttgtagagacggtgggagtgggacagagtgaaacggctgttcactcgatggtcgatttctttctgttgattcagttggccggtacgggagacgaacttcaaggtattaaacgcggtatcatggaaatggcagatggtattgtgattaataaggctgatggtagcaatatcgataaagccaaattggccgctgctcagttccgtaatgctttgcatctttttcccgctcccgattccggatggacaccgcgtgtactcacatattccggattctacaatcttggggtaaaggaaatatgggatatggtgtatgagtatatcgattttgtgaaaggtaatggctattttgaatatcgccgtaacgaacaaagtaaatactggatgtatgaaagcatcaatgaacagttacgtgacagtttctatcataatgccaagatcgaatcgatgttacaagaaaaggagcaacaagtgctcaggggaaatctgacctcttttgttgctgccaagagcctactcgatacctattttgaagatctgaaataa

SEQ ID NO: 1002 - DNA, 1206 bp, B.fragilis
ttattgtatgccaatcaaagaaattttagaattaatacctggtacaaaagcattaaaaagatgatttcaccaaaattttttattgatagcctttcagataggcaaattgattttttttcaggtgttccggattctttattaaaaaacatatgtgcttatattgcggataacaaggatgcaaagcataatattataacagcaaatgagggggcggcagtcggtttggctgtaggtcattatttggctacaagggaaattccagttgtgtatatgcaaaactcaggagagggaaatattatcaatcctcttgcgtcattgactgataaagaagtctataatatacctattcttttactgattggatggcgtggtgagccaggagttcatgacgaaccgcagcatgttaagcagggaaaagtgactattcctttactggatgtaatggggattaagaatacagtgatgagtaagagtgaagttgatttcactaagcaattagatgatgcgttggtctatatgcgtgaaactaacgaagcatttgctttaataatagaaaaagatacattcgaatcatattcgcttaaattaaaggaggattctgtattacaacaattatcaatgagtcgagaaaacgctattcaaatggttgtagattcaattggaaaaaaggatgtaatagtttcaacaacaggtatgatttcgcgagagctttttgaatacagaacaaaaatgaatgaaagccatcagagtgattttcttacagttggttctatgggacatgcttcacaaatagcattagggattgcactggaaatacccgatcgtaaaatttattgttttgatggtgacggtgctgtgattatgcatatgggatcaatggcaattattggagataagggccctgaaaatttgatccatgttgtgtttaacaatggatctcacgattctgtaggtggtcagccaactgtaggacttaagattaatatccctgcaatagcaagagctgtcggttataaagttgtatatagtgttgattgtgaagaagctttaaagactgctttagaaaaggtcataaaagaagcaggacctattcttctagaggttaaggttaaaaaagggaatcgaaaagatttgggaaggccatctattactccaatacaaaataaattatcttttatgacttttttgaataatgaaaaaaaatag

SEQ ID NO: 1003 - DNA, 1260 bp, B.fragilis
aagagtttttatatggaacagataaccgaaaaaataaatgacttattcgtttcctggggatttgactccagtgaagtaggtcccattatgacactggtactgattattggcattgcctttttagccgatcttatttgtcgtaacattcttttaagagtagttgccaaactagtgaaaaagaccaaagcaacctgggatgatattgtgttcgaccgtaaagttttgatttacctcagtcaccttgtcccccccatcattatttatgtgttgattcctttggcaattccgaatgtaagtgccctcgattttatccgtcgtatctgcatgatttatatcattgcggtttttctgcgttttatcagtgcatttctgtcggctgtttatcatgtatacagtgagcgagaacagtttcgtgatcgaccattgaaaggtttgttgcaaacggcacaagtgatactatttttcattggaggaattgttgttatcagtgtattgatagataaatctccgatggtattgctcaccgggcttggtgcttcggctgccatcctgatgttggtgtttaaagacagtatcatgggatttgtgtccggcattcaactttctgcaaataatatgctgaaagtaggtgactggattgctatgcccaaatacggagccgacggtacggtgattgaagtgacgctcaatacggtgaaggtgcgcaattgggacaataccatcactaccatccctccctatctgctggtcagcgattcttttcagaattggcggggtatgcaagagtccggtggacggcgtgtgaagcgttctatcaatatcgatatgaacagtgtaagattctgtacccccgaaatgttggctaaatataagaaaatccaattgttgaccgattatgtggagcagaccgagcaggtggtgaaagagtataataaagaacatcacatagacaactctattttggtcaatgggcgacgccagaccaatctcggagtattccgtgcctatctgaccaactacttgaaaagtcttcccgatgtcaataagaacctcacttgtatggtacggtatcttcagcccaccgaacaaggtattccggtcgaactttactttttttctgctgtgaaagagtgggtaccttacgaaggaattcaggccgatgtattcgatcatctgcttgccattgttccggaatttggtttgcgcgtattccagaatcctacgggagaagattttcgggagtggaatagaagaaattaa

SEQ ID NO: 1004 - DNA, 840 bp, B.fragilis
gcaaagtttctattttttagtaggcgctctgaggatttatcacttatttcgctgccaataaatttagataatatgggaaaaataattgctttggccaatcaaaaaggtggtgtaggaaaaacaacgactacgattaacctcgcagcttcgctggctacgctcgaaaagaaagtactggttgttgatgcagacccacaggcaaatgcctcttccggattgggagtcgacatcaagcaatctgaatgtactatctacgaatgcattatcgacagagccaacgtacaggacgctattcatgacaccgaaattgattcgttgaaagtcatttcatcgcacattaatctcgtaggcgccgaaatagaaatgctaaatctcaaaaaccgtgaaaagatactgaaagaagtgctgactccgttaaaggaagagtatgattatattttgatagactgctctccttcgctgggactgatcacaatcaatgccctcacggcagccgattcggtgattatccccgtacaagcggaatattttgcccttgagggaatcagcaaactgctgaataccatcaagatcatcaaatcgaaactgaacccggcactcgaaatagaaggttttctgctgaccatgtacgactcacgtctgcgtcaagccaaccaaatctatgatgaagtgaaacgccacttccaggaactggtgttcaaaaccgtcatccagcgtaacgtaaaactgagtgaagcccccagctacggtctccccaccatcttatatgatgcagagtccaccggagcgaaaaatcatttggcgctggctaaagaactaataagcagaaacagtaaataa

SEQ ID NO: 1005 - DNA, 615 bp, B.fragilis
gtaggtatgtatcagtatgttattaaacgattaatcgattttgtagtcgtgttttttgtcctgattattatctggcctgtattgcttctcgtaactctttggcttcattttgccaataaaggtgccggtactttttttcttcaggaaagacccggtagacatggtaaaatctttaaggtcatcaaatttaaaaccatgacagatgaacgtgatgcagaagggaacttacttccggatgataaacgattgacgaaggttggtaagtttgttcgttctacttcgattgacgaactcccacaattaatcaatattctgaaaggagatatgtcctttattggtccccgtccgttattacctcaatatcttcctttatacaataaagaacaggctcgtcggcatgaagtccgtcccgggataaccggttgggctcaggtgaatggacgaaatgccatttcgtgggtaaggaagtttgagttggatgtctggtatgtagaccattgttctttttttctggatttgaagatcttttttttgactataaaaaaagtttttgtgcgagagggtatcagttctgatacttcagtaacaatggaaccttttacagggaataattaa

SEQ ID NO: 1006 - DNA, 1068 bp, B.fragilis
agtagtatgcagattttttgtacactttttaatgttgcttatttagataaggctatcacaatgtataattctcttgagagagtctctagtgaatttactctatatgctttggccatggatgataggtgctatgaaattttagttgatctaaattttaggaacttgaaaccgattaagctatcagactttgaagatgatgatttgcttaaagtaaagtcagatagaacctttggtgaatattgttggacttgttcatcttctttgatatcttacgttctgcatgaatattgtgagccacattgtacgtacattgatgcggatatctactttttttcggatcctatagttttgatgaacgaaatgcttcataagaatgcttctgtattaatagtaggtcatcgttttaatgactataatagagatttaatgtgtcggactgttgggaaatactgtgttcaatataatacttttttgaatgatgaaaatggtaatatattgcttgaaatatggcgtcgacaatgtataacgcattgttcttgtgatggtgatggtgtctattggggggatcaaaaatatatggataattggactactgactatgattttgtacatgaaactcttaatgtaggtgctggaatagctccttggaacatctctcaatataaattgcgtttaataaatgactcaggctgtgttattgtaagtaggaataaagttgattgctctacagtattttatcattttgaaaatattaattacataaatgataagattgtgaaaattaatgtgttcaatacatggcatatagataaggaactagtgaaggctttttatattccatatttgactgaggtttatgacattaaactaatgctaaaggaaagatatgctgtgaatattttgcttaaaaaacatcctggtgttaaatgtgataaaagaacttttgtccaaaagattattgataggttaagttatcttattgataaggaaaaacaaaaactctatataatgtcagttcttccaactagactgtataagaaaaatgatgtaataattattattggataa

SEQ ID NO: 1007 - DNA, 1527 bp, B.fragilis
cttatagttaatgagatgagcgacaataagcgtattgcagttaatacattgattatttatgctcgaatggctgttacgacaataatcagcctaatagctacaagatatgtcttacttgaattaggacaagctgattatggattatataatgttgttgggggcatagtgacgatgctcaatgtggtaagtataggaatgtatatgaccacgcagcgttttattaatgtagaaatgggtaaaggacctaatggaaatttaaataaagtattcaatgtttgtatagttctgcatataggatttgctttatctatttttatcataggtctgactgttggtttatggtatatttataacattttgaacgtattgccagaaaaactttccgatgcagttttgatatattttatatctactacagtttctgctatcggtattattaatattccatttcaaggattgatgttagcatttgagaaatttaaaaagatggcaataattgatttgctatctaatttcatgaaagtgcctttagttattttacttatgtgttggtctggtaataaacttcttttttatgcgattggtgtttgttttatttctcttttctcttttcttttctattatagttattgctatcgaaagtttggggatattgtgaaatggcatctgtcacgtgaaaaatatatttataaggaaattttagttttcaataattacacttcgattggaactattgcatacctttctcgtactcaaggtgcttctgtggttataaattacttttttggaattattgtgaatggagcttttgctatagtattccaaatcgaaaatttcattatgatgtttgttaataatcttgggactgcttcagatccacaaataactcaatcctatgcctctggtaattatagagatgcattttctcttgttgagaaaatttctaaatatagtatgttcataatgcttcttgtaacattttcaattggtgttgagctggaatttcttttaagattatggctcggtacattgccggagggtattttagtactttctcgctggatgttagtaagtcttttagtgcggagtataaatagctcatgtggctctattattcaagcctctggtcatgtgaaatggtttcaaataataagttctgtattattattgcttggattaccaatatcttggcttttatataaatgggggatgccccccgtaactattataattacttttacagtaaccgattttattagcagaatgatatatttatggttaatgcatcgaattatcaaatttgatgttttgcatttttcaaaaaaagtttttttacccgtaattaaggttctgtgtctatcaggcttatatctgtatctctacaattccattatgctacaaactgattttatgcgtgttatggggattggcgtgtcatgtatgttttatgtgtgtctatgtctattcgttgggatgaatcgtttggaacggaatagtatttttttttatattaagaataaaatatga

SEQ ID NO: 1008 - DNA, 1038 bp, B.fragilis
catttaactaaaacacgacctatggcaatcagtctcaaagacaatctgacttcttcctatttcaatgctgctcataagttatactctaaaaaggcgcgccgccggattgtagcttatgttgagagttatgacgatgtagctttctggcgtacactgcttgaggagtttgaggacgaagaacattattttcaggtgatgcttccttcggctacatctttggctaaaggcaagaaaatggtactgatgaatacccttaatacggccgagttaggcaaaagtctgattgcctgtgtggatagcgattatgactttttgttgcaaggagctactgctacttcacgtaaaattaatcgtaatagatatatttttcagacctatgcttatgctattgaaaactatcattgttatgccgatagcttgcatgaggtctgtgtgcaagccactttgaacgacagacacctgattgacttcaatgagtttatgaaacgatactctcagattgcttatccgcttttcctgtggtctgtctggttttatcgtcgtcatgatacttatacgtttactatgagtgaatttaatgcctgtgttcgtttgcacgatgtcagcttgaggcatccggaacgttctttggaggcagtgaggcgttcggtaacgtctaaactttctgagttatccacgcgttttccacaaggtatcgaagaggtcgacaagttatcggtcgaattaaaaggacttggagtgcttcctgatacaacatatctgtttattcaggggcatcacatcatggacaatgtcgtgatgaaagtattgactcccgtttgtacagccctgcgacgcgaacgggaacaagaaatcaaaaaattggcggaacatgacgaacaatttcataatgaactgacttgttatcaaaacagtcaggtcaatgtggaggtaatgcttcgcaaaaatagtgcttacaaagatttatacctttatcaatggttgaaagaagacataaaagagtttttatatggaacagataaccgaaaaaataaatga

SEQ ID NO: 1009 - DNA, 765 bp, B.fragilis
tcacaaactaaggcgcaacattttatgaaaaaccgacattacttaaggcacatactggccattactgcgttattattcaatggagaagccatttactcgcaaacttatccaatagaaaactacttaaaagcagcaggagactatgttactatttacaatggtgaaatcgaattaacatacagtcttgcccaatacgacaatcttccctattttcaaggtgatgaatttaccacaggagagattatcttcaaaggaaaccgatacccgggactggatcttcatttggatttacacaaagaccaactttgtgcactgactcctgacagccattacagcatgattatcaataatgaaggaatcgaacaagtcaacctgcacaatactacatttatctatttccgtccgacaaagaagacagatctcaataagggattttacgaattactacaagacggaaagcgactgagactgctggcacgaaaaacatactccgttgctcagatcaacgtagaaaaaatagccaaaacccgcaaacatcaaactgaatacttcatatacggagtaaaatattatctggaatacaatgggatatattatcccgtcagtaacaacaagtcgtttgccaagatctttccggagcaacataaactgataaaacgttacgcacgaaaacataaacttaattttcgccatgacgctgatgcctcattaatcgctcttactaacttttgtgaagaattgatagaccaaaaacaaacacgatga

SEQ ID NO: 1010 - DNA, 360 bp, B.fragilis
aatcattataatatgaagaagttgaaaagcccggcgtcacaaagtgaagccatgaaactgagatggaaaaaacggatcgtcttcgagaaaggatacaccgagtcgtgcgccgaatggatggcagaacgacttgaagcactcctggaccatatgcaatatggacatgcgacggtagcttaccgaaaacaaaacgggagtttccaactggtaaaagcaacattgatttactacgaagcggagttccgtaagaagtatgatcccacaaaaatagaaggcgcagtagtctactggaatgtggacgaacagagatggacgacgtttcaagtggagaattttatggagtggagaccggtggtatag

SEQ ID NO: 1011 - DNA, 1002 bp, B.fragilis
atgaagaataaagaattagggatgaagaaactaataaaaaaggcgctgaaacttatcttaccattggttttgggaggctttatcttatattgggtctatcgtgacttcgattttgtgaaggctatggaagttttgcaacatggcacaaactggtggtggatggctttctcgcttcttttcggcatatttgcacaggtatttcgtggttggcgttggcgccagacgctggagcctttgggagcatttccccgaagaagggattgtgttgatgccattttcatttcgtatgcagctagtttggttgtaccgagggtaggtgaggtgagtcgttgcggggtacttgctaagtatgacaacgtttcttttgctaaatctttagggactgtggttaccgaacgtctggtagatactgtgactattcttttgattaccggtgttacggttctattgcaaatgcctgtgtttgttaccttccttgagcaaaccggaacgaaaatcccctcattcatgcatttacttacttctgtctggttttacattgttttattttgtacaatcggagttattgtacttctctactatctgattcgtacgctttctttctttgagaaagtgaaaggagttgtgcttaatgtttgtgaaggaattatgtcactgcgtaatgtgaagaatcttccgctttttctactctatagttttttgatatggcttagctatttcctgcatttttatttcactttttattgttttgcttttacggcacatttgggcttacttgctgcattggttatgtttgttggaggtacctttgctgtaattgtgcctactccgaatggagccggtccatggcattttgccgttattaccatgatgatgctttacggggtaaatgcgacggatgcagggatttttgcactaattgttcatggcatccagactctgctggttattttattgggtgtttatggattggtgactatttcttttttacaccggaagtga

SEQ ID NO: 1012 - DNA, 1335 bp, B.fragilis
attctatgtaagatggaaaaatgtaaaaaagtttatgttggaatgagtgcggatatgattcatccaggtcatttaaatataataagagaggcttccaaactaggttctgtaactgttggagttctaacagatgcagctattgcaagttataagcgccttccttatttagattatgaacagcgtgcggagatagttaaaagtatcaaaggtgtagattctgttatacctcaagagactttagactatgttccaaatcttgaaaaactacgtccggattatgttgttcatggtgacgattggattgatggtgttcaatctaatactcgtaaacgtgtaattaagtgtttgttagagtggggggggaaagtggttgatattgcatatactaaaggtttttcttctactgcaatgaatgagaggataaaagaaataggtacaactccggaaatcaggcagaaaagacttcgcaggctaataaacgcaaaacctattgttcgtattcttgaatcacataacgggttgactggactcattgcagaaaatgcttcggtaataattaacggagtgaagcatgaatttgatggtatgtggtcctcttctctaacagactcaactagcaaaggaaaaccggatatagaagctgttgatttaacaactcgtttacatgatttaaatgatactttagaatgtacaacaaaaccagtaatttttgatggtgacacaggtggaaaggttgagcattttgtatttacggttagaacgcttgagaggcttggtatttccgccattatcattgaggataagatcggtttaaaacaaaactctctatttggtactgatgctgttcaaacacaagattcgatagaaagtttctgccataaaattcgttcgggaaaaaatgcacaagtaacagactcttttatgattattgctcgtatcgaaagtcttattgctggtaaatcaatggaggatgctttggaaagggctgctgcctatgttaaggcaggggctgatggagttatgattcatagtaaagacaagtctgggatggacataaagaatttttgtacatgtttcagaaaaatcgactcgacgacaccaatagttgctgtaccaaccacttataatcagtttactgaatcagaattggcttcatggggtataaatgttgttatttatgccaatcacatgcttagaagtgcttatcctgcaatgctggattgtgcaaaatcaattttgactcatgaacgttcgttagaagcatccaatgattattgtatgccaatcaaagaaattttagaattaatacctggtacaaaagcattaaaaagatga

SEQ ID NO: 1013 - DNA, 1152 bp, B.fragilis
actgaaatcctgggaattatgaaatattatctgattgttggcgaggcttcgggcgatttgcatgcttcccacttgatggctgcactgaaagaggaagacccggaagctgaatttcgcttctttggcggtgatttgatggctgccgtgggaggaacaatggtgaagcattataaagagttggcctacatggggtttatccctgtgctgctacatttgacgaccatttttgccaacatgaagagatgcaaggaggacatcgtggcgtggtcgcccgatgtggtcattctggtggattatccgggctttaatctcgatattgctaagtttgtgcatgcgaaaacaaagataccggtttattattatatctctcccaagatttgggcatggaaagagtatcggatcaagaatataaaaagagatgtggacgagcttttttccatacttccttttgaggtaggatttttcaagggacatcgatatcccattcattatgtgggaaatccgacggtagatgaggtgaccgccttcaaggcgtcgcatcaggagtcctttgccgattttattgccgatagtgaattggcagataaacctatcatagctttgcttgcaggtagcagaaaacaggagattaaggataatctgcccgatatgatccgggctgcttcagcttttcccggttatcagcttgtgctggcagctgctccgggcatttctccggaatactatgccaaatttgtaaaaggaacggaactggcggtgatttttgaccggacttatcgtttgctccaacaggcggatgttgccttggttacttccggtacggctactctcgagacagctcttttccgtgttcctcaggtggtttgttatcatactccggtgggcaaattggtgtcttttctccgaaggcatattttgaaggtgaagtttatctcgttggtcaatctgattgccggacgtgaagttgtcagggagttggtggccgatacgatgacggtagagaatatgcgggccgaattggagtgtttgctgtttcgggaggattatcgtcgcaaaatgttggacggttacgaagagatggcacggttactcggaccggccggagccccccggcatgcagctcgtgaaatggtgaaattgcttaaaaaatag

SEQ ID NO: 1014 - DNA, 855 bp, B.fragilis
aaacgtaacaacaccttgaagaacaactttttacaacgcgccataacaggaatattattcgtagccatcatagtgggttgtatactttatgatccactggctttcggcactctttttgtcattgtcagcgctctgactatacgcgaattcggacatctcgtcaaccaatcgggagaggtaagcatcaaccggactatcaccatgttgggaggagcttatctgtttctggccattatgggtttctgtatcgacgctgccggttctaaaatatttattccttacctgatattaatcatttatctgatggtaagcgagttatatctcaaaaagaagaatccggttttaaactgggcttactccatgctgagccagatgtacatcgcgcttccctttgccatgctgaatgtgcttgctttccagaatgatccggaagcaagcagcgtatcatacaatccgatattgcctctatccatctttgtctttttatggctgaatgatacgggggcatattgtttcggatcactttttggcaaacaccgcctgtttgaacgcatatcacctaaaaaatcatgggaaggttccattggcggaggtattgtagccattgcctcttcatttgtttttgcctgctacttccccatcatgacatgggcagaatgggcgggactggcattggtagttgtcattttcgggacttggggtgacctgacagagtctctgctgaaacgccaattgcagattaaagattcaggaagtattctacccggacatggaggtatgctcgatcgcttcgacagttcactaatggctataccggcaggcgttatttacctatatgcactgacattggtctaa

SEQ ID NO: 1015 - DNA, 945 bp, B.fragilis
aagaaattaaaaaagtgtgttatatttgtggctaataatactatattagctatgaatgcactacaaagcaacattattcgggagatcactccgctgtccgataaggattgtttctacattgccgaacggtataaaacggagtttacttatcccattcacaatcatgccgaatttgagctgaactttacggagaaagcagccggtgtgcgacggatcgtcggtgattcggcagaagtgatcagtgattatgatttggttctgattaccggaaaggatttggaacatgtatgggagcagcacgattgccattcgaaagagatccgtgaaataacgattcagttctcttccgatcttttcttcaaaagttttatcaataagaatcagttcgattctattcgtgatatgcttgagaaagctcagaaaggtctttgttttccgatgtccgccatcctgaaaatttatccccttctcgatacgctggcatccgagaaacaagggttttatgctgtcatcaagttcttgaccatactttatgaactgtcacttttcaatgaagaggcccgtacgttgtcaagttcttccttcgcgaaaatcggcattcattcggatagccgccgtgtgcagaaagtgcaggaatatattaatgcccattatcaagaagagatccgcctgaatcagctggccgatatggtaggaatgactccggtatctttcagtcgcttctttaaattgcgtaccggtaagaatctttcggactatatcattgacattcgtttggggtttgctgcccgcctgctggttgattctactatgtctattgctgaaatctgttatgaatgcgggtttaataatctttctaatttcaatcggatcttcaagaaaaagaaagaatgttcgcccaaagagtttcgtgaaaactacaggaagaaaaagaaactggtataa

SEQ ID NO: 1016 - DNA, 324 bp, B.fragilis
cttaaacaaaaggaggcaattatgaaacggattttcacactatatctctttatcttattctgtctgattttgcaagcacaagaagaattatatgaacgggtatacgtacatacggataaaacgtgttatttggccggtgaagaagtatggctcaaattttatactattgacacacattttcgcccatcttctttcagcaaagtgggatacatagaaatatcaaatactgaacggcctaaagcacagcttaaactggcacttgacaatgggagcggttcgggcaaagtaaagattcctacagacgctccttcgggaattttatga

SEQ ID NO: 1017 - DNA, 867 bp, B.fragilis
atggcaaaaaaaactaaaatatacccgttatacattgccctgcttctctgtttttttcaggtagcagggattgatgtgtatgcacaggagcctgtcaaagtatcccaagactccatttctccggtacgcgaagcccccaaagcacgggcacgccgccatcgcgagccggtcgtttctactccggccaccgacagtgtgaaagtggagaaagcagtcgtcctcccaccgatagacagtttggagaacctgaaacccgccatcgttacggcagacagcctggaggaagtcaaccgacagaacctggaaaggatagaaacacccgtcatgccatcggtcgtaaaggcagatagcctgccacccgtcatgcccaagaagcttttcgtacctaatccgacgaaagccacctggtatgccatcgtatttccgggcggaggacaaatttataaccgcaaatactggaagttacctattatatatggtggatttgccggatgtgcttacgcattgagctggaacgggaaaatgtataaagactatgctcaggcgtatatggatattatggataacaatcctaataccaacagttttcaggatttgcttcctccgaatcataactataccgatacgcaactgaaagacctgctccgcaaacgaaaggacacataccggcgctatcgggatctcagtatattcgccgtcatcggtgtatatctgatttccatcatcgacgcctatgtggatgcggaactatcgaatttcgacatatcacccgacctgagtatgagggtggaacctactattataaataacaacccgttgcaacccggcagcaagtcggtaggcgtgcaatgcagcctcagattttaa

SEQ ID NO: 1018 - DNA, 1206 bp, B.fragilis
ttatatatgaagttactttatattggtgctttttgtgagccttcaacagatttcttaattagaaaacgtaccaaaggacatataacagttagtgctacgacttttcagaaagctcttctgtctggttttgaaaatttagaaaaaaaattagactatatcataaatattcccgatatcggaagcttcccattacgctgtaataatccattcttttcaagaacgaacttccaatttgcttttatgaagggagttaatggctcatttcttaatattacttacttgaagaagtatagtatctatcaatctgtgataaatgaagctaaacgatggcttaatttacatagggatgaggaagtaactataattgtgtactctctcatgtatccataccttaaggcagctattgatttgaaaaaacattattccaatatgaaagtgtgttgtattgtcttggatttgcctgagtattttggagataattcatccattctccatagagtgttagaagcaagaaacactaataagatttattctttagttcaggaaattgattcctttattttactgacagagtttatgaaggataaattgagagttggtattcgtccttggtatcttttagagggtatttatagtcctgtagaagttgctctacaaaaaaagaggaggaaaacgatactctatactggtaagttagatgctcgatttggcatacgtgatctgattgaatcatttatcaagattgatgatagagagttttctttgtggatatgtggttttgggacagatcgagcttttgttgagactgcagccaagaacgattgtcgtataacatattggggacttgtagatcaaaagcgtgtatttgagatgcagcaacaagccacgttgttgattaatcctcgtaaaggagatgcagaatacactaagtattcttttccttctaagacaatggagtatatggcttcgggaacacctaccataatgtataaattaccaggacttcctgctaactacttaaatcatttgattcttataccggaccattcacgagaaacacttactacattgttaaaagagtgggggaataagggacaggatgaattggatgactttggtaagcatgcaagacaatttatattggataataaaaattcagaaaatcaggcaaggcgattgttggaatttctggtgaataagacatga

SEQ ID NO: 1019 - DNA, 1029 bp, B.fragilis
gacatgaagaaaaaaaaaatcttgttttattcgagtgttagatcactcgaattgttgaatacacaaaagttctatcagatagatattgctctgctgaggaatctaggttatgatgtctgtttatccaataggatagttgacagtcttaagttttgggaatatgatattttgttctcttatttttatcgatattcattttttgcttcattttttgctaaatgtttaggtaaaagaacctattttactggaggtattgataatttagatgaaaattatgcctctacccgaaattataagattcaagtgctattttttaagctctgttattgggtctcaagttcttgtattattgtgtctcaatctgatttaaagaatatagcaaaagtatttcattttagaagaagattgagttatagtgaacatgtggttgatactgcacagtttatgtctgatgttccgaaagagaagctatttactacggttgtctggatgggtgaggaagggaatgtgcgacgaaaaggggtggataaggcattgcgaatctttgctgaattgaagaagataacttcattttctgattaccgatttattattatgggtaagaaaggtgagggaactgccttggttcaatcattgattaatgaatatgatttagaaaaatttgttgaattagtgggtgaagtctcagaagaagaaaaaattgctttcttaaaacgttctaaatattattttcagctctcattgtatgaaggttttggcttagcagctttagaggctttgtgtgccaacaatattctgattcattcgggtagggggggcttggctaatcctatctacacagatcaacttctttttgatatagataatgattttgataaagagttttcgattttaactaaaaaattggcttcttttacttcattgattccaaatgatgaggtcttaagttattatgatatccagagaagaaaagaagattttaaggctattattacagacaacaataggaattataaattaaataattaa

SEQ ID NO: 1020 - DNA, 375 bp, B.fragilis
ttgttaaaccttaaatctatttttatgaaaataaaaaaattatttactattctaacagtgctttgtttctctgctttagcaggagttgtgtttcttaaattcgtagataataaaaagaacgccagagatattgcattggcaaatgttgaatctcttgctaatgctgaaggcgatggtatagggaatgaggataatccatcaactacgataaaaaagtgtgtaagctccagtgaatttacaaaagatgattctacgggagagtattatttggtgtgtaattcaggaactaccgaaagcgttatttaccgttgtccatctggtactaccgaaggtcacaaagattggatatatagttttctttattgtacgagatag

SEQ ID NO: 1021 - DNA, 981 bp, B.fragilis
acaaatatagaaaattcaaacgataaattggttacttttgcatcagttttcaataaaggtaacattttcggtatggagattgataagaatctgaaaggacacgcattggcatttacagccaacatgatgtgggggctgatgtcccccatcggtaaatcggcattggcagagttctcagcgctttcggtaaccaccttccgcatggtaggtgccgcagcagctttctggatactttccgctttctgcaaacaagagcaggtaggacaccgtgacatggtgaagattttttttgcttctctgtttgcccttgttttcaatcaggggatatttatattcggattgtctctcacttctccgatagacgcatctatcgtaacaacaacttcacctatcatcactatgattgtagcggccatctatctgaaagaaccggttaccaacaaaaaggttttgggcatctttatcggagcaatgggagcgttaatcttaattctaagcagtcaggcagtaagtgcaggaggaggaagcatttggggagatttactttgcatgattgcgcaacttagcttctccatctatctaaccgtattcaaagggttatcccaacgctattcggccatcacgattaataagtggatgtttatctatgcatccatctgttatattcctttctcataccaggatatagcaagcattaagtgggacagcatttcgacagccgccatctatcaagtactttatgtggtactatgtggaagtttcattgcttacatctgcatcatgaccgcgcaaaaactaatgcgccctacagtagtaagcatgtacaattatgtacagcctattgttgcttctattgctgctattttaatgggaatcggaagcttcggctgggaaaaaggagttgcgatcgcattggtatttcttggagtctactttgtgactcaaagtaaatcgaaagcagatttggaaggtgtgtcataa

SEQ ID NO: 1022 - DNA, 756 bp, B.fragilis
ctaaaaaaagagatgaaaaaaataaaactactttggatggcaatgttgacactgatgctgccggcattgcaatcgtgtgacgataatgatggctattcattgggagatatagcggtagattgggctacggtacgtgtggtcggtggcgacacttattcgctgaatgctgaccgttggggaactctttggccggctgcaactgctattccattttataagccgatagacgggcaacgggtgattacttacttcaacccactttacgataactatgaaggatatgatcatgctgtgaaggtagagcataattataatgtcctgaccaaacaggtagaagatttgacggctgagaatgaatcggaatttgggaatgatccggtttgggttaacaaggatatgatgtggattggcgggggatacctgaatgtcattttccgtcagaatttaccggttaaggagaagcatcttgtcagtctggttcgtgataagtgggctacagctgctgagggagaggatgatggatacatccatttggaatttcgctataatacatacgatgatgtgaccgctcgccaggcgaatggtgccgtatctttcaacttgaattcattggatctgaccggtaagaaaggcattaaggtgaaattgaattccgtaaaggacggggaaacggaagtggtctttaacttaaagggccagtcaatgccggaggaagcaaagcaggtgacgctttcggatgaagtgcaaataaaataa

SEQ ID NO: 1023 - DNA, 903 bp, B.fragilis
ataaacgaagatatggcaacacagagaagaaatgcattaggccgcgggctggacgccctactctccatggaagaggtgaaaaccgaaggttcttcgtctattaacgaaatagaactgtcgaaaatctccgtcaaccccaaccaaccacgccgtgagtttgatgaaacggcactggaggagttggccgattcgatcagagaaataggaattatccaacccatcaccttacgtaaagtctcggacgacgagtaccagattattgccggagaacgccgctaccgcgcctctcagaaagccggactggatactattcccgcatatatccggacagccgatgatgaaaacgtgatggaaatggcgctgatagagaatatccagcgtgaggatcttaattcagtggaaatcgcactggcctaccagcacctgatagagcaatatgacctgacacaggaacggctgagtgaacgtgtcggcaagaagcgtacgaccattgccaactatctgcgcctgctgaaactgccggcaccgatacaaatggccctgcaaaacaagcagatagacatgggacacgcccgggcactgatcacattaggcgatccgaaactacaagttaaaatattcgaagagattctggaacacggatactccgttcgcaaagtagaagagatcgtgaaatcgctgagcgagggagaagccgtaaagagcggaaccaaaaagataaccccgaaacgggccaaactgcccgaagaattcaatatgctgaaacagcacctttcgggattctttaacaccaaggtacaactgacctgttctgaaaaaggaaaaggaaaaataagcatccccttcagcaatgaagaagagttggaacgtatcatggaaatcttcgattcactgaagaaataa

SEQ ID NO: 1024 - DNA, 810 bp, B.fragilis
accatatactgccatacaatggcatggacaataatgaaacggaacaaaaagaatttcaggataacaacaaacacatgtctatatccggagctcaacaaaataagtccagccaatgaacacttaaccatgcaaatagcctcgcaagtttacaatattcctacagcagccaatgggctctgtttttttcaaaatgatgaacctgcctatatcacacgacgttttgacattgcacccaatggaagaaaattcagaaaagaagattttgcttctttagccggaatatcaaagggtaataaaggtcccaactacaaatatgatgtattaagttatgaagagatggcggatattatcaaacagtacgtctcagcatcatctgtagaggttctaaaattctttcgattagttattttcaacttccttttttcaaatggagatgctcatgctaaaaatttctctttgttagaaactccttctggagattttatacttgctccggcatatgatttgctaaataccagactgcatatttttgatgatcatgtatttgctttacaacgtggcttgtttaaagagaatacattaaacggaaatgacggtgcggttacaggaaaagaattcatagaatttggtatccgcatcggcattccccccaaaagagttcataaagagctaataagcttttgccaaaaggcagaacaagtacaagatttagtcgaaaaatcatttttaccgaatcaattaaagaaacaatatttactccattaccaaatgagaaaagattcctatctttcggtaggcattctcacataa

SEQ ID NO: 1025 - DNA, 1443 bp, B.fragilis
caatgggagcggttcgggcaaagtaaagattcctacagacgctccttcgggaattttatgatttggacggaatccacccgatatatgaggaatgagggagaaaaagtgtttttcagaaatcccattgctgtaattaacacttcccgagtatcagactccgatcctattgaactagcggattctgccgagatatatccgaaagggaaaccgggtaccaccgaaaatattcatataaaaacttcccggtcgaactacaacacacgccaactcgtagaattgaccattaatagactaccggatgaagtatccgatcttactgtctcggtaagccgtaatgattcactggtaaccctcccgcctcttgaagaatccacctggagcaaacaagtgaccgctactcccggaacattttccggaaaatggataccggaatatgaagggcatatcatctgcggacagatagaaagccctacaggagaaacattgaagcaagtacaaaatgaacctatatcagccgacatcgctttcgtaggaaaagatatacgatatgtgcaaggacaagtggaatcgggaggaaatacactgttctacacaagccatgtatatggaacgaacgatgtagtagccgctgcatggaacattaacggggaaccgttcagaatgaacatcttatcacccttcagtgaaaagttaccccaaaacttgccatcattaaaactctatcggaataaaaaacgactgttggaaaggagcataggtatacagctgcagcaagtcacagtgctcgattcattggatcatgccattcctctgcaatcttgttatggacttcaaccttatctgaattacaatttagatgaatacacacgattcaatacaatgacagaaactttcgtggaattcgtacgcagtgtgataatacgtaaagttaatggaaaacgtagattaagagtactcaaagaaggagaaaaaagattcaatatcggaaatacattggtactgctggacggtgttcccattcatgaccatgaggatattttaaaatataatcccagattggtgaagaaaatcgaaatatataacggccgttatggatttggtggtgaagtattcgaatgcatgatttcacttactacccaaagaggagacttaccttccatacagcttagtgacgattcacgactaacggtttacgagtgtccgcaactgcctgttacatttaagatgcctgaatataaagacgctactgacaaaaaatcacgtagaccggatttccgccatacgctatactggaatccctctgtagagacagaagcaggaatagataccacactttcattctatacttctgaccttgaaggagaatttaaggtggtagtggaaggcttcacattaaaaggagagctgatcagaggcgaggtaaacttccatgtgaaaaaatga

SEQ ID NO: 1026 - DNA, 951 bp, B.fragilis
ccctgtcatagttacaaaagacataatagaacgattgaaaaatgttctgggaacaataaattgaataattatttgtcaatgaatgaaggtttaacaaaagaatatcgggtaaagttgttagaaacatttgcagcttttgatcgattctgtaaagcaaatggaataaaatattatgcggcttatggaacgcttatcggtgctgttcgacataaaggactaattccatgggatgatgatatagatgtttatatgttacgtgaagattatgataaattctgctctctgaagggaaaagtcatggatcattatgatattatggatattaatgacgatggttattggttactctctttagcaaagttcgtagatacgaataccactctttgggagtttaaaaatcgccctcttattttgggtgtttacatagatgtatttcctctagatgagtgtaatatggagcaagtaataactcttaaaaatagatatgataagtattcacttttggtggctcaatcaatgatgagatattctttaggagatattttgcattcattgtttaggttgaaactgaagtgtttattattacaaatctcttgtgttttctataaaagacataaatacgcatattacaaacagaagtatttaagttgtgttgaagatataaaaaagtctaaaggtaatttcttggtttcttatgatggaccttatggaatgggagaggtattggacaaaaaattgttttcggagtctgtgttggttccatttgaaagtatgtctattgaagtgccaattggttatgaggagtgtttaaaaagtatatatggagattatatgaaactacctcccaaggaaaagagaatttctcaccatagtcgttattatttgaatttaaaccatcgtttgtcttttagtgaaattagtagagaaatttcattaagaggcaaaatttga

SEQ ID NO: 1027 - DNA, 2778 bp, B.fragilis
agaattgatagaccaaaaacaaacacgatgaaaaaaagtacatacttatggatgttgcccctactatttgcatggccgcaacaaatgacggctcaacaccccctctcacttcctgctgacagtataactattgactctttattggagactgtagaaaaaaatacaccctataggattttcagcactattagtgctcctttcaaggttttggtgaaaggaaaagcttcacccctgcaacaattaaaagaagcacttgagccgactccctataaattgtcagtatccggaaacaatttattcgtgctgaaagagcaggaactcatcacgctattacctgctaaactgaccggagaaccggaaaaaggcgaaagttattatggtgacgtatatacttacctaagcggagaacctgaaaaggcatcttcagaaaacaaagtgtataatgtgggagatgtacgaatcaagcaaccaccacgaaaagcggtactcaaagggcaagttactaactttaaaaccggtgagcccatgataggcatcaatctgattttaaaggacccatggattgcgacgacaacagatgttaagggaaactttactcttgaacttcctaccggacacaaacaaattgatatcaaaggacttaacattaaagatacccgtcgacaaattatgctttacagtgatggtacactggacatcgaacttgaagaaactacgcatatgctggacgaagtaaccattacttccggacgtatacaaaatgtgaaaagtacgcaattaggtgcagaaacactgcgtccaacccaattgaagaatatcccgatggccttgggagaagtagacattttaaagatggtacaggctttacccggtgtaaaaacagtaggtgaagcttcaagcggcttcaacgtacgtggtggagctaccgaccagaatctaattctgctaaatgacggaaccatctataacccgaaccatttattcggcttttttgcagccttcaattcagatatggtaaaagaagccgagatatataaaagcagcatcccggcacaatatggtggacgtatttcatccattctagatatcaccggtaaagaagccaataaagaaaaattcaccggttcggccggtatcggtctggtaacgagtaaactgaatctggagattccgattatcaaagacagaacgtctgtattactaagtgggcgtactacgtattctgactggatcatgaagcagcttccggagaaaagcgaatacaaaaacggtaccgccggcttttatgatttggctgctattgtggcacataaattcaatgacaaacatagtcttaatgtctacggatactatagtcatgaccgtttcgctttcaattcaaacgaaaaatacggctacaataatctcaatgcttccgcacgatggagagctgtatttaacgaaaaactgataggatacttctccgccggatacgatcattacgattacaataaccgcgagaccgtcaatgcatcaactgcttataaactttcatttgatattaatcagtattttgtcaaagcagacttcacaaacatactggccgataagcacacgctcaactttggtttcaagtccatgctctatcatatcaattcgggtacttatgaacctgaaggaagtgaatcatttgtaaaaaaggacgttttacaaaaggataaagccttggaaacggcattttatttaggtgatgaatgggaaatcactcccaaactatcggtcaacgcaggtatccgttactcactgttcagtgcactcggtccacgttcgtactatcaatatgcatcaggcatgctcccacacgaatcgaccataacggacaccatcactgcaggagcaggaaaattcatgaagacttatcatgggccggaattccggttatccgcccggtatgccttcacagataatttctcggtcaaagccggatttaactcgatgcggcaatatatccataagttgtcgaacactgtcattatgtcgccaacggatacatggaagttgagcgatgtgaacatcaaaccccaaagaggctggcaagccgcagccggactttatctaaattctccgagtggcatctgggaatattctgtggaaggatattacaaacgaatgtccgattacctggattatcgtggaggagcaaagctacttatgaaccaccatattgaaactgacgtcatcaacacgcagggacatgcttatggcgtagaattgcaggtaaaaaaacaagtcggtaagctcaacggatggatgagttacacgtattcacgtaccttcttgagacagaatgataaacgaattgagaaaccggtgaataacggtgactggtatcctacagaatacgataagcctcacgactttaagtttgtaggtaattacaaatttacgcatcgatacagtatgtcaatcaacgtggattatagcacaggacgccccactaccatacctgccggacagtattatgatgaatcaacgcaatcgatgcgagtttactatacggaaagaaactcataccgcataccggattactttcgtacagacatctcttttaatatagaacccagccatcatctgaccctgttgacacatagttctatttcgattggggtatacaatgtaaccggaagaaagaatgtgtattctatttattatatgccggaagaaggacaaataaaaggataccagatatctattttcggagttccgattcctttcattacgtataacataaaattctaa

SEQ ID NO: 1028 - DNA, 1017 bp, B.fragilis
cagtggtgcagaaatattctttcagatttgtttaggcgatatgcttgtttcgtaagtgagtttagtgactttcaggaaaatcctatattagaagaagttaataatggttgcaattttttcgagaagtcaaaatcggacattataatagcatgtgggggcggaagtgtacttgacatggctaaattaattcgttttaaagctgcttatgatggcgatttggttgattctgtttttgaaaagaaaaaggaattaactcctcttattgcattaccaaccacagctgggactggatgtgaagccactccttttgctgtatgttataagaattcaataaagtactcagtggctcataatgatatgcttcctgattatgctgtgatatttcctcagtttacttataataattcttcatatctgacagcctgtacaggtttcgatgcactttctcaaagtatagaggcctattggaacgtgaatgccacagcagaatctgatgaatatgccaaaagagctatttctgttctttgggataatcttccaaaggtagtaaattctccttcaaatgagattcgcgatttgatgtctgttgcagcttattggtctgggtgtgcaattgctattactaagactacagctccacatgctttttcgtatgcttttactactcattgcggttatccacatggacatgctgtagctctttcatttcccttttttatggcattaaacttattggaaaaacaggactttgctttccaaccaagaataaatattgatgagtattataaaaagacagcatggcttcagtctcaattaggcttctctgatgagattaatatacagtctgaaatgcaaagttatctgaacaatataggtttatgtaataatggatatggagataatgacttgaccataatgttgaatcaggtaaatattcagcgattggtaaataaccctgtcatagttacaaaagacataatagaacgattgaaaaatgttctgggaacaataaattga

SEQ ID NO: 1029 - DNA, 1257 bp, B.fragilis
cttttatgtggtgtaacgagtgttttgatcccggtaggccggatacttattttgaagaagtttaatagcattatggaaatcaaactggattattcagatatcaagtttcggtatgatggcaagctgagactgttgattatagtcggtacccgtccggagattatccggttggctgccgtaataaataaatgccgtcgatattttgattgtattttggctcataccggacagaattatgattataatctgaacggagtcttttttcatgacctgagcttacaggctccggatgtctatatggatgctgtaggggatgatttgggttcgacaatgggtaatattttgaatgcgagctataaactgatgtcacacttacgccctgatgccgttttggttctcggtgataccaattcttgcctaagtgtaatcagcgctaaacgcttgcatattcctatttttcatatggaagccggtaaccgttgctttgatgagtgccttcctgaagagacaaaccggcgtattgtagacattatttctgatatgaatctttgctattcggagcatgccagacggtatctgaatgcttcgggtgtggcaaaggaacgtacttatgtaaccggttctccgatggccgaggttctgtctgagaacctttctgctatagaatcttcggatatccacgccagattgggtttgaggaaaggacaatatattctgctgtctgcacatcgggaagagaatattgatactgacaagaacttcgcttcattgtttgaaggcataaacgcgatggctgaaaagtatgacatgcctgtactttacagttgccatcctcgtagccgtaatcgcctggaatcaagtggatttaaactggatagccgggtgattcggcatgcccctctggggttccatgactataactgcttgcagatgcatgcttatgccgtggtcagtgatagcgggacattaccggaggaaagttcttttttcacttctgtcggtcactcttttccggctgtttgtattcgcacaagtaccgaacgtcccgaagctttggataagggatgttttattcttgcggggattgataaagcctctttgcttcaagctgtagatactgctgtggaaatgaataggaatggtgataatggtgtccctgttccggattatatggatcgaaatgtatcgacaaaggtggtgaagttgattcaaagttatacaggaatagtaaacaaaatcgtctggagaaaatcctga

SEQ ID NO: 1030 - DNA, 426 bp, B.fragilis
attgagtgtggtatggatatgcaggatgtgaaggtattggatttacctaagatattagataagcgtggtaatttatccattatacaagaagttgaaaatatcccttttaaaataaagcgtatatactggatttatgatgtaccggggggggaaagacgtggtggccatgcttataagaaaaatcaagaatttatagtagctctttctggtagttttgatgttgtattggatgatggaaattgtgagaaagttttttctttgaatcgctcttattatggaatttatgttcctcaaggtatatggagaaaaatgcaaaatttctctactaatgcactggcgttagtgttatcttctacaaattatgatccagatgattatattttggaatatatagattttgtgcaaagtaaaaagaattcattatga

SEQ ID NO: 1031 - DNA, 594 bp, B.fragilis
ttactcatgggaaacttaacagaaaatgattttcagcgtgtggcggatttacttggcattgaggtagcagtggtaaaagctgtacaggcagttgagaccagtgggcatgggggctttgtggctccggggcgaccgatgatcttattcgaaggtcacatcttttggcgtgaactcaagaagcggggactagatccggagaggtatgttgcgggcaatgaaaatattctttatcctaaatgggagaagggtcattattatggcgggatgaaagagtatgaacgtctggaaaaggcctggcaaatacataaagaagctgctgacgcttccacttcatggggaatgttccaagtgatgggctttaactatgcgatgtgcgggtatggcagtgtggaggaaatggtgaaagatatgtgtgtcggagaagataagcaactggaagcttttgcgaggtttgtgaaacttgctaagttgcagtcctatctggagcagaaagactgggtcgggtttgccaagaggtataatggacccggatatgcccggaatcagtatgataaaaaactggaaggggcttatcggaagtttacgaaggagtag

SEQ ID NO: 1032 - DNA, 501 bp, B.fragilis
ttcaaatttattatgactctttccgaagaagtagcttcccttcagcgtgccgcgcacgacctgatgtatttgggcatggacgggagtcccatttacagcgatgacttgtcccgccgcaacaatgaagtttaccgcttgaccacaacattgtataattccggtgtccaaggttccacggttgaagaacaggcctctgtctgtctcgctctcctaatgggttacaacgcatcgttcatcgaccacggagaaaagcgcgaacatgtccagaagatattagatcgttgctgggatatcctcgatactcttcccgcttcactattgaagcttcgtctgcttaccgcctgctatggtgaggtattcgacgagcctttggctgacgaagcccgttcaatcatcgcttcttgggattcggtgtcacttactactgaacagcaagaggctatcaacgagtttcagactgtggtggataacccttatccgtgggagtatgttgaagaataa

SEQ ID NO: 1033 - DNA, 891 bp, B.fragilis
gttttaattatgaaaggtattgttttggccggtggttccggcactcgcttatatccgattaccaaaggagtcagtaagcagttacttccgatattcgataaaccgatgatctattatcctatctctgtactcatgttggcagggattcgtgagatcttgattatctccactccttatgatttacccggctttcaacgtttgctgggtgacggttctgattatggagtgcgatttgaatatgcggaacaaccttctcctgatggtttagcacaagcttttattattggtgagaaatttatcggtgatgattcagtatgtttggttttgggtgataatattttttacggagatggattgattgaaatggttcaggctgctgtgaaaaaggctgatttagagaataaagctacagtttttggttattgggtgagtgatccaaaacgttatggggtagttgagtttgataaagaaggaagtgtgttaagtcttgaagaaaaaccacgtgatccaaaatcaaattatgcagttataggtctttacttttatcctaatgtagttattgagttagctaaaaatgttataccctcatctcgtggcgagttggagattacttcaattaatcaagaatttttatataagaaaatgttaacagtgcagctactaggacgtggctttgcttggctagatacaggtacacatgattctttggcagaagctagcacatttatcgaagtgattgagaaaagacaaggattgaagattgcttgtttagaggatatagcttttggacaaaggtggattactattgataaattgcgaaaactggcagaaaagatgaagaataatcagtatgggaaatacttgttgaaaattgtagaaggactgaattga

SEQ ID NO: 1034 - DNA, 798 bp, B.fragilis
aaatgtgttatggctaaactttacccgattgggatacagaactttgagaaaatacgtagggaaggctatctttatatagataagactgcattagtctgtagattggtaaaaacgggttcatattatttcctgagccgtccccgtcgctttggcaagagtctgctgatatctactcttgaagcttattttcaagggaaaaaggacttgtttcgtggtttggctatggaggagttggaaaaagattggataaaatatccgattttacatctggatctgaacaccgaaaagtatgatacgcccgaaagcctggatcgaatattgaacgatacgttggctaaatgggaaatggtgtacgggactgctccttctgaaacttctattcctttgcgtttcaagggtattgtacagcgtgcctgtgaacagtcggggcagcgggtggtgattttgattgatgaatatgataaaccgatgttgcaggctatcggtaatgaggagttgggagagaagtatcgtgatacactgaaaggtttttattctgtgctgaaaacgatggacgggtatatccgctttgcccttttgacgggagttaccaagtttggtaaggtaagtgtgtttagtgacctgaataatctgaacgatatctctatggacgaaccttatgtggagttgtgtggaattacagaaaaggaaatccatcattatctggaaccggaaattcgtcagttggcgaaatatcaaaagatgtcgtacgaagatgcttgccgtcttcaccacagggctggaaggatcctcgaatag

SEQ ID NO: 1035 - DNA, 888 bp, B.fragilis
ttatcatctatggaaaatgaagagactttcgctttcctatttggttctgttgtcgatacaagttctttttgttacttttgtgcatttcgaaaacataaaataacagataaggtagattgtatggaaaataaaagacctctgatcctcgtctccaatgacgacggcatcatggcaaaaggtattagtgaactgataaaattcctccgcccgctgggcgagatagtggtaatggccccggatgcccctcgttccggcagtggatgtgcattaacggtgacacagccggtgcactatcagttattaaagaaagatgtgggactgactgtttataaatgttccggtacaccgaccgactgcataaaactggcacggaatcagatactcgaccggaagccggacctggttgttggtggaatcaaccatggtgacaattccgctaccaatgtgcactattccggtacgatggggatcgtgatcgaaggttgtctcaatgggattccttctatcggtttctctatttgtgaccacgcccccggagctgattttgatgcagcaggaccttatgtccggagaatagctgcgatggtgcttgagaaaggacttccgccactgacttgcctcaatgtgaattttcctaatactcaggagataaaaggggtgagaatctgcgaacaggccaaaggacattggagcggagaatggcaggcttgcccccggagagacgatgcgaatttctattggttaaccggagaatttatcgatcatgaaccggaaaacgaaaagaatgatcactgggcactggctaatggatacgtagcgattacacctactgtagtggatatgaccgcttatcattttatggatgaactgaaatcctgggaattatga

SEQ ID NO: 1036 - DNA, 549 bp, B.fragilis
aataatcgtataatggaagtggaaaaagaaaccgaaatatggttcgctatgcgtgccacttatcgtcgagagactgacgctatgcggttgcttgcgaaagagaacttgggctgttttgttcctatgcaatataagataagtataaagaaagggaaaaaagtccgtgttttggttcctatcattcacaatctaatttttattcatgcttgtccttccgaagtgaagcgtgtcaagtctatggttgcttatttgcaatatatcaccgatacccgtagcggcaagaagatcattatccccgacaatgaaatgcagcgtttcattgctgtagccggtacttacagtgaccatcttttatactttcaacccgatgaactcaacttgtccaaaggaaccaaagtccgtattacaggtggtgacttcgagggccaagaaggtgttttcctgaaagtgaaaggtgcccgggatcgtcgcgtagtcattgctatacaaggtgtcatagccgttgccatggccactattcaccctgatcttatagaagtaatcaaataa

SEQ ID NO: 1037 - DNA, 2043 bp, B.fragilis
tctatcagtatggacaataacagcaagaaacccaacaataaagtaaatatgcccaagttcaatctgaactggatgtatatgattatcgccctaatgcttttagggctgtatttcgctaatggaagcagttctgtcagtaagaacatctcttacgatgagttccagcagtacgtacgtgacggctatgtaagtaaagtgatcggttatgatgataattcggtcgagatttatatcaaaccccagtacgtaggaaccgtattcaaacaagattccacccgtgtaggccggaatccgatgatcactacggaagccccttcacgcgagaacctggataactttctacaaaaagaaaaagaggagacgcactttgacggttctgtcagctatgataagaaaaaagactatttcagtgcaatactttggaatgtactgccgattgtcttcctgattgctttatggatattcttcatgcgacgcatgggcagtggtgccagcggaggtgcaggcggagtattcaatgtaggaaagtcgaaagcccagctttttgaaaaaggcggttccatcaaagtaactttcaaagatgtagccggactggcagaagccaaacaagaagtagaagaaattgtggaattcttgaaagaaccccagaaatatactgacctgggaggtaaaatccctaaaggcgctctattggtgggccctccgggaacaggtaaaacgttgcttgcgaaagctgtggccggtgaagccaatgtacctttcttctctttggccggttccgatttcgttgaaatgtttgtcggtgtaggtgcatcccgtgtacgcgacctcttcaaacaagctaaagagaaagctccttgtatcgttttcatcgacgagattgatgctgtaggacgtgctcgcggtaagaatcctgcaatgggcggaaatgatgaacgtgaaaatacgttgaaccagttgctgacggaaatggatggtttcggctcaaatagcggtgttattatcctggcagccaccaaccgtgtggatgtactagacaaggcattgctccgtgctggacgtttcgaccgacaaatccatgtagatttacctgatctgaacgaacgtaaagaagtatttggcgtacacttgcgccccatcaaaatagacgatacggtagatgtagacttactggcacgccagacacccggattttcgggtgcagacattgccaatgtatgtaatgaagctgctctgatcgccgcgcgtcacggaaagaaattcgtaggcaagcaagactttctggacgcagtagaccgtattatcggcggacttgaaaagaaaacaaagattactacggaagccgaacgtcggtctattgccctgcacgaggccggacacgccagcatttcctggttattggaatatgccaatccattgattaaggtaactatcgtcccccgcggacgggccttgggcgctgcctggtatctgccggaagaaagacagatcacgactaaagagcaaatgctcgacgagatgtgtgctactttgggcgggcgtgctgccgaagaccttttcatcggccgtgtatcaagcggagctgctaacgatcttgagcgcgtaaccaaacaggcgtatggcatgatcgcatatttgggtatgagtgaaaagctacccaatttatgctattataataatgatgagtattcattccagcgtccatatagtgaaaaaactgccgaactgattgacgaagaggtcaaaagaatggtaaacgaacagtatgaacgtgccaaacagattctctcggaacacaaagagcaacacaacgaattggcacagctactgatcgataaagaagtcatctttgctgaggatgtagaacgtatctttggaaaacgtccttgggcttctcgttcggaggaaatcatggcagctaataacaaacaagaaaacgccgttcatcctgcagatggagaagatgtagacacaactactccgcaagcaacagagtctcaagagggcaatacgcaacaagagtcagcggcatcacaaaactaa

SEQ ID NO: 1038 - DNA, 423 bp, B.fragilis
aaagaattcattatgacagtgtttgattgttcaataatagaatttcctaaaatagaggatcgttcaggaaatataactcctgtacatagtgaagagaatgtgccatttgatataaaacgtgttttttattcttatgacattcctggtggaggagctcgaggagcccatgctcataaagaatgccatcaatgtttaattgcagcaagtggaagttttgaagttgttttagacgacggtgttaatagaaagacagtacttttaaatcgtccatattacggcttacatattccgccaggtgtttgggcttccgaacaaggtttttcctctggtgcaatctgtttagtattagcttctcatgtatatgatgaaaatgattatgtgagaaattatcagaactttttaaataacaaagagatactatag

SEQ ID NO: 1039 - DNA, 597 bp, B.fragilis
tcagtaacaatcatgtttttatatggtgccagtggtcatgccaaagtgatcattgatattttacgagccggtcatgaatcgattgaagcgttgtttgatgataatgtggaggttacttctcttcttggtcatcccgtattacgtccgtcagaagtgcggggaccactgatcgtcagtattggaaataatcggatacggaagaggattgtggatactttgtccgtggagtttggatgtgctattcatcctttgtccattgtatctgaatttgctgatattggagaggggagtgtcgtgatgcaagggagtattatacaggtgtgtgctcaggtaggcagacattgcattattaatacgggtgcctctgtggatcatgaatgtgtcattgaggattatgtgcatatttctccacattccactctctgtggaaatgtattggtgggggagggtagctggattggcgccggtactaccattattcccggtgtgaagataggaaagtggagtgtgatcggtgctggttccgtggtgactaaggatattccggatcatgttttggcggtgggaaacaaatgtaaaattattaagagtatataa

SEQ ID NO: 1040 - DNA, 618 bp, B.fragilis
atcctcaaaataatagattgtacgctcagggtgaagatgattcgatttgggcttatgacgtttcctggcttagtaaatgaagtattgatgggaaagcttggaattcttagtctgatgttctgcaccattgttctattatcctgtggtaaaaagaaaaacgtatatccggaactagaagcttttatcggaaaagaaattatcttttccgataaaaactttaatacggttggtaataaggcttttaaagaccaatttttactgatatcttatgtcgattcgggtaattgtacaccttgtagtttggagaagatgcaatatatgaaaacaaataagcgtcggttgttggatacgcatacaggagttcttatgattgtgcatgaaaaagatacttttactgttaatgaggtgtttagacaaatgcatgtcagttatccgatattttttgattcattgggatgttttaaaaaagaaaatggtatttttgataatcctttatatcaagatttcgttatagaccgctcaaataaggtagtatggttgggaaaccctttacgtaataagcagtcatggcagcaatacgagaaagccatatctatgttaatggatagtggtaaatag

SEQ ID NO: 1041 - DNA, 897 bp, B.fragilis
gttatagaaatatatgttatattacttttaataaatatggtttcggtaataattcctttgtataataagtatttagcaattgggcgtactatagaatcagtaattgtgcaaacttataaagattgggaacttctgattattgacgatggttcgaatgacggcagtgggcaagtggctgagcaatatacttttgatgagcgtatccattatatttataagtcaaatggtggtgtatcgtcagcacgtaatatggggatacaaatggcgaaaggtgaatggctgctttatattgatgcggatgattatcttttacccaatgctttagagaccttattaaacttagcggaaaaatttgaagtaagtattgcggctagtaatttttatgttgagtttgaaggaaaaaagaggcgttgcctttacaatgtaagtgaaggggtcgtgttaaataactttcgttcacttttctttaattccttcgatatcagagcaggagctacactctataaatcatcattaattaaacagtataaatttgatgagactctaatacgttatgaagatgccaaattggaatttgacatattaagaaatcataaagtggcaataactcctcaatttactatggtatatactaaggattatgctggtttaagtaaaccagcaagtgacttttcaaaggattatatatcatgtatgtcttttgaaggaaaaccgttttgggaaaaaatgaagcttggttctttagctaattatggtttagatatctaccctaataatcgaagtgaaattaaagctatatattcaaatgacctcaaatggatatatcttagcgctaaaattggcttttttgtatacttatttaataaatgttgtaacctattgcataagttgaagtag

SEQ ID NO: 1042 - DNA, 1497 bp, B.fragilis
cctgtagaaattgatttaaaacctataaataattcatttatgagcacaattcttgatttagctccacaaaatgtatggaagcacttttattctttgacacagattccccggccatcgggacatatggaaaaaattaccgaatttctggtaaacttcggtaatagtcttggattgaaaacttttgtggatgatgccggtaatgtgattatccgtaaacccgccactccggggatggagaatcgtaaaggagttatccttcaggcacatatggatatggttccgcagaaaaataacgatacagttcacgattttgagaaagatccgatcgaaacttatatagatggtgaatgggtaaaagcgaaaggtactacattgggggccgataatggtttgggtgtagctgctatcatggctgttcttgaagatcagaatctaaaacacgggccattggaggctttgattacgaaagatgaagaaacgggtatgtatggtgcttttggcttaaaaccgggtacggtgaatggcgaaatattgcttaatcttgattctgaagatgaaggtgaactttatattggctgtgccggtggtatggatgtaactgcttctcttgaatataaggaagttgctccggaagaaggtgatatcgctattagagtgaatctgaaaggtcttcgtggaggacattccggattggagattaatcagggacgtgccaatgccaacaaattgttggtacgttttatacgtgaggcagtagcaacttatgaagcccgcctggcaagctgggaaggcggaaatatgcggaatgccatacctcgcgaggcacatgctgtagtgactattcctgctgaaaatgaagaagaattgttggctttggtgaaatattgtgaagatcttttcaatgaagagttcaaagcgatcgaaactcctatctgctttactgcagaacgggtagaattacctgctggagaagttcctgaagaaatccaggataatctgatcgatgctatttttgcttgccagaatggtgtgatgcgtatgattcctactattcccgataccgtggaaacctcttcaaatttagctatcatcaatattggtgaaggtaaagcctctttcaaaatccttgcgcgcagttccagtgacagtatgaaggaatgtctgactaccagtttggaatgctgtttttctatggcaggtatgaaggtagagatgaccggaggctattccggatggcaacccgatattaattctccgattttacatgctatgaaggaatcttacaagaagcagtttggtacagaaccggcagtgaaagtaattcatgccggattggaatgtggcatcatcggagctattattcctgggttggatatgatttcatttgggccaacactacgctctccgcattctcccgacgaaagggctttgattccgacagttcaaaaattctatgactttttaattgctactttggagcagactccaatgaaataa

SEQ ID NO: 1043 - DNA, 5784 bp, B.fragilis
tatatgagaattaaactgatttgtattatcgtgttactttctatggggatgatgtcatggacgcatgctcaatcatacgatagattatggaagcaagtggagcaggcccagcagaaaagtttgccccaaacagttgtccgattaaccggtgaaatttatcaaaaagctaaagcagagaagaattctcctcaaatgctgaaagcttatatttggcagatgaaatttagggaagagattactccggatagcttttacgtgtcgttgaatggcttagagcagtgggcggtgactacggacaagccattggaccgtgcaatcctgcattcgctcatcggtagtatgtatgctgattatgcttcccaaaaccgttggaaactgaatcaacgtacggatttggaagaagaagctccctctgttgatatccgggagtggagtaagaatcagtttgtaactaaagtaatgacagaaatagccgtaacatttcaagactctttgctactgctcgatacttcctcccgaagctacattccttttgtggaacttggagtaaccagtgattactatcatcatgatatgtatcatttgttggcttcccgtgccattacttcactggagaatctatccggatttggccatgattctttaataaatgtacgcattgaagaaatttatcagcatatgatgaattcatatcatcggactgataatcacgatgctctgttgcttactactttggattatttgcagtggaagaggcgtactgatatcgattttcggccttatcgtgctccggaggggaaacttggcttgacacaggatccttatttggctgcactggacaaactgattgccgaaaataagtcacatgatgtctgtgcagaagtttatttgctcaaggcacaggcggcaatggatgcaggagtgcccgcttctgcgttacaattgtgcgaagaggctatctctcgctatccggactatcgccgcatcaatgctctgaaagaactgaagcaagaaattctgcgtcccgatctgacagtacaatccccgtcaacagtttatccgggtgaggagtttgatttaaaagtcagctttaaaaatttgaaagactttacggtagagttgtatgcaattaatttaccggcacgtccgaatacggtggaagcacccaatgacgcatttctaaaaaaacatggacgtttactttcatcggaacattatgttctcttcccgtcggatgactataaagtgaaagattccatctaccacataaaggcacctgaaacaggactgtacgccctccgtgttattccgggtgttaaggttcgttccaatgtttcaaaatttctctattctacttgctttaaagttcttacccgatctctaccttctaatctgagtgaggtagctattctcgatgctatgagtggcaagcctttgcagggtgttgttctttcattcttcgatcgacagaacaaacaacttctgacagccactaccaataccgaagggaaagtacagtttgcttcgtcggaaaaatataggtatctgactgctgccaaagggaatgatacagctatgccgcagatgtatttatggggaggagattataattttgcagaccattcaaaacctgtttctgtggtaactttgcttaccgaccgttctgtttatcgtccggggcagactgtctatgtaaaaggcattgcctatgaacagtatcctgactctgcccatgtgattgcgggacaggaatatacgctgactctttcggatgccaatgggcaagaaatcagtgcaaagaagctgcgtaccaatgattttggatctttcaccgcagaatttattttaccgtctgtttgtttgaacggtactttcagtttgaatactcaaaacggatttcgttccattcgtgtagaggattacaaacgtcctacatttgatattacttttgagccggtgactgaaagttatcgattgggagatcgtgtcgagttgaaagggagtgtaaaaactttcagtggtgtgccgttacaggatattcctgttacttataccattacccgctcattgtatacttggcggatgtgggggatgaatccggttattttggcctctgacactgtccgtttgggagtagatggaaacttcgaaattcctgtggatctgaaaccagacacttcgaatcccgatttgggagacggtgataatacctctttatattatgactataaagtgcagctttcagtaaccaatgtcgcaggtgaaacgcaaacctcagaaacaagtctgcgggcaggaaagacctctttgttattgtttgctgatatatccggactgatttgcaaggatgattctatgaaagcgacttttcgggtaaataatctggatcgtaaaccggtcagtgtcgaaggcagttaccggttgtttttgatttccgattatcagaaatcaaaacccttgaaagaacaggacgtttccgatcaaccggctctttccggttcgtttaggtccaatgaagagatcttgttgtccgattggaaaaaacttccttcaggtgcttacaaacttgtagcttcggtgaaagatgatcaaggccgtaaggtagatgcggaaaaggtagtgattctttttgcttccgatgataagcgtcctccggtatctatgcctttgtggtgttatgaagtgaatacccggtttgatgcagcacatcctgcgctgttctattttggtacttccgaaaaagatacttatgtcttaatggatgtgttctgtggtaataagcatctggagagtaagcttcttcatttgtccgattctcttgttcgttttgaatatccgtatcgggaagcctacgggaatggtttgggtattacctttgtatttgttcgtaaaggtgttgtctacgaacaggaggtaagcctgataaaacgtttgcccgatcataacttgaatatgcgttgggatgtattccgtgataaattacgtcccgggcaggaagaggaatggaaactgactatccgtaatccacagaaatcacctgttttggccgaaatgctggctactatgtatgatgcctctttggataaaatttggaagaccaaccagtcattgcaattacattatcaactttctgtccccattgctcgttggaggagagattatgttggctcaaactatttttattttggtttccgccggactgatttgaaggtgcctccgtttagctatgatcattttgacttgcctccggttttatatgcggttgccgaaatgttgtcggtcaccaatgatgctgctccgactacccgatatgcacgtctgcgcggaatgggtgctgcaaaaccacaaatgaagagcgctgccgtagccgatgtcgttttcgaatctgaaatggttcctgttacggaagagagcggaatggcaatgtcaatggacaatgccgatatgggtaggacaacagatatagagttacgtaccgactttgcggaaactgccttcttttattcgcagcttcacacgaacgttcagggtgaggtcagtttctctttccgtatgcctcaaagtctcacgacctggaatttccgaggatatgctcatacacaagatatgatgacagggcagatggatgctactgctgttaccagtaaagagtttatgcttactccgaatctacctcggtttgtccgggtaggagatcacacttccatggctgcttctgttagtaatctgaccggtaaaaatctgtctggtactgtgaaactggtacttttcgatccaatgacagatcaggtaatatcgacccaacagaagaaatttaatgccggagccggacagagtgtcggcgtaagtttcttgttcacagtaactgataaatatgaaattttgggatgccggatgattgccgaaggaggaaatttcagtgatggagagcagcatttgcttccggttctcagtgataaggagaacttgacagagactttgcccatgcctgttcgtggcgagcaaacacgtactttttctttggccgatctgttcaatcaccatagtaagacagcgaccaaccgccgtttaactgtagagtttacttccaatccggcttggtatgcagtgcaagcattaccggcactatcacaacctcggaatgatgatgctatttcgtgggctacttcctggtatgccaatacaatggcttcttatatcatgaatgctcagccacgtattcaggcaatatttgatagttggaaactccagggaggcactaaagaaagcttcttgagtaatttgcaaaaaaatcaggaagtgaagaatatccttctttctgaatctccttgggtgatggaagcgacttcggaaagcgaacaaaaagagcgtattgccactttattcgatttgaataatatccgtaacagtaatacagcagctttgttgaaattaaaggaactccagttacctgatggttcgtggagctggtataaaggaatggacggaagtctttttgtcaccgacttcattgtagaacagaatgcacgtatagccctgcttacagggaagccgctggagggaggagcgctggatatgcaacaagtagctttcggttatctccataaagaagccttgcaggaatatcgttctatccgtgaggcagaaaaggttggcaataaatcagagggaatttcacgaagtgcattgaagtatctctatttgattgctgtctctggcgagaaagttccggcatcggcgaaagaaggttatgattacttcctatccaaagttgctccatcattgtctcaacaatccgtcaccgagaaggcctggtcggctattgtattacagaaggcaggtaaggtaaaagaagctcaggagtttatggcatctctcaaagaatatcttactcaaacagacgagcaaggcatgttctttgataggactgatagtccgtatgcttggaataatttaaaagtgcctgcccatgttgatgtaatggaggcttttgagatggtaggcagcaatgccacgattgttgaagaaatgaaaatgtggcttttaaaacagaagcaaactcaacagtgggactctccggtagccacagccgatgctgtttatgctttgctttaccggggtactaatttattggataatcagggagacgtgcgtattgtccttggcaatgaagttttagaaacgataagtcctgccaagacgactgttccgggattaggctatatcaaaaagacttttaccgataagaagaccgtgaataccgatgagattatcgttgaaaagagagatccgggtattgcctggggagcagtttatgcacagttcgaagagaatcttgataaagtggtccgccagggaagtgggttgaatgttgataagaaattgtatgtagagacgattgttaataataatcgccggttacagccggttatcggtaaaactcaattaaaggttggtgataaagtagttgttcgtctgaccgttcgtctcgatcgtacaatggactttgtacaattgaaagatcaacgtgctgcttgtcttgaaccggtagaggtcctgtccggatatcgtaatgtcggtgatgtcggttgttatgttgcagtaaaagatgcttctaccgatttcttcttcgatactttgaataaggggacttatgttttagaatacagttatcgtgtagatcgtgcgggaagttatgaagcaggaattgctactattcaaagtgcctatgcacccgaatatgctgcccattcagcttctgcccgttacgaagtttctcagtaa

SEQ ID NO: 1044 - DNA, 1089 bp, B.fragilis
caccgggtgatattgttttcttcaaatgatagctgtgtaattgtgattgtttatatatttttgatatttgtctctacagtcatatttatttcgcatatatatgttaaaagcgagaaagtaaataagataactgcattcttatgggtaattatgatgactttgtttgtggggtctcaagatggtataggaaatgaccatgctaattatattgctcagataaaatccccatgggccactcctcaggaaccatttacattatttatattctatataattagatcttgtgatttatctgtttatgtatttttctatatctatgcttttcttacttattattttttgtataaagtgatattattatcagataagagtattcgatttattattgtaatgatgatacttcaatctctattattttttcaatcgtttaatttgattcgccaaattttggcttgcgcaatatttttgtatggaatatctcttatattaaataataaaaaaggatattggtttctattattagcatgtttggtgcattattctgcattttttggactacttatagtttggatagcctcaaaaataagagtaagtactgttatgcttattgtttatataatgtctgtagctcttttatatacaggtggttttattggagattttatatcaaaatatgaatttttgatacgtatgacttactatggctactatttagactcctctcttattaatgatgatgtagcagcaaattttggtgttgtatataagattacctttattttatgcttagtcgtttataccaaaagaaaatttttcaaatcgaacggtcaaattttactcttcaaccttttttttgttggtcaaatattatacaatttatcatccgcaaatattacgattcaacgtgctacttattttccttatttctctatgatattagtaatccctttattggccaaatgtttttctccatattggaattctaggttagctttagtactgtattcattatattttctttttataagtgcttcgttggcttctcaagactgtccatacgtaccttataaaaatataatatggaattaa

SEQ ID NO: 1045 - DNA, 846 bp, B.fragilis
cgcgcggcgatcagagcagcttcattacatacattggcaatgtctgcacccgaaaatccgggtgtctggcgtgccagtaagtctacatctaccgtatcgtctattttgatggggcgcaagtgtacgccaaatacttctttacgttcgttcagatcaggtaaatctacatggatttgtcggtcgaaacgtccagcacggagcaatgccttgtctagtacatccacacggttggtggctgccaggataataacaccgctatttgagccgaaaccatccatttccgtcagcaactggttcaacgtattttcacgttcatcatttccgcccattgcaggattcttaccgcgagcacgtcctacagcatcaatctcgtcgatgaaaacgatacaaggagctttctctttagcttgtttgaagaggtcgcgtacacgggatgcacctacaccgacaaacatttcaacgaaatcggaaccggccaaagagaagaaaggtacattggcttcaccggccacagctttcgcaagcaacgttttacctgttcccggagggcccaccaatagagcgcctttagggattttacctcccaggtcagtatatttctggggttctttcaagaattccacaatttcttctacttcttgtttggcttctgccagtccggctacatctttgaaagttactttgatggaaccgcctttttcaaaaagctgggctttcgactttcctacattgaatactccgcctgcacctccgctggcaccactgcccatgcgtcgcatgaagaatatccataaagcaatcaggaagacaatcggcagtacattccaaagtattgcactgaaatag

SEQ ID NO: 1046 - DNA, 1323 bp, B.fragilis
cccatgaagattgaacaaataagaatgaagaaattagcaaactattgccccctgattttattatttttgtttgccacacccaaggtaaacgcacagagtgtagacgtagtgattcgcgacaacggcaaagaacgccaagagagcatcgaacttcccaaaagtatgacttatcctctcgatagcctgctcaacgactggaaagccaagaattatatcgacttaggaaaagactgcagtacagcggagattaacccgctgttcagcgactccgtatacatcgaccgcctatcacgcatgccaactgttatggagatgccatacaacgaaattgtacgtaaatttattgatatgtatgccggacgcctgcggaatcaagtctcttttatgttgagtgcctgcaacttctatatgcctatctttgaggaggccctcgatgcgtataatttaccattggaattgaaatatctgcctattatcgaatcggccttgaacccgtcggcagtatcgcgcgccggtgcaggaggcttgtggcagttcatgatcggaaccggcaaaatgtacggtctggagtcaaacagcctggtggacgaccgtcgtgacccgataaaagcaacctgggcagcagcacgctacctgaaggatctatatgacatttatcatgactggaatcttgtgattgcggcttacaactgcggaccgggcactatcaacaaagccatccgccgctcgggaggagaaaccgactattggagtatttataattatctgcccaaagaaacaagaggttacgtaccggcatttatcgccgcgaactatgtaatgacctattactgtgatcacaacatctgcccgatggaaaccaatattcccgaaagcactgatacgattcaagttaacaaaaacctccatttccagcagatcgccgacttatgcaacgtcccaatggaccaaatcagaagtctcaatccacaatataaaaaagaaatcataccgggcgaaagcaagtcgtacacactgcgccttccacaaaacgcggtcagttcgttcatcgaccgtcaggatacgatttatgcccaccgtgccggcgaactgttcaagaatcggcgtacagtggccatcagggacgacagttcagcctccaagaggagaggtagctctgccaaagccggcagtggtacacccacttactataaaatcaaaaacggggataccctgggagccattgcggcaaaatatggtgttcgcgtaaaagatcttcaaaactggaacggattgcggggaactaacatttccgcaggaaaacgtttgaaaatatacaaataa

SEQ ID NO: 1047 - DNA, 1140 bp, B.fragilis
ctaatacatgttagaatgatggttttaaaaaataaatggaagaataggtttattttaatccttttcatggtcggatttgttttttttgcttgtaaagaagagacggatctttactttaatggtgatataacagttatcaaatcgtttgataacgatactttgttgtctccggtaaaagtagagcttgaagatatttatgacggttcagtattagcgtatgactcattattgttttttacttcgcataaatatagtgattgctggatgtatgtatttagtgtgaatagtggcaaacatatcgcttctttatgtcccaaagggcaagggccaaatgactatttatcctgtaaaaactctcagcagtttataagggagaatggcgaattgaagttatgggtcagagataatgccaaatcagctagattattgaatattacaaagtctatagagacaggagctactgtttgcgatgctattattcccatggattggaataaatatttcgtttacccggctactaccctgttctttttgaaagatggatatatattagggcaaaatcagtgtgaggaacagtattccaaaggtaaagaatatattccgcgcaaattttatttatataaagattctttggggaataaagtgaaggaatataagttgttcaaccgaccggttattttgaaggatgataaatatgatgttctgagtggcatgttttacgctaatcatagttatatacatccggatcagactaaagtggccattgccatgcagcgggttgcccagatcaccatattagatgtaaagtcaggaaaacaagtagggtacaggatggatgatacgcttgacttcagtgatatagaacaaaatcttgagtgcatacgctattattatacaagtgcggctgtgaattcacgatatatatttgccctttatattgatcaggcagaaatgggaggtaagtatccttttaaatcaaagactgtccatgtcttcgattgggaagggcggcccgtatataagatacagttggataaggagatctcttggatcactttagatcctcaaaataatagattgtacgctcagggtgaagatgattcgatttgggcttatgacgtttcctggcttagtaaatga

SEQ ID NO: 1048 - DNA, 819 bp, B.fragilis
atgaaattagtaaagcctaaaaagtttctcggacaacatttcctgaaagacctgaaagtggcacaggacattgccgatacagtagatacattccccgatttgccaattttggaagtcggaccgggaatgggtgtgctcactcagtttcttgttaagaaagaacggttggtaaaagttgtagaggtagactacgaatcagtagcctatttgcgagaagcctatccgtcattggaagataacatcatcgaggatgacttcctgaaaatgaacttacaacgtttgttcgacggacatcctttcgtcttaactggaaactacccttacaacatatccagccaaattttcttcaaaatgctggataacaaggatctgatcccctgctgtactggaatgattcaaaaagaagtagccgaacgcatcgccgccggaccgggtagtaaaacgtatggtatactcagcgttctgatacaggcctggtatcgggtagaatatctgtttacagtaaatgaacaggtgttcaatccacctcccaaagtgaaaagcgcagtcatacgaatgacacgcaacgagacacaagagctcggttgtgaccccaagctatttaaacaaattgtaaaaacaactttcaaccagcgtcgaaagacattacgaaattcaatcaaaccgattttaggtaaagattgcccgttgacagaagacgccctgtttaataaacgaccggaacaactatcggtacaagagtttatccacctgacaaatcaggtggaacaagcactaaaagttccgatagaaccagtttctcagatagaaaatccataa

SEQ ID NO: 1049 - DNA, 1416 bp, B.fragilis
actaacaaagtaggaaatgtaatatacaaaacttgtcttccttattattacaggaagttaagtaaggctgtaattatgaacgaagaatacattgacaacgtaaaagaacttatcgaagaaaaagatgccgataaggtaaaagagcttcttatcgacctacaccctgctgacatagcggaattgtgtaacgagttgaacccggaagaagcccgcttcgtctaccgattacttgataatgaaacagctgcggatgtacttgtcgaaatggatgaagacgttcgtaaagagtttctcgacatcctgccatcagaaactattgccaaacgcttcgttgactatatggatacggacgacgcagtagacctgatgcgtgaactggatgaggataaacaggaagaaatactttcgcacattgaagacatcgagcaggcaggagacattgtcgacctgctgaagtatgatgaaaatactgccggtggtttgatgggtacggaaatggtaaccgtcaacgaaaactggagtatgcccgaatgtctgaaagagatgcgccaacaagccgaagaactcgacgatatctactatgtatatgtaatagatgatgatgaacgccttcgcggaatatttccactgaaaaagatgatcacatctccctctgtatctaaagtaaaacatgtaatgcagaaggatcctatctcagtacacgtagacacccctatcgatgaagtggcacaaattattgagaaatatgacttggttgccattcctgttcttgacagtataggccgactagtaggacaaatcaccgtagatgacgtcatggacgaagttcgtgaacaatcagaacgtgactaccagttagcatccggtctttctcaagatgtagaaacagacgataatgtactccgccagactactgcccgcttaccttggttgttaatcggtatgattggaggtattggcaactctatgatattggggaactttgattccacttttgccgcgcatcccgaaatggccctttacattccattgattggtggtacaggcggaaacgtagggactcaatcgtcagctctcgtcgtacaaggcttggccaacagttcccttgacgccaaaaatactttcaagcaagtcagcaaagaagccgtagttgccttgatcaatgctacgatcatctctttactggtatatacctataattttatccgtttcggagcaaccgccacagtcacttattcggtatctatcagtctgttctcagtagtgatgtttgcctccatcttcggtactttggttccaatgacactcgaaaagatgaaaatagatccggccatagctacaggaccgtttattgccattacgaacgatatcatcggcatgatgatgtatatggggattacggtgttattatcgtaa

SEQ ID NO: 1050 - DNA, 1104 bp, B.fragilis
aatatggaagtaagagtttggaattatttaaaagagtatgcatcttctaaagaagaaatactaaaggctgtagaagatgtttttgaatcaggacaactcattcttggtgcaaaaggaaaacactttgaacaggcgtacgctgaatattgtggtgttagtcatggtgttggttgtgataatggtactaatgctataagtttggcattacttgctgttggtgtgaagcctggtgatgaggtaattactgtgcccaatacggccattcctactgtttcggctatagtaactgtcggggctacgcctgtttttgtagatattgatcctcttacttatttaatggatgtgacaaaggtggaaagccatattacggaaaagacaaaatgtattcttccagttcatctttacggacagtgtgtcgatatggatgaacttatagctttggcctggaaatataaattatccattattgaagactgtgcgcaagctcaaggtgcagaatataaagggtataaggcaggttcaatgtctaatgcttctacaacctcattctatcctacgaaaatattaggtgcttacggtgatggtggaatgattattaccaatgatgcagaggtggaagggaaattgcgtcgtttgcgattttatggtgcagagaagatgtattatgctatcgaacatggttataattctcgtttggatgaagttcaagctgccatccttttgacaaaattgcctcatttggatcaatatatcaaacgtagaagagaaatagcgtatttgtataatgaattgctgaaagataccaatttaatattgccaaaagaagcagattacggtaaacatgcttattatttgtatgtagttcgtcattctaatcgtgatgaaatcatggcagcattaaaagaaaataatatatttgtaaatattagttatccatggcccattcataccatgacaggttaccagttccttggttataaggaaggtgacttccctgaaacagaatctgctgcaaaagaaatattttctttgccgatgtatcctacattaacggatgaagaagttcattacgtgtctgatatattacacaaaatattaaaatag

SEQ ID NO: 1051 - DNA, 1140 bp, B.fragilis
aaacccctatttttgtactctaaacaactaataattataaaacagagacgaatgaaacgtagtttactcttcatatttactttacttactattactttatcggctgtagctcaacctcgtatctcttctaataaggagacccatcatttcggacaaatcgaatggaaacgtccggtttctgtagaatatactattaccaatacaggtgataaacctttggtactgactaatgttaccacttcttgtgcctgttcggttgctaactggacgaaaactccgattgctcccggagaaaaaggaacagttagtgctacgtttgatgctaaagcgctagggcatttcaataagtcaatcggcatttacagcaatgcacagcctagtttggtttatctgaattttgacggggaggtggttcaggaaatcaaggactttactaaaacacatccttatgcaatcgggcaaatccggattgatcgtacagatattgattttccggatgcacacagtggagagaaaccggtaatcacattaggagtagtcaatctttccgatcgtccatacgaacctgtattgatgcaccttccgccttatctgaaaatggaaactaatccgaccgtccttttaaagggtaagaaaggaaccattactctcacactcgacaccaaacaactaatggatttgggcttgacccagtcttctgtttatctggctcgttttgctggtgataaagtgggtgaagagaacgaaatacctgtgtcagcagtccttcttccggacttttcaggaatgaccgaacaggataaggcggtcgctcctgttattcgcctgtccgaatctaagattgatttaagtcaggtgctggccaagaaaaacaaagccagacgagacattgttatcactaatacaggtaaatctcctctgcaaattagcaaactgcaagtgtttaatccggcagtgggggttgctttgaaaaaaactgtactgcaaccgggtgaaagtactcggctgagggtgactgttctgaaaaagaaccttggaaagaaaaagagacatttacgtatcctgatgatcaccaatgatccggtgcaaccgaaagtggagatcgatgtaaaagctacgaataacgaatcacataattaa

SEQ ID NO: 1052 - DNA, 1209 bp, B.fragilis
ctaaggatattccggatcatgttttggcggtgggaaacaaatgtaaaattattaagagtatataaaattatattattgatgaacaaacgaatctggctttcgcttgctcacatgggtggccgtgagcaagactttataaaagaggcttttgatacgaactgggttgtccctttgggacctaacgtggatgcctttgagcaatctttggttgaatatttgcatgaagaccgctatgtagtggctttgagtgccggaacggctgcacttcacttgggcttgattcttctggatgtgaagcccggtgatgaagtgatctgccaaagctttacttttgctgcctctgccaatccgatttcttatctggaggccaaacctgtttttgtggacagtgagaaggatacctggaatatggatccggtattgctcgaggaggctataaaggaccgtttacgcaagacgggcaggttgccgaaagcgatcattcccgttcacctttacggtatgcctgccaagatggacgagatcatggatattgcgggtcgttatggtatctccgtattggaggatgccgcggaggctttgggttcggaactgaacggacggaagtgtggcacattcggtgaactggccgctctctctttcaatggcaacaagatgatcacgacttccgggggaggtgctctgatctgtcgtacggaagaggaggcccgacagacaaagttctacgctacgcaggctcgtgatgccgctccgcattaccagcatacccatatcggttacaactatcggatgagtaatatttgtgcgggtatcggtcgtgggcagatgtttgtcctcgatgaacatattgcccgtcgccgtgccattcactctttgtatgttgatttgctgaaagatgtggcgggtattacggtcatggagaaccctgattcgcggtttgcttccaacttttggcttacttgtattctggttgatccgaagcttgcgggtaagagtcgtgaggatatccgtttgaggctggactccgagaacatagagacgcgtcctctgtggaagccgatgcatcttcagcctgtgttcacggatgctccgttctatgggaatggtacgagtgagaggttgttcgatatcggcttgtgtctgccttcgggacctacattgacagatgaggatatcaggagagtggtggatacgatcagagcgatataa

SEQ ID NO: 1053 - DNA, 840 bp, B.fragilis
atgcaaccatttatggaactatcagccaattatatcaaacgaattgaaatagacggattatgggaccgtttcaatatagtctgggaccttcgtccggatgtcaatatactatccggaatcaatggagttggaaaaaccactatcctgaatcgatcggtcgggtatctcgagcaactgtcgggtgaagtgaagagtgatgaaaaaaacggagtacatatctttttcgacaatcccgaagctacttacattccttatgatgttatccgtagttacgatcgtccgcttattatgggggatttcacagcccgtatggcagataagaatgtaaagtccgaactcgactggcaactctatctgttgcagcgccgttatctggattatcaagtcaatataggcaataagatgattgagctgttgagcagcaataacgaggaagaacgtagcaaagcagccactctttccattgctaaacgtcgttttcaagacatggttgacgaactattcagctatacccgtaaaaaaatagaccgtagacgcaatgatattgctttctatcaggatggtgaacttctgtttccttataaactttcttccggcgaaaagcagatgttagttattctgcttactgtacttgtacaggataatgcccattgcgtattgttcatggacgagcccgaagcttctttgcatatcgaatggcagcaaaagctgatatcgatgatccgtgaactgaatccgaatgtgcagattatactaacgacacattctcctgcagtgatcatggaaggatggctcgatgctgtgaccgaagtaagtgatattgcaaccagctataagtag

SEQ ID NO: 1054 - DNA, 303 bp, B.fragilis
gtatcacattctcaggaaataaaaaagagagtatccttttctggacaccctcttccctacgcatctgcgtcacatactttactattgtttgatttcccatattatacccgtttaggtacaaatacaataaaagactcccacttttatacccgatatggtataaaagtgggagcaagtcaggaatctatacccatttgggtatattgttactcattctatctgattacatctatgactttcctgatattttcattagaacctactttctcctatctattacatttcttttctactccttcgtaa

SEQ ID NO: 1055 - DNA, 234 bp, B.fragilis
  unsure (92): Identity of nucleotide sequences at the above locations are unknown.
gaaagccggaagtgcaacggtcaaacagttcgggaatcaaagggtacctatcttacggaggaatatgtatgggaaaataagttggacatcgngcgtacggcatggcagtatgatccgtatacgcacgaatgggtagacatgcctttggtatcgaaaggcaaaaaacaatctgaagaacttccagagcctgagtatggtgacaaacaacaatgtaagtgtctctcagaaaggtaa

SEQ ID NO: 1056 - DNA, 1560 bp, B.fragilis
acatgcctttggtatcgaaaggcaaaaaacaatctgaagaacttccagagcctgagtatggtgacaaacaacaatgtaagtgtctctcagaaaggtaaatatggaagtgtacgcacttcattgacccatgtgtataataaaggacagtatccgaaccagaaactgaataagatcacttattcggtgtcgggtgatatgaagtggaagaaattctcttttgacggaggattgacttataataagcgcttttatcccaatgacatgggagccggatacggtggtagcggattcctttataacctgttggtgtggtcgggtgccgaatatgatatacgcgactataagaactactggatcaagcaggacgaacagcagaactggatggataccaagtggtatgacaacccttatttcatagcaaatgaaattgtccgttcgagtgattacgatttgattaacggatatctttctgccaactatgattttactccctggttgaacctgtcgctgcgttcgggtctggattcatactcgcagaagaaagagtggcggaatgccgtcagtgccgtaggtggctggcataaacaaggttattatgggctgcaacgtttaggaggatacagcttaaacaatgacctgattttgtctgccgatcacaaattcggtgattttaatgtcgatggttttattggtggaaacgtttattattggaagagtgacaatatcctgggcgaaacgcagaatgggttgaaaattccggggtattattcattgaagtcatcgattgatccggtgaagacaaccagcggtattaccaaaaaactggtgaccagtgtatatgccaaagcctctgtttcctggaaaagtacactgtttctggatgtgacaggacgtaatgactggtcttcttcattgccgtcggagacacgttcttatttctatccttctgtagccggtagtgtggttctttcacagttcatcccaatgcccgaagtgattgacttctggaaagtgaggggggcatggacgcagaccaagagtgacttgggagtatacgataccaacaatacttacagtgtttctaccgatttgtggaacggtgagagcgccgcatattatccgacatctatccgtggtgtagcggtgaaaccctcggccacgcgttcttatgaaatcggtacggcaattcacatgtttaagaatcgcctgaaactggattttacatattataataaactctattacaacttgacccgcagtgcaggtatcagtaactcttccggatttacgtctacattgatcaatatcgatgaagaatatgtgggacggggagtagagttgactttatcgggcgatattatcaggacgagagacctgaaatgggagtcgtccttcaactggtcgcgtgaccgttggtattataccaaaatagacccggtgtattctacacaaaaaccttgggtagccgtcgggaaacgttgggactggtacggtatttacgattgggagcgtgattcacagggaagtcttcaccacgggggtggaaggagcaacgtctga

SEQ ID NO: 1057 - DNA, 825 bp, B.fragilis
cagacacgatttgccacagaacgtatatgtggggcgactgggcccttccccgatcccgacagggctgggccaaatatcccgttttcaatccggcggaccccgttccggcatccggtatcggtcggctattccaacatatactccttttgcagggactttgtcagcacgccccgtttcctgggggctttcccgtggctggaactggcgggcaccatcgcccccttgctggcagcctataatgccaacgcgtcggcactgagcctgcatatagagagcccgcaggcctattgggacgcggcagaggacaggatcagggaaatatgcaagcgtaagggggtgccttattcggccagaatgctcgaggaattcaaggatgaagccatggagaagttcgcttcaggagtgaccggcagggagaatgtgggcaaatacatgcacacgaccaggttctgggatgcggacgccaatgacttccagggctggacgataacccccatcgacaagaaaataagggattatatcgaaagccagatcaagatcgccaacaaggccgatgccgcggccacatccgggttcggactggatccggtgctctcaaacctgatcatggataacaagctgtcctcagggtcggaaaaactgtactccatcaaggtgtacaatgccagtgagacggccataccggacatgatcctgtgcaaaccgttgatgcactacatacgggccaattatccgggaagcagaacacaggtggggctttaccggagcgtagtggaatccgaacagagtgtatcacccgcaaacaggatgaaagaaaatatataa

SEQ ID NO: 1058 - DNA, 477 bp, B.fragilis
attcgaaacgccatgaacgaggatctgataaaacaagagtttgtccgggagaatatcgaaagggatatccgggccattttcgaggcgcaatacctgatcgccaccgaaagggtgtatacctctgccatctatccgactcaggtcggacaggggcggagccttgtccgggaacaggggtatggacgcctggtgcggggtactaccggccggctgctcagcgccttacacaaccccgtttacagcgtcgggttttccgggcggggggtggtcgccacttccaacatccccctctatatccgcttcctggatatgaagaaacatggaaactatggcatctataaccgccaggtatggggaatcctctggaacaattcgctccagaccataaaatacggatatggcaaggaggtccgcgaccgtatttatgccggattacaggaagctttccaaagaatggaaatacgtacggattcctaa

SEQ ID NO: 1059 - DNA, 456 bp, B.fragilis
aactgttcagctatggtagatttacagcaatatgaagagtattggtcgggtataacggagaggattccgcaaataaagaaggtggtgcctgtcaccttcgaccccgacatgggcgctttggtccaagggcttaaagcggacgaactaccggcgctgctactcatcatcccaagcgccaaaggaaaatccccggatgtggacaacctgttggaattaaacctttgcgtagcgttcctgatggacaagaccgatccgcagcgtaaggggacttatcaggtgttaaaggagttgcagcccgtcatggagaagatgaaagcgcagatgatcgatgacaaggctgcgggatgtcacctgctctcccgtctggacctgtcgagcttatccaccattcccgaagcgggattttattcggtctttgccggatggagcctgggatttgaattcgaaacgccatga

SEQ ID NO: 1060 - DNA, 402 bp, B.fragilis
gaagcaatgaagtattttacaatcaaggaattaagccacagcgatacggccgtggcgcgcgggattgacaatacccctacgggggaggtggttcacaacctgacagagctggtggaaaacgtcctcgacccgctccgtgaaaagtacgggaagcccatccgggtaagttccggttaccggagcgctgtgctgaacagaagcgtgaacggggcgacctccagccagcacctactgggtcaggccgccgatattaccgtaggcagcaaggagggaaaccgccggcttttcgagatcatccgcaaggaactgcctttcgaccagctgatcgacgagaaggatttctcctgggtgcatgtgtcattccgcacaggcaaaaacagaaaacaggtattaaaactctaa

SEQ ID NO: 1061 - DNA, 2847 bp, B.fragilis
  unsure (2724): Identity of nucleotide sequences at the above locations are unknown.
gaatcggtgaatgacctggagctcatgcaggccgcggtacgcgccaaagactttcgtatcccgctcgaggacctggggaaatacttgcagtttgcccggttaaaagcacagcagaccggacagagcgtggattatctgactgactcgatcataaccggactgggtcgtaaatcactgctgatactcgacaacttaggcctgtcggccgcggaggtcaacgaggagatggccaaaacgggggatctgatggcagcggtggctgcaatcgtggacaggcaactcgcgcaagcgggggagaattacgtgtcggctgcggacaaggccgctcaaaaagccgcggagctgcaaaacaggcagatggaaatcggaaggctcctgcttcccctgcaagaaaaatggagcggtctcttccagtctctcaagctcggtttttcagatgtggcgctccgggtattggaacataaaaaaagcatcattacgcttatctccgtggttaccggttttattctggtttataaaacggttattcttctgcaaaaaacatggaacgggcttttaatgctgggcaaggcggtcggcctggcctacgcctcggttgtggccatgcagagaggaaacatcctcagaagcgctgccgccatgaaaatgtataatgcctcggtggcgtccaacaacatcctggtaaaggcatgcaccgcatccacttatctgtttgccgccgccaaggcggtgcttaccgggaatatcaacaaggcccggattgccatgcaggccttttatgcaatcaccaaaataagcccgctggccatagtggccaccgtggtcgccgccctgacatacaagctggtgtcttatcgcagggaacttacggcgacggaaaaagcggagcggagcctgcaccgggtgcgggcgcaggccgccgacaccgtagccaccgaaacccgggaactgaataccctcctgggaatcgcacgcaacgagaaaataagcaaggagcagcggatggaggccataaaaaggctcaacgccttaagtgaggaataccttggcggtctcaggctggaaacaatcaacaccagggaagccacggccgcagtgaaggactacacggacaacctgttgtccatggccaggatacgctcggcaaactcaaggctggaggagatccagaaagaaaaaagggcactggaggaacagcgtaaggatatccatgccaaccggaatctctgggacagtttcaaactggggctcgccaaagggttcaattctttgtccgtagcggtaaaggggtattccgacgcctggtcggagggggtcatccatgactattttgcaagggaattcgaccaaatacaagccttgaaccgggaagaaaagaaacttacgcaggagatcacggcctcacagcaggatatcattaaggtcgatacccaatccgaggcaaaaaccaaggaccttatccaggccaaaaaggaagagattgcccaggctgagcgggaagtcgcctcgacgccggccctgctggccgccaaaaaccggaaactccaacagttgaacgaggagcttaaagcgttgcagcagctgggaactatccgggaaaccccggacggattcgcctcgcagaccgacaaggtcctctcggccctgaatgagaggcatgaaaaggagctgctcaagatccgggaaaacaaggagaggcagcagcagacacaggctcaatacgataaggccgtgctggcggaagacataaggtttcacacccaaaggctcgtcatcctcgaagggctggagaaaaagaccgcccggaccaaactcaggcagctggccgacatccgggcaaaaatgacggaaagctccgccaaaatactggagttacagcggaaactggatgaaaacgaggttgccctgctacaggaacagcgggataaaaaactggccatacaggaggatacgtacaaggccaccagggcacagatagaattgaattatgcaaacctgcatattacgcagcagcagcgcgacatgttgctgttgagcctggaggagtccaattcccgggaaagactcggtatcctgaaggaataccggaaggatgtggaagccctggagctacagacgggggatgtgaaaatacaggccgtcaaactctccgggcaaaaggtactggaggcggagctggccaacgccaaagacagggccgcgcagcaaaaggcgatcgaaaccatgctttcctctttcaaaaaagagttcaaccttttcaatctgccggatgaaacggaccttcagctcaaggtgctggaagcgtcataccgggcccggctggaactgatccgcaatgcgctcaaaaacgagcttgtcacaaaggatcaggccgcccggcaggaaaaggagctggaagaagcgtacagcaccgcaaaactgaacataacccggggtgccgaagagcgcagaaacgggattttggagaagtacgggctgctcggattccagcaacgctatgccatgcagatggcggccctcaagcgggagaaggaacaggggttgataggtgccgaagcatatgcaaaggccgaaaagatgctcaagatacagttctggaaagaggctttcgattattattccaacctgttttcaggggctgtctctgccctgcaaaacgccgagatcgcgaacatggaggccaaatatgacgccgagatcgccgcggcacagggaaacgcgcangaagtcgaacgcctgaaaacggagaaagcgcagaagaagctggagatcgagaagaaatacgccgacgtgcagtttgccgtaaaagccaccagatcattgcccgacacggcgtggccatcatga

SEQ ID NO: 1062 - DNA, 951 bp, B.fragilis
tatacaaatatgaaactgatatttgataaagattcaaacggcacgcaggaactggtcgacgccttgggcctgatcgatgtccgcacggacttctccaaatggaagccgtacatacctttaagcatacgtcgcctgaccgccatcatagggcaggaggtttatgacaaggttctcgacttctaccaatcggcaagcgtcgatccggatggcaagctcacccgcctgttgggaatggtgcagcagtccgtagcgctgtttacctggctgaaaatcatccccacactggatgcgcagcatgggaacacaggcaggcagaagcgcttgggggagcacgaaaaagggctgacagccttacaggagtacaaggatgaagccaacatcctgagtcaggcctacgagtcggtagatgccctgatagcatatctggagcaggaaaagttcgatttctggatacaaagccccaaaaggaaggctgtatcggaattgctcctgaatagcaaggaggcatttgatttttactatgtaaccggcagccaccggctgtttctgaccctggcacccatcatccgggaggtgcaacagaggcatatcatcccgataatcacgtacggccgttatgaaaagctggtagcgggccagcaggtggcagaggggttccgagacgccgtctgtcggccgctggccctgctgtccatgagcaaggccgtggaacgtttgcccgtggaggtcctgcccgacggtgtggtgcaggtgcagcttgcaggaagcgtccgtgaaaagctcagggcggaagccgaagcgcgcaagacagtggcaaaaagcctggaacaagatggcatgcgggatcttgccgcgctggaggacctggtcgcggcgctcgacgccgcaccggatgaaccggatctgtatgtaccctcgatcacccttcaatcaaaaggcataacattctga

SEQ ID NO: 1063 - DNA, 648 bp, B.fragilis
aatacggatatggcaaggaggtccgcgaccgtatttatgccggattacaggaagctttccaaagaatggaaatacgtacggattcctaaagacacattgtccttttgtccgggagacggcccgcctatttttgtccttaaaaataacgttatgggaaaattacaaccggattatatcacctggacgcttttggtcaatgcggacgggttgcagaaggagatgctgaaggtgcgcaacaacaccaaagagctcaaggcggagaacgtgcgcctgaaatcctccatggaaaatcttgccatgcagggaaaactccagagcaaggagtataaggaactgaatgcgcaactcaaggccaacaaccgtaccatctcggaaaacggggagaagctccgcctgctcgaaagccgtctgaacaacgccgacaaatcgtatgcccagctctcaaaacaggccagacagcttcgcagggaattggacaatacggtaaaatcgttacaaccccaagagtacgcccgtctggaggcggaactggcaaagaccaaggaggcgatggagcagctaaggcccaaaacccgaggcggtgaaagagtcatttttcagccttaccaggatgaaatccgcggtagtccggttttttcgccggtatag

SEQ ID NO: 1064 - DNA, 795 bp, B.fragilis
attatggaaatcagaagaaccggaaataccggatttatagataccggggaggggcagcttatctccttcgccatgggaaagggatggtctccttcttccatcagcttcagccgcccggagagctggcagacccgcaagatacgggtcgcgggtgtgaatatcgtgcccatgggtgccaataacgaccttcccggcgacgtacaacgcctgctggataacttttacggcggtgagggtatcatgggtaaaatacagggattgcagtggggagagggcccccgcttctttgaggaggccatcgactccgaaaacaaccgcttttaccgcaaatggatactcgatgacgtcatacaggcggatctggagagttgggattaccgcgactatatgctccgctgcctggtggacctggtgcacatgcaagggttctgggtaaagttcatccgtaaccggggaccgcgtatcggagaggatggaaggataatcaggctggaacatatcccttacaggaaatgccgcttcgaatatcccgatgacagacacgatttgccacagaacgtatatgtggggcgactgggcccttccccgatcccgacagggctgggccaaatatcccgttttcaatccggcggaccccgttccggcatccggtatcggtcggctattccaacatatactccttttgcagggactttgtcagcacgccccgtttcctgggggctttcccgtggctggaactggcgggcaccatcgcccccttgctggcagcctataatgccaacgcgtcggcactga

SEQ ID NO: 1065 - DNA, 858 bp, B.fragilis
accggatctgtatgtaccctcgatcacccttcaatcaaaaggcataacattctgactatgaaagaaattacgtacaacaatcaaaagaaagagattccggactccctggaggagttatcccccaaggagtattaccgttacctggagttggtattaatgatgaacgcgggggagatttctcctttccagatgcgctgcaagctgctttcctgccttctggggatgaagcacagccttcttctgtgcctgggagaaatacaggaagagcttttggcgcaactccccgccctggacgggttcttcgatatcacctcgcaggaggggatgatggtttacgacgcccgcctgaaaactggccggaacctgctgcccgcctataaggagtggaaaggcccgggggatatgctctcggggattactttcggacagtttatcgagtgcatgggggtgatggcggaaatggagcgcgcccgggagcagggaaatgaagaagatataggggaactgatatcttctataggcagactgctttataagaaacagggccctcaggaaaccggcactcctcctttcccggtctgcttccacgcatacatcttctttctcgcggtctgggagctgatttacagtgtccccatttcaaccaacgggaaggacatcgacttctcgatcctgttcgagaaatccgggcgggggaatgcaggggacaataccggctgggtgggaatctcgtacgacgtggccgcatcgggtgttttcggtgatttcagacaggtaaacgacacccctttctgggatgtgatgctatacatttataaatgcaggtttgaaatgttacataacaataagaagcaatga

SEQ ID NO: 1066 - DNA, 507 bp, B.fragilis
aaaggcgaatcgaaaacattaaaaataggaaaaaagactatggggcaattagacaaaacggatgttgaaatacttcaggtattacagaaagatgcgaaagtgaacactaaagagctttctgagaagctccatatatcaaaaacgccgatatatgaacgcatcaaacgactcgaaaatgatgggtatataaaaggatatgtcgctttggtggataataaaaaagtcggattgcctttgattgttttctgtaatgtctctctggcagttcacgacgacgaacatataaagcgctttcaagaggagatcaaggagatcgatgaaattatggagtgctattctaccggcggtatttatgattttttcattaaggtggtcttgaaagatctggatgcctataaccgattcgtttttgagaaactgactaaagttcacggtatagttaagatgcagagttcgtttgttcttagtgagattaaacatacgacagttttgaatatagaccgatga

SEQ ID NO: 1067 - DNA, 648 bp, B.fragilis
cagctcttgttggcccgtcaggaagtggaaaagagtacggtaatgaaactttgtgcccgtttttatgatccgacaaaagggcgtatactgtttggtggagtaccggtacgagagattgaacctgaaaaattgatgagtcgtatttcgatggtttttcaggatgtttatttatttcaggatagcatacgcaacaatattcggtttggtaaaagtgatgccacagatgaagagattgtagcagcggccaaaaaggcctgttgtcacgactttatcatgcatctgccacatggttacgatacaatggtgggagagggaggctgtacgttatcaggtggtgaaaaacaacggctttccattgcgcgtgccatgctgaaagacgcacagatcgttctgctggacgaggcaactgcttcgcttgatcccgagaacgaagtagagatacagaaggctatcgatacgttgattaaaggacgaacggttattgttatcgcccatcgtctcaagacaataatgggggccgaccacatcgttgtcttatccgatggaaaagtggaagaacaaggtacgcattcggaattgatgtgccgggatggtttatatcggaagctctggaacattcaagaaagtacattgggatggacattatag

SEQ ID NO: 1068 - DNA, 423 bp, B.fragilis
attatatacccaaagggaattaatatcatgatacagacaatacaagtacaaggaacagaaaaacgcttataccaacttattgctccattggtgatgaatccggatgttttaagtgcaaataataattatccttttaaaacgacagaacaatacgtgtggttcattgctatcgataaaaaatcggttgttggttttatgccggtggagcatagaaggagcggatgcgtaatcaacaactattatgtcagcggtgataaccgtgaaacactctcattattaatctccagtgttttggaagcaatcggaaaagaagtacgtttgtttgccgttgttatggtcaaccatcaggctgtatttgaggaacacgggtttataatggagaaggcatggaaacgttatgtaaaaatgcaaaaagatgaatga

SEQ ID NO: 1069 - DNA, 1827 bp, B.fragilis
ataaatcggttgatcatggtaaataagaagaaagaagggctgtcccgtctgtttgagattgcaggacagaaaaaaagtctgcttctgttggcaggcttgttatcggctgggagcgcggtgtgtatgctcataccttattgggcgatctaccggatactctatgaattgttgaaccatagccgggagctgtcgtccatcgatgagaccaatatgatccgttggggttggatagcctttggcgggctgatcggcggattattgttgctgtatgcttccctgatgtcatctcatgtggcagcataccgtattctctacggactgcgtatccggttgacggaacatatcgggagattgccgctgggttatctgaacggaacatcaacgggagccatcaagaagacgatggaacagaatgtagaaaagatagagaacttcatagcccacacgattcccgatttggtgaacgttatggcaacagtagtggtgatgttcctcattttcttttcgctcgatggatggctggcaggtgtctgtttggcagtgatcgtactaagtatattcttgcaattttccaatttcatgggaaaaaaggcacgggaatttacacgcatctattacaacgcgcaagagcagatgagtgcttctgccgtgcaatatgtgcgcggaatgcctgtggtgaaaatctttggacagagtgtccgctcattccgtcagttcaatgccgaaatcgaagcttacaagacctatgcattgaaagtttgcgacacttacgaatcgggtatgacatattttaccgtactgctcaattcgattgtcaccttcattctccctgtcggtattttactaatgcaaaatgactcccggagtcttacgctggcagctgtatggcttttctttatcatactcggtccgggcgtggcttcacccgtctataagttgatgtatctgggcagcagtacgcgggaaatcaatgaaggtgtatcgcgtattgatcgtattcttgaaaatcagccggtctcggaacctgcttgtccgaaaattcccgcgacgtatgatatagagtttcgtcatgtctcgttttcctatgaaaacaaggagcaggctactcgtaccgaagcgttgcacgatctctgtttcacggcccctcaaggtaaaattaccgcttttgtcggtccgtcgggaagtggtaaatctaccgtcgccaatctgattccccggttttgggatgtggagcagggagaaatccttatcggcaatgtgaatgtgaaggatattgcaacggagcagttaatggatctcgtttcgttcgtctttcaggatacattccttttttacgatacactctatgaaaatattgccgtaggttcgtccaaggcaacgagagatacggtcattgctgccgctcgtgctgcgcaatgccatgagtttatcgagaagttaccgaacggatacgaaacacgtatcggagataaaggtgttttcctttccggtggtgaagcacaacgagtctgtgtggcacgggctattttgaagaatgctcctatacttgtactggatgaagcaacggcttttgccgatcccgagaacgagtacaagatgcagcaggctttgaaatcacttattaaggataagacggtcatcatcatagcccaccgcctttcttccattgtatcgtccgaccggatcatcgtactgaaagatggaagggcagtacaatgcggacggcatgaagaactttcctctcaagaaggggtatataaaaagatgtggaatgcttatacgagtgcgttccgctggcaattgaatgtgaaacaagaaaaagaatag

SEQ ID NO: 1070 - DNA, 558 bp, B.fragilis
aaacatattgcaatgagtataaagaaaagtccggtatataatgtaatagcagttcccgtagaaaaagtacaggccaacgattacaatccgaatgtggtggctcctccggagatgaggcttcttgaactttctatctgggaagacggcttcactatgccctgcgtctgctattatgataaggaaaaggatgtttatatccttgtcgacggtttccaccgttattctgtgctgaagacttcgaaacgtatctttcagagagaaaacgggatgttgcctattgtggtaatcgaaaaggatctttccaatcgtatgagttccactatccgccataatcgtgcccggggtacgcacaatatagaactgatgtgccatattgttgccgaacttgataaggcaggcatgtccgatcaatggattatgaagaatatcggtatggatcgggacgagttgttgcgcttaaagcaaatatcgggtttggccgatctgtttgccaatcgtgacttcagtgttcccgaagatgaccagccgggaaatgtagataagaaacctactcgttaa

SEQ ID NO: 1071 - DNA, 1014 bp, B.fragilis
agaatgagtgcaataagaaatattacaataggccgtacggaaaggctttataaacctgtaggctacactatgcttgccaatttggtgaacattgttcctttttgcctttctatcgaggcgattcgtattatattccgtgctttcaacggaggcgggcaatcgcttgataccacccggttgtggtgtatatttggctgtatgacaggttatatagctgttatggtactggcggaaagggctgcctatcgtgccaatttccgtggtgcttacgaaatgagtgcatcgggacgcatctctttggcagaacatttacgcaaactttcgttaggttttctgggtaaacgggatccgggtgatttatcatccatgcttattaccgattttacaatggcggaaacaggtatctcgcattatttgcctcaactgatgggagcattggtgatgcctgtactggcttttgtttcgcttctttggatcgattggcgcatggcggtcgccatgttcgtggctcttccgtttgcaatgggcattttgtggttgagcacgagcgtacaggagaggctgagtggcaggcagatcaaagcaaaagtcaatgccggaaaccgcctggaagagtacctgcaaggcatccgggtgatgaaagcctacaatctgctgggtgatcgttttgttcggttgcgtgatgcttttgccgaattacgtcgtgcctgcattcggttggaggctctattgggaccttttgttctattggctattacactcgtgcgtgcaggattgacattgatggtactgtgcggaacatacctgcttttaggtggccagttgtcgattctcacgtttgtcatgttccttgttgtcggttcccgtgtattcgacccgctgacttccgctcttaccaattttacagagttccgtcatttttctatttcgggaggacgtattctttctcttatgaacgaacccgaaatgaaagggacaaaagaagctcccgaagacggtaatatcatcttttga

SEQ ID NO: 1072 - DNA, 354 bp, B.fragilis
  unsure (280),(285): Identity of nucleotide sequences at the above locations are unknown.
tcgtggaggtatccacttgatttaggggctgtaaagctgtctgcacagcaaatgattgtgcttacaccggtcttgcgatatacagaaggagaagaacagcagctattagctccggtagtgatagccggaccccgtcgctatcgggtgctgaaacgatctttagctttcggtactgacaattttgaaatgtttcctatgcttgtcgagaatcgaaagagcggtactccccagactgtgaatattcacttcggattaccctatcatgaatggatgcgccggncatanctgattatacgtgaaaggtgcccggttgtgccgatcgtcttgtcagtcaggatgaccataccgttataa

SEQ ID NO: 1073 - DNA, 471 bp, B.fragilis
atacctttgcaggtacaaaagtatatagaatatatggaaacaaagattctttcaaatgccacacacaaatgtgttttagtgatcgataacgctcaacctacgggcatagtagccaatattgccagtgtcttatccatgacgctagggtgcagagtcagcaacattgtgagtcatgatgtatatgataaacaaggtgaaaggcatttgggcataacacaactgccgattcctatacttggagcttcacaggagaagataaaagagctccggaactatttccactctttagaaattgaagatctggtactggttgacttttccactattgcccaacaatccagaacttatgatgaatatgaacgtgaaatgtatagtgccaatgaagatgatctgcactatgtaggtatcggtatttgtgcagagaagaaagctataaataaagcaaccggcagcctgagtctgatcagataa

SEQ ID NO: 1074 - DNA, 183 bp, B.fragilis
ttgataaggcagctatacttgccgttattggcgaacatacggatttcgccacacgtaaaaaatcggttgcaggcgttgaatgtaggaactacctacaggatgttactgagggactattatccgcctacacgtagtaatgtatataccatttttaatgtggcgagagctttcaatgtagtctag

SEQ ID NO: 1075 - DNA, 1305 bp, B.fragilis
atgatgactaaaactacaactgtacctaaaaatgtgtatgaactggcgcaagaacgtttgcgtatcgtcttcaatgagttcgataatgtctatctttccttttcgggaggaaaagatagcggagtgctgttgagcttatgtattgattatattcgccggaataacctgaagataaaactcggggttttccatatggattatgagatacaatataagatgacgattgactatatagcccgtatgttggaagacaataaggatattcttgaagtataccgggtttgtgtacctttcagggtagctacctgtacttccatgtaccagtctttctggcgtccgtgggaagatagtaaaaaagacctctgggtgcgtccgttacctgagaacgccatgactaaagaagactttcctttttataatacacaaatgtgggattatgagttccaaatgcgttttgccagttggcttcatgagaaaaaggatgccgtgcgcacctgctgtctgatcggtattcgtacgcaggaaagtttcaatcgttggcgctgtatttacctcaatcgcaagtaccagatgtatcatcgttatcggtggacttcgaaggtaggaaacgatatctttaatgcatatcctatatacgactggaaaactacggatgtatggactgctaacggaaagtttaagtgggattacaataaactatacgactattactattgggcgggagtcaatctggaacgtcagcgcgttgccagcccgttcataggtgaggcacaagagagtctggcactttaccgagccatcgatccgaatacgtgggggaaaatgataggccgtgtcaatggagtgaacttcacgagtatgtatggaggaacccatgcgatgggatggcagtccattaagcttccggaaggatatacctggcgggaattcatgtattttctgctttccactttgcccgaccgtgcccgaaacggatatctccggaagttacaggtcagtgtacaattctggcgtaataagggagggtgtctgagcgacgaaactattcgtaggctgaatgaagccaaggtacctattattgtaatggacaactccaattataaaacgaccaagaagccggtccgcatggaatatcaggatgatattgatattccggagttcagggaaatccccacctacaagcgcatgtgcatctgtattctgaaaaatgatcatgcttgcaagtatatgggattctctccgacaaaagaggaaatgagtaaacgaaatcaagtaatcgaacaatataaaaacatattgcaatga

SEQ ID NO: 1076 - DNA, 291 bp, B.fragilis
agcggaatcaataatgtttccgccacgatgttttcaaattcatgtttttgtttcattctatacttttatgatgttagtgtcagagtagcgctgaaaaatgaacggtattcaaaatcgttcacaaaaaaagaagagaaccttcgtaaagattctcttctcaattttaatccggtaaacggcgatttatatttttgtcttctattgctcatactctcagcaaagccctccaaccttgaatttcaaacaatatatactcatgcacgatatactccatttccttgctatcgatag

SEQ ID NO: 1077 - DNA, 327 bp, B.fragilis
aacatggaaaaaatagagattgtattacgccgggaacaaaataacagaaatggcatttatttaaattacatcaacggatattggtatacttacgaatggtcagcctttttgctatgtatgcttcatccggaagtcgaagtcagaaaatgtattggagtgcaacccgatgaaaactatgctatagcccgcgtcaataaaaaaattataaaaaaattagaaaggaagtatcagacatccatgatggatgactccataaaaatactacttccgccgttcaacgaagatgaaaatatcttcctgaattggaaagcgctactccctccataa

SEQ ID NO: 1078 - DNA, 924 bp, B.fragilis
gtgcaaagaaaaaaaaacggtaaaatgaaagatagtaaattaaaaacggcaggtatgcggaaacttcactggggtaaagcggttatgtccatagtagtgacactggctgctatgccgttgacccatagcctggcacgtgtcctgaaagagggaaccacaggagtggagcagttttatgccggaatgggaatgggggctttcggattattcatggtgattgcgggagtgtttgtgaaagggcatatccggcagactttattgggattgttcggaggaatgttctattggatgggagctgtcgactttctgtttatgtattttgccaaccgtttcggtacgcaggcacaacttgatccggtgacaggagaggtcgtcagccggccggagtatctgttactgcctgctaccttcggtttttgggttatggtgatgatactctatctgttctgtactcggaacggatgcaacttcttgaactggtggcagaaattatttttcggcaagcacaaaaaggagattgttgtccgggccatgacgcgccacacaagtattgtagcttttatggaagtgatcactatgctatggacgtgttacctggtactgatgttttgttatgatgaacggttctttggcgatcaccatccggtgacactgttggtgggaatgttgggacttatcggttcgatttttatgtttgccaaactgctgcgtcatgcctcgtgggatatgagtttacggttcggctttgccaccgtcattattttttggatagcggtagaggtgtttgatcgtattcatttgttccccggtctgtgggaaaatccgggtggacataagcaggaattgcttcttatagcggcttctatcatttttacagggtggtggcttggatataataacctattagttttaaagaataaatga

SEQ ID NO: 1079 - DNA, 954 bp, B.fragilis
aatggtggttgtttgataaaaaggaactttttctgtcctttgcagtacctccgtcacataaaactttggaatgaacgcaaaatggcagataatgtaaaagcaaacaaaatgaactctcaggccgacgatgacattggatttgggatctatacggatattgcagatcttcctatgaccggttgtccgtcttatattgaagaggggatcggcggtgtatgcgaatcgggtacggcaactatcgtagtttttgatgttccattccaaatcgtaccgaatgtggtcattaccctgatgccgtggcaactcgtttttatcaaagagattagtgaggatttcaggatcacttttttcaaaatttccaaagatatgttttcagaaactctgagtacattatggagacccgcttccgggtttttgctgtacatgcgcaagcatattgtatcaatcccggacggggagttgatcggtcgttttttggcgtattgtaatcttctggtatacaggatgaagcatacaccgcaaaattgtcgtcaggaatcaatcatgcaactgttaagggtttacttctgggatgtctatactgtgtatatcaatgatcctcaggctgagaagagtctgaagtttacacgtaaagacgaatatgtctatcaatttgtacgtctgattatagaagatcattctccggataaagatgtggcctattttgcacagaaactgggtatttctcccaaaaggctcacaaatcttatccggagtatcagtggtcaatcagcgcgtgaatggattgtttattataccattcttgagatcaagtcattgttacgggagtcatccctggacattaagtcgattgccgccagggttaattttcccgatcaaacgacattgagtaggtattttcgtcattataccggagtaacgccatcccaatacagaaaaaatatttatttttga

SEQ ID NO: 1080 - DNA, 645 bp, B.fragilis
ttttacgtccggaaacaaaacgctgttcgtcatatgcaaacactcaaatcggatatacgcaaccggattctgtcggccgcaaaagagcaatttgtgcagagaggatatttgaagacctctatgcgcgaaatagccgatgctgtagatgtaggcgtaggaaatctctataactattttgagaataaagatgagttgttttgtgtgatacttcgtcctgtatcggatgctttggagcgaatgctgcaggaacatcatggagccaaaggagcagatattatgcttatatgttccgaagagtatctcaagtctgctgtcgatgaatatatatccttgataaacaagcatggtgagctgatgaagattctattgttccattcacaaggctcttcattggaaacattcagggaagactatacaaaccgttcgacggagatggttaaaacatggtttgccgaaatgaaagagaagcatccggaaatcaatgtggtggtatcggattttatgatccatctgcaagcagtctggatgttcaccctttttgaagaaatgttgaagcatgctatcgatagcaaggaaatggagtatatcgtgcatgagtatatattgtttgaaattcaaggttggagggctttgctgagagtatga

SEQ ID NO: 1081 - DNA, 867 bp, B.fragilis
acaagaaatagtttaactatgaaattattacatatagaacgacacaccacttgcctcaattatgtatcagattacaatatatgctttattcatcaaagactcttctccgggggcgattttaagatagataaccatcaccactcgtgtatcttatttcttttaaaaggggaaatactgacatcctgcagcgagtttcacgatcagcacatcgttgaagggcacatggttctctttccccaaaacgatcctaatcaaagcaaaagcatgacagaaacagaatttatactactgttcttcgacaatcaagtcaatcttcacagtaaaatgtcgattgaattgtctgccattcatcttgagtctgaaaagagttgtttttattccttatctatctgtcctccgctacgacatgtgttggacagtatttgcttctatctcaaacagaaagttcagtgtagtcatatgcatgaactgaaacagaaagagatattcatggtattcggtacattctacaatcgaacagatatggcccacttcctgatgcccatcacagggcgagatccgaatttcaaaagtttcgtattggaaaactacctgcagatacgaaacatcaaacagtttgcacaattatatcattgttccgaacgttctttcaatcgtaaattcaaaagctgctttcacgatactccctacaattggattcttaatcaaaaaacacgccatattaaagggcaattagccaatcgtaatataccgatcagtgaaatagccagaacctttcattttgcttcaccttcacatttcactacttactgtaaaaaaagacttggaatcactccgagcgaattcagagaaaaaattgcaaaataa

SEQ ID NO: 1082 - DNA, 603 bp, B.fragilis
aaggtgcccggttgtgccgatcgtcttgtcagtcaggatgaccataccgttataacatcggtattcggggaacaatttgcgcctcgtactgagctgagtatcgtgactccgccggtagatccgttgaagcagcgtagcgagacacatacagcctatctgaattttgaggtggacaaatatgtaatgtcgcgcaattataagaataatgccaacgtgcttgctgatgtcgaccggattgtcaatgagatacaaaacgattccaacctgaccgtaacggaatttcgggtgacaggctatgcatctcctgaaggtgactatagccgcaacatggagttgtccgaaaaccgtgcattggcatttgtcggttatctgcagaatctcggaggagttgacgaatctctgctgacagtcgattggaaaggagaagactggtccggcatgcgtcgtgaagttgcggcttcgagtatgattgataaggcagctatacttgccgttattggcgaacatacggatttcgccacacgtaaaaaatcggttgcaggcgttgaatgtaggaactacctacaggatgttactgagggactattatccgcctacacgtag

SEQ ID NO: 1083 - DNA, 594 bp, B.fragilis
tcagtatatataatagaagaaacgagtatgaaaaagctaattctgtttggagccgcaatatcgatttcagtagctgtaagtgcacagcacgtcgctctgaaaaataatctcctgtacgatgctaccaccacacccaatctggcattagaggtagggttggggaagaagaccacgcttgacctgtatggcggctataatccgtttacgttcggaaatcacaagcgtttcaagcactggttggcacagccggaattccgttactggacctgtgagcgtttcaatggaaccttctggggtgtacatctgcatggaggtgagtttagcgtggccggtatcagtttacctttcaaaatattcccttctcttaaagaccatcgctatgaaggatacttctatggaggaggtgtcagtgtgggacatcaatggctgttgagtaaacattggagcctggaggcctcggtcggagtgggatatgctcattgggtatacgataagtatcgttgtgtgaattgcagtcctaaaataaagagtgggcataaaaactatgtcggtcctaccaaagcggctgtttcattggtctactttattcgctaa

SEQ ID NO: 1084 - DNA, 360 bp, B.fragilis
caggttagaattttaataatcattaaaaaaattacgatcatgaaaaaggtattagtagcagtagcattggtaatgggattaggtagttctgtagcatttgcacaggaagttgaaaactctacggcagtagaaacgcaggcacaagctccacaagatgagtttacgaaaattgatgcccaaaaacttccggatgcagttatgaatgccttggctaaatcttatgaaggtgcctcaatcaaagaagtttattcggctgacaaagagaccggtaagatttataaggtgattcttacaaccaaagattctcaggaagttaccgtacttctggacgaaaagggcgaagagataaaagaggcataa

SEQ ID NO: 1085 - DNA, 828 bp, B.fragilis
aagtatagaatgaaacaaaaacatgaatttgaaaacatcgtggcggaaacattattgattccgctttacatgagagccaaggagaaccgtcggaaaaatccgattctatgtgacaaattggctgagcaactggttgagaacatcgaatatgattattccaggttcgatggggccaagttgagtgaagtaggttgtgtgatacgcggttggtattttgatcatgctatccggcggttcattgacactcacacctgcccggtagtggtaaatgtgggttgcggactcgatacccgttatcagcgtgtcggaaatgacggaaaggctgtattttatgagttggatctaccggaggttattgctatacgtcgtcggttgatacccgaacctgagaatgattgttacctgtctgcatcgttgttggaaaccgattggatggatcggatccggctccttcatcccaatggagatttcatctttgttgtggaaggagtattgatgtattttcgtgaggaacaggtacggacatttctacataacataaccatgcgcttcgaaggtggcgagttgtggttcgatgtatgcggaacgatgatgagccgacgtggtgtgaagcccgattccttgagggaacataaggcgcagatacgttcggggatagatgacgggcatatggtggagttgtgggaacccggattgcatttgttggaacaggccaattatatgaaatttttccgttcccgttggggattttttttcgggcagatattgggcaggatgacgaagttgtgctacaagttcagttccatgctcgggtataaaataggataa

SEQ ID NO: 1086 - DNA, 186 bp, B.fragilis
agaacgcagatatccggactgatgggcccgggtagcaagactgacataaagcaacccatagcggaacctataaaagaagaagtgcgttgctccggacaaaagcacctcttttcatccatccggcacagtccggatgtgaagtttgcatttcacttcattcatataaattacaataacccactataa

SEQ ID NO: 1087 - DNA, 717 bp, B.fragilis
atactcatggtaattataggcgtgtttgcccaaggagatacccgccagacgctatggggcttttttggaggactgcttttttggacgggttgggtggaatttttatttatgtattttgccaatcgtttcggtacacaacctgaactggatccggtgacgggagaaatcgtgacccgtcctgaatatctgatactgcccgcttcttttggcttttggatgatggtgatggtaatgtatttgttcagtacgaagaatggctgcaatttcatcaactggtggcagcgtttgttattgcgcggacgaaaagccgatatagcagcacgtcccatgacacgccatgtgtcgatcatcacctttatggaactgatgatgatcctgtggacttcttatcttgtgctgatgttttgttatgacgatgtatttctcggcgaacatcatccggtgacactgttagtgggattaggatgtctggtaggagcgttctttatctttgtcaagcaattacgcattgcctcgtggggagcgaatatacgtatggctattgctacagtggtggtgttctggacaccggtggagatactgggacgcatgaatctgttcagtgagatatggattgatccgatgaaccacgtgatggagatgggtattattcttgctgtgttcattatccttactgtttatctctggtacatgagtgcaaagaaaaaaaaacggtaa

SEQ ID NO: 1088 - DNA, 1536 bp, B.fragilis
atgtcgaattcttctattaaatcaaaaacggcgctactccgaaacggggaaactcaaaaaggaaatggctatccggaagccaatgattattccgccaggattcttgaaaccatgcagaccggtgtgatctttttcaataccgaacaaatcatttccggcatcaacaacttggcatgcgaggatttacagatcccccgggatccttccggacataaaataacagacatcatttcaatcatccaccaagaaaaagatatcttcccggaactgatcgcccgattgaagtcttcggaaacggatatggagaaattgccaatagacactttgatacgttctctggaaacgaaggtgcaattctttgccagtgggtgtatcatgcagttggagaccggacgttatttattagcattccgtaatacgatggatgaagtaacgcatgaacaccttctgagcatgattctggcaaggacaaagatctttccatggtttttcgacttgaaacgtaataaaatgttaatcgatgcccactggttttcttatctgggtatcccggcagaagactgtgagataacaatcgagaagttcttctccagagtacatcccaacgaacgggatatgcttgcagatgctttgcaaaaacagttatcagaaaaagaaatacccgattcattctcctatcggctgcaacggggcgatggaagttgggagtggttttctgaacagtcgatgtatctcagcaaaaccaatgacggttcaccttatcgtattgtaggcgtatgccatagcattcaggagcataaaaatactgaggataaattgcgcgctgcacgcaataaagcccaagaaagcgacagactcaaaagtgcatttctggctaacatgagtcacgaaatacgaactcccctgaatgcaattgtcggtttctccaatcttattgcaggcgggattgtcgacttggatacagaggaagccagagattactcggcattaatcagtaaaaactgtaattatctgctcacactggtctcggatgtccttgatctttcatgtatagagtccgacacgatgacttttaagtttacagtatatccacttacccgacttctgacagaaatctatcagaaatatgaaaacagaatacctcaggaggtacagtttaatttgctgctacccacagataatgttgaaatagaaacagatgctgtgcgcctacggcaagtgatagagcacttgttggataatgcggcaaaatttacagtaaaagggcatatagatatcggatatgccctgtcggatcatggtgagaaaatatatgtattcgttgccgataccggttgcggtattccaagcgatcaatataaaaaagtattcgagcgcttttataaaatcgattcattcgtacagggtgccggtttaggactttcagtctgcaaaaccattgtagaaggtctgggaggtacgattaatgtatattcgcaactgaaagaaggttctcgtttttccgtgatcctaccgctaaacagactccataaataa

SEQ ID NO: 1089 - DNA, 1455 bp, B.fragilis
agcaactttccacatacgtttatttggggggaagctcaaggtgaagccttaattacttctggtactagtgccgatggtatgggtatgctatatggtgatattaaacttcaaaatttgattgaagatcatacagaagggatcaaaaaatttggtgatatttttggtcgtctaacaaacttaaatctttttattgcaagagtaacagatgctacttatatggatgatgtcaaaaagggatattatcttggacaagcttatggcttaagggcattttattatttcgatttatatcgtacctatggcggtgtgcctctacgtttgactgctgatgtggtagaaggggttattgatcctaataaactttatatggcacgtgccactcctaaagaagttatggatcaaataaaaaaggatttggataaatcaatggaatcttttggagataataattcgtttgatcctaataatcgtggaaataaaaaagggtattggtcaaaagctgcaaccgaatgtttaatgggggaggtctatttatggatttcaaaagtgtcgacaggagatgatgctgccaatgaggccaatctggagatagccaaaacacatttgcaaaatgtcatcaacaattacggtctaaaaatgttagacgatttttcgtcagtattcgatgccaaaaatggtaagggaaactctgaaattatttttgctgtcagatatatggaaggcgaagctggcaataataacaacttattcacttatgctatggctacaggtagtacgaaagacaattatctggctaatggcgagaaattcctggatgctttgaatattgcaaatacgggcagtcagcagttggaatacaaacatgaaatttataatagttttgatgtggctgacacacgtcgtgaagccacattcattgcttcatattctaaaaatactgaaaccaaagagttaactttaagaggaacacacgttcgcaaaaacatcggttatgtgaatgctcaaggtagtcgtatctattgtggggattatattatttatcgtctacctctcgtatatttaatgcttgccgaaattgagaatatgcagggaggagatgttgccaaatatattaacttagttcgtgaacgtgcttatagcaccaattgggataaggcgatttatgggtatacaaatgccgatttcacaactaatgaattggccattcttcatgaaaaggataaagagtttattcaggaaggacagcgttggtgggatattcgccgaatgacgttaactaaggggggcaaacatcttgtctttgtcaaagaaggtagtatcggaacagatatgcctactttagatgaagcgactgaagcgcataaagtcctttggccggtagataaagatttgttgggtaatgaccctttaatttaccagaccccgggatatgcaacttataaaaaagcagaatag

SEQ ID NO: 1090 - DNA, 3270 bp, B.fragilis
ctcaaaaaagcaatacttatgaagaaaaccatcttcttgattttgtgcattttatgttctcttggagccatggcacaaaagaaatcaatcacaggtgtggttatggatgctagcggtgaatcaatcatcggagcgagtgttgtcgaggtcggtaccaccaatggtgtaattactgacatctcaggcaaatttacgttaatggtcgatcctaacggaaagatcaaagtttcttatatcgggtatcagcctcaggtactcgatgtaaagggtaggaattctttcaatattaaattgaaagaagactctgaaatgttggatgaagtagtagttacaggctatggaggaaaacagttgcgtaccaaagtgacgaattctatttccaaagttagtgaggaatcattaaaggttggtgtcttttctaatccggcacaagcattatccggtgcagtttccggtttaaaagtgacgcagagttccggtaatccaggaagtacgccgaccattgtactccgtggcggtacagaatgggatggatctggttctcctttagtaatggtcgatggacagctgcgtgatggtttaaatgatatcaatccggaagatatcgaatctatggaagttttgaaagatgcaggtgctactgcattgtatggtgcgcgcgccagtaatggtgtaatattgattacaaccaaaacgggtaaagtcggtaaggcagaaattaatcttaaggctaaagtaggtatgaactatattaataatccctatgattttctaggagctaaggattttatcactgccatacgtacagcttatgacacaacaccatgggctagtaaatcatcattggatggtgcctccgcttatggaacaggaaataaatatggcagcgatttggtttggaacttattggtaaaggatagcggaaacgaattcctgttgaacaaaggttggcaacaaatgcaggatccgcttaattcttcaataacccttctttataaagatatcaaaccttccgattataatttgaataacccttctttaactcaggattataatgtaaatatgtcaggcggtaatgataaaggaacttattatgctggtttagggtataataagtcagaaggacttcccatttcttctttttatgagcgttatagctttattttcaatggcagttataagttggctgattggattaccgcaaattctaattttaattataatcgtgctaattggcgttctatgcccggttcgcaagataatgaagggaactattttggacgtataatgtccttgccccccactgttcgatatgaagatgaagatggaaatcctgtcctcggccctaatcatagcgatggaaaccagtcgtatcaacccgaaaaatggcttgtagataaccaaacggataaatttacaatgatccagtcgttggaaatcaggccaatgaagaatctcgtaattaaaggtaccgctaactggtattactcggaaggtgtctatgaaagttttaccaaagattttgagacagctccaggtaaattcaacacaactcgagcttcctcagccaaatttgagcgtgacttctctcaaacttataacgtagtattaaattacaataatacatttgctcaaaatcataatatagatgttatgttgggttctgaatactacgataaaaagacaaaaggatttagtgcgtcaggttccggtgctcccactgacgattttgcagatctcaacctgacagataatggggaagggaaacgcacaattgattcatggcatagccagtaccgtattctttcttattttggtcgtttgaattatgattatcaggggaaatatctgttatcaggagtattccgttatgatggatattcttccttattgggagataaccgttggggattttttccgggagtatctgccggatggatttttggcaaagaggactttataaaaaatgctgtgcctgacctgtcatttggtaagttacgtttcagctatggtgtgaatggtaatgcaaccggtattggagcttatactttacagggttcctataactctcagaaatacaatggtaatgtgggatatttaattggtgctctccctaatccggggttaaaatgggagaagacccgtacaactgaagttggtttagacttaagcttctttgataaccgcttaaacgcaaactttacttattataaccgtttaacgatggataaatatgctgatttgagtttacctactactaccggtttctcatcggtaaagaataataatggagatttccgtaatagtgggattgagatggagctatctggtacaatactcaaaataaaggattggacctggaaaatgggaggtaatatttcatataataaaaataaagttgttaccttacccgataatggtcagccaaagaatcgtattggtggccaacaaatttataccggacgcaaagttttagatgaagcagggaatcaagtggatgaagtaatctttgtaggcggtaaacaagaaaggcaggaaccgggtattttagtcggatataaagcggaaggattatataaaagttgggatgatattccagagaatctaattgtaaaaacgggaaattatcaaggaaaatatcaatatggtccgaaagcgtatgcagcattgtcagatgcagaaaaagcgaaagctctccaaattgcccccggtgatgtaaaatggaaagacattaataatgatggtacgatcgatgcctttgaccaggtagtaatgggaaataccactcctcactggtttggtggtttcaatactacattgacttggaaaggtctgacactgtatggacgttttgacttcgcactggactattggatttatgataatacgactccctggttcttgggatgtatgcagggtggatataatacaacaaccgatgtattcaatacttggagcgaagaaaatcctaacgctaaatatccgagatatgtttgggccgatcaattaggtactgccaattattatcgtacgtctaccatgtttgcttataaaggtaattatctggcaatccgcgaaatttcattgtcttattctttacctcagaatattgcacggaaattttattgccagaaattagatgtatctgtaacaggccaaaacttaggatatatcacttcagccaatgtagcaagtcctgaagtttcaactgccggttctggatatgccttaccacgcactttactcttcggcgttaatgttacattttaa

SEQ ID NO: 1091 - DNA, 1629 bp, B.fragilis
aaagaaaaatatatgaaaagaataaaatctacaatattatatggtttactggtggcatcttcggggctgttagtaacgtcatgtgccgataaattggatctgtctccgattgattactacggaagtgggtcttattggaaaacagaagctcaggctaccgcctatatagatggtattcataagcatttacgcgatgcggcatggcaacatacaatcacattcggagaacttcgtggtggacgtttcatcaccggtgcaagtagtgatggcatgggagttagtaatggtgatattattttgcaaaattttgatgaaacacataccggagtaagtaagttcggagatttattcggccgtattactaacttgaatcttttcatagcacgcgttacggatgccacctatctgtccgatgaaatgaaaaacttctatttgggagaagtgtacggtttacgtgctttctattattttgatctataccgcatctatggcggggtacctttgcgtttgacggctgatgttgttgaaggagttattgatcctaataaactgtatatggcccgttcgacccccaaagaagtaatgacccaaataaaaagcgatttgaataaatcgatggagtattttggaaatatgaatgattttgatccatacaaacgtggcaaaaaggtgtattggtcaaaagctgcaaccgaatgtttaatgggagaagtttatttgtggacttctaaagtaaccacaggagatgacgtagcaaatcctgctgatctgactatagctaaaacccaccttgaaagtgtattgaataattataatctgaaaatgctggatgacttttcacaagtattcaatgccaaaaacaaggcaaatgacgagattatatttgccattcgtttcttagaaggtgaagcaaccaatagtaatggtacatttacttataatgtaggtaccggtagtaccaaaaacagatatcaagccaatggtgaagtatttggtgatgctttagacatacagaatactggcaatcagacgtatgaatacaacaaagctgtttatcaaaattttgatgatgcagatacccgtaaggaagcgacctttatcgcctcatacaataaagatggcaaaacaggtgagttatctctctatggaacacatgtacgtaaaaatataggttatgtaaatgcacagggagcccgtgtttactgtggtgactatatcttctatcgcctgccgtgggtttatcttactcttgcagaaatagcaaacatggaaggagataatgcagctgttgccaaatacatcaacctggtaagaaaacgtgcctatggcaatgcatgggatgaaattctgtatgcatatccggaaacggcagattttacaactaatgaattggctattttgcatgagaaagataaagaatttatccaagaaggacaacgttggtgggatttacgacgtatgactttgactaaggggggaacacctttggttttctgcaaagaaggaagtcttttgggagatgccccgatattgaataaatctacagaagcacataaacttttgtggccaattgaaaaaacaatgttggataaagaccccgcactggagcaaacacccggatacaaataa

SEQ ID NO: 1092 - DNA, 1263 bp, B.fragilis
aatttaaatcaaatgaaaaatatttttttaataattggaatatcactgttttttaatggcagcctatatgctcagtccgatgactggtctcctaagaatcataatttaattaagtctgtacgtgaggacgggcgattctcaagttcttatggtgtagtgcatgccatgctcagaaatactgagccacgctatgcttttcatagagagttttctcccaaagaatttcgaaaatggcaaaagggacttcgccatgcgatggaagaaataatgaaatttcctcaaataaaaaactctccagctcctgtctgtataaaaagagaacagcgggaagggtatcgattagaaaaatgggaattttatccgcttcctgaatgcgtttctacttttcttgttttaatacctgataatataaacaagcccgtacctgccattttgtgtattcccggttccggaggaaataaggagggacttgcaggtgaaccggggatagctcccaaattgaatgaccggtacaaagatccgaaactgacccaagccctcaactttgtaaaagaagggtatatagcagtggcagtagataacccggctgccggagaagcctcagaccttgagagatatacattgggctctaattatgattacgatgttgtatctcgctatcttttagagttgggatggagttatttgggatatgcttcatatttggatatgcaggttttaaattggatgaagacccagaagcatattcgtaaagatcgcattgtagtaagtggattttctctgggaaccgaacctatgatggtattgggtacgcttgatacttcaatttatgcttttgtttacaatgatttcttatgtcaaactcaagaacgggcggaagtaatgactatgcctgacaaaaacggacgtcgtccattccctaattctatacgccatttaatacctgatttctggaaaaattttaattttccggacatcgtagcggctttggcaccccgtcctatcatactgaccgaaggaggattagatcgagacttggaccttgtgagaaaagcgtatgctatagcaggcactcccgataacgtgaaaatatatcattataagaagttctcagatccggatacacgaaaaaatgtagaatatttacctgaaggactagatcgtaatgaatattttcggatggtaaatgtagatggtcccaatcattattttaaatcagaactggttgtaccctggttgagaaaattattggaagaaagatga

SEQ ID NO: 1093 - DNA, 1632 bp, B.fragilis
aatacaagaaatatgaaaacaataaaatcaataattatatcaggcatgttactggtagtatctggtggcataatgacttcatgcagtgatttattggatttatctccaattgatttttacggaagtggttcttattggactactgaagcgcaagttaccggttatatggatggtcttcataaacatctgcgtgatgtagccgaacagcacatcttcacctttggagaactaaggggcggaatctatagaagtggtaatgcatctgatggtaacgcactgaattacggcagtattatattgcagaattttgataggaacaatactggtgtaaccggttttggagggcattatggacgcttggctaatatcaatttgtttattgaccgtgtgtcgaaagcagattatatagatgatgccaagaagaaattctatttaggacaggcatatggtttacgtgcttttatctattttgaactttatcgtatttatggcggtgtacctttgagactggatgtagaagtaattgatggagtacttgatcccaataaactgtatatggctcgtgcgacccccaaagaagtaatgacgcaaatcaagaaagatttggacctttcaatggagcattttggtaatgtaacagcttttgatccatataatcgcggtaaaaaagtatattggtccaaagcagctactgagtgtttgatgggagaagtctatctatggacttctaaagttactaccggtgacaatgaggccaatatcgctgacttggcaatagcgaaacaacatttacaaagcgtcattgataattacggtctgagcatgatggataatttttcagatgttttcgaagccaaatcccataaaggcaacaatgaaataatatttgcgattcgttatcttgaaggagaagcgaccaatagaaatgtcaactatacatacatgaatcagggagagatagataaaggaggttttcgtgaagatggaactccatggaacgatcctttaggattaaagaaaagtggtgctcaatggtgtgagtatattcctgaactctttcaattatttgacgtggaagacactcgtcgtgatgcgactttcctggcttcttataaaaaagataaagatggtaatttaagtctttggggaactcatgtccaaaagaatataggttacataaattctgaaggcaatcgtgttttttgtggggattatgctttttatcgtctgccctgggtttatctttcattagctgagatcgctaatatggaaagtgatcattctggtattgagaaatatatcaatctggttcgtaaacgtgcttatgcttccaattgggatgaaaataagcatggatataaatcaggagattttactcaaaatgagttggctatactacatgaaaaagataaagaatttgttcaagaagggcaacgttggtgggacgtgttacgcatgactctgacaaaaggcggtaagcatttagtattctgtaaagaagctaatttgaaaaatgatggagtaccaatcttgaatgaagcaacagaaagccacaaagttctttggccaatcgaacagaatatgcttgataaagacccctcgataaaacaaactccggggtatgataaataa

SEQ ID NO: 1094 - DNA, 216 bp, B.fragilis
gcgaaaaatggagagaaaagaaagttttgtgaatattttcaaacctctaaaaatcaagcatttattctttttcttgtattagtttttagcctccacaaagggcttaaaatgaatcttttagaaggggataaatctagtataaaaatcagactcattcatttactaaagaatgaattaatgatatttttccaaaatccaacagaagtgagatgttga

SEQ ID NO: 1095 - DNA, 1332 bp, B.fragilis
acaaaggatatgaagttttacaatagggagaatgaattagctgaattacaaaggatacaagaattatcttttgaagagaactctcgtctgacagtagttaccggaaggagaagaataggtaaaacaagtcttattatgagagcttttgaaaaaactcctactatctatttatttgtggggagaaaaaatgaagcatctttatgtagggaattcataactttagtttcccaagcacttgatatttatgtgccagaagaaatatcgactttcaaatctctctttcggtatattatggaagttgctaccagacagtcattcaatttggttatagatgagtttcaagaattctataatatcaataagtcgatttatagtgatatacaagatatctgggatcagtatagacaaaaaactcacatgaatttcgttgtgagtggttctatttattctttaatggaaaagattttccataatgaaaaggaacctctttttggccgtgctgacaatattataaaactttcagctttcagtctgaatgttttaaagaaaatcataaaagactatcatccccaatatacaaatgatgatttattggcactatactcattttccggtggggttcctaaatacgttgaattattttgtgataacagagtattaaccgttgatggaatgattgatttcatggtcagagacaactccccttttacagatgaaggaaaaaatctgttaatagaagaattcggcaagaattatggtacctatttctcaatcctaagtgctatctcaggtggatataatactcagacagaaatagaagcgttgcttggcgaaaagagcttaggcggttatctaaagcgattaattgaagattataacatagtagtgcgccaacgtcctgtcttttcaaaagagggttctcaaactgtcagatatgggatatgcgataactttattcatttctggtttaattatttcgatagaaatcgttcactcattgaaataaaaaatttcgttggcttacgaaaattaataaaagctgactatccgacatattcaggaaaaatcctggaacagtatttcaaacaaaaatatgctgaaagttacgagttccgtcttattggttcgtggtgggagcctaaaggcaatcagaatgaaattgacattgtagctatttatttagataacaaaagtgcaattgtagcagaagtcaaacgtcaaaaaaagaatttcaagccagaacttttccaaaagaaagtggaacacttagagaataaagtcctggctaaatatcaaataaacacagtctgcttatcattagaggatatgtag

SEQ ID NO: 1096 - DNA, 213 bp, B.fragilis
tgtccctgtatcgtgctaatcaaaggagtgaccggaaccgtaatagaaaaaacaaaatctgaaccatttcacaaaatcaaagggaaagtaaaattatcattctactaccaaatagaatgtttttacctatttacgacttattcttatttgggaaaatttcaaaaaaggaatattatcacatatttcttctttcttaatttcattgtcagatag

SEQ ID NO: 1097 - DNA, 3303 bp, B.fragilis
acatctttattattaactcaaaaagcaatacttatgaagaaaaccatcttcttgattttgtgcattttatgttctcttggagccatggcacaaaagaaatcaatcacaggtgtggttacggatgctagcggtgaatcagtcatcggagcgagtgttgtcgaggtcggtaccaccaatggtgtgattactgacattgacggtaagtttacgttgtcggtcgatcctaacggaaagatcagagtatcttatatcgggtatcagcctcaggtacttgatgtaaagggcaaaaattcttttaatattaaattgaaagaagactctgaaatgctggaggaagttgttgtaacggggtatggtggcaaacagctgcgtacgaaagtgacgaactctattgcaaaagtaaaagatgaagcattgaaagtcggcttattctctaaccccgctcaggcactctccggagcagttgcaggtttaaaggttacccaagcctctggtagcccgggtgcggctcctaaagtaacgcttcgtggcggtactaacttcgatggttcaggtgaccctctggttattgtagacggacaattgcgtgacggtatgcaggatatcaatccggaggatattgaatccatggaagtcttgaaggatgccggagcaaccgctatttatggtgcgcgagcaagtaatggcgtaattttaattactacaaaaacaggtaaagaaggacgtcgcgaaatcaacttcaaagccaaaatgggtttgagctatgtaaataacccttatgattttttgggagccaaagattatatcaacgtactgcgtacaggctatagtaaatccggatttacaacctcagacggagagtatgtctctattgccccacttggtaacttgacaagtgcttctccattcggtactggtaatacactgaatgataaaacgatctggaatattatgaataaaacggcagacaatgcctatctgttacagaaaggatggcaagaaatgccggatcctctggatcccagcaaaaccattttatataaagatactaatccggcagattataacctgaataatccggcaatatctcaggactataatatcaatatgtccgggggtaatgataagggtacttactatgcaggattaggttacaaccgtcaagagggacttcctatcaagacattctatgagcgctatagttttgttttgaatgccagttataaaattacagattggcttaccagttcatccaatttcaattataaccgtgcaaattggaaaaacatgccgggatcacaaaccagtgaaggcaattacttcggacgtatcatgtctacacctcccactgtccgcttccaggatgaggatggaaatccaactttaggtccggtagctggtgatggaaaccagaattatcagcccgacaaatggtggaattttaatcagagtgacaaatttaccatggtacaggccttccagattgatattttgaaaaatctttctgtaaaaggtactgccaactggtattactccgaatcattggctgaaagtttcaccagagactatgaaaacacgccgggtcaatttgtgagaacacgtagttcttcagcaagtttctccagagatttctctcagacctataatgtggtattaaactataatcaaactttcgctaaagatcataatgtggctgttatgttgggtatggaatattttgatagatatagccgcagctttagtgcatccggttcaggagctccaacggatgattttgccgatctatcattgacagataatggagaagggaaacgttccattgattcaggacatagcgattatcgtattctttcttatttcggacgtctgaattacgactataaaggccgttatttactttctgctgtcttccgtcaggatggatattcatctttattaggtgacaaccgttggggatttttcccgggagtttctgccggatggatttttggacaagaaaatttcgtaaaaaatgctctgcctttcctgtcatttggtaaattacgtgcgagttatggtgtaaatggtaacgcaaccggaattggcgcctatgacttacagggatcttacaattctcagaaatataatggaaatgtcggcttcttaatcggtgcactacccaacccgggtttgaaatgggagaaaacccgtactgcagaagtcggtatagatatgagtttttttgagaatcgcctgaacgcaaactttacctattataatcgtttaacttcagacaagtatgccaacttaagtttaccttctacaacaggtttctcgtcaattaagaacaataacggaaaatttcgtaatagtggtgtggaaatagaactgtcgggaaaaatcctaaaaaccaaagattggagttgggatttgggtggaaacatatcgttcaataaaaacaaaatagtttcgttgccggataatggcttaattcgcaatcaacaggatgccgctcaaatatacagtggaaggcaattatctgatggcacatatgagaagatttgggtcggcggtaatcaggaaggttatgaacccggtgtgttaattgcatataaagccgatgggctttatcgcagttgggatgaaattcccggagacttggtagtcacatccggtaactatttcggtaaaaagatgtatggaccggaagcttggaagaagttgagttccgcagagcaaaagaatgcattacccattcagcccggagatgtgaaatggagagatataaatggtgatggtatgattgataattatgatcaggttgttgtgggaaatacaaatccgcattggattggtggtttcaacaccacattgcgctggaaaaacttccaactgtacggacgctttgattttgcatttgattactggatctatgataatactaccccttggttcttgggttgtatgcaaggaacttacaatacgaccaaagatgtattcaacacttggtctgaagagaatccgaatgccaaatatccgcgatttgtgtatgctgaccagcttatgaatgcaaactattatcgtacttccacattatttgcttataaaggtaattatttggctatccgtgaaatatctttgagttattctttacctaaagcatgggcaaacaaggcttactgtcaaaaggtggatgtgtcgatcaccggacagaatctgggatatatcacatcggctaatgtagcttctcctgaggtttcaagtgcaggttcaggatatgctttaccaagaaccctcctgttcggattgaatgtaactttctaa

SEQ ID NO: 1098 - DNA, 990 bp, B.fragilis
cagccgatgcagatagtgctcgaccgcaaaaagtggggtggattgccagagaaatataatggaatcagtgatgcttgtatcctgaccgatgaaaagaacggtactatttatgtggcgggactctggatgtatggagtcttagatccccgatcgggtaaatgggtggaaggaatgacgcaggacagtacccgttggatacaccaatggcatgcgaaaggttctcagcccgggctcggggctaaagagacctgtcagttcttgattacgaaaagcgtggatgacggactgacttggagtgaccctgtaaatataacagcacaaaccaagaaaccggaatggtggctgtatgctccggcaccggggcatggcattactttgaaagacggtacattaatatttcccacacaaggccgtgataaagatggaataccattctctaatattacgtatagcaaggatgggggaaaaacatggatagcctctaagccggcttatcacaacactacggagtgcatggcagtcgaattacaggatggcagtgttatgttgaatatgcgtgataaccgtaatcacggtaataaaaaggtcaatggacgccgtatttgtgtcacctccgatctgggaagcacatggacggaacattccacttcccgaaaagcattgatagagcctacttgtatggcaagtattcatcgacatacttatcaggaaaacggcaggcaaaagactcttcttctattctgcaatccggagtcttatgacagtagagaccacatgacgctaaagtgcagcctggatgatggaaatacctgggattccggccggaaaatcatgttggatgagttgggaagttttggctattcctgcataacttcggtcaatgattctacgattggtgttttttatgaaagtagccaggcacagatggttttccaacaaatacagttgaaagagctcataggtaaaggtaaatcatataaagagagatag

SEQ ID NO: 1099 - DNA, 747 bp, B.fragilis
ttggagtggtcaccattgtcgtttcacaattgcaataaattgcggatgaattttaaagaaggagaagtactttattttaataaaccgttgggatggacgtcttttaaagtcgtggggcacgcccgttaccatatgtgccggcggatgaaagtgaagaaattaaaggttggacatgcaggtacactcgatcccttggcaacaggggtgatgattgtttgtacaggcaaggctaccaagagaatagaggagtttcagtatcatacgaaggagtatgtggctaccatacagttgggcgctactactccgtcttacgatctggaacatgaaatagatgctacataccctacggagcatattacccgtgagttggtggaaaagacgttgaaaacgtttgttggcgagatacagcagatacctcccgctttctcggcttgtaaggtagatggtgcacgcgcttacgatttggcccgtaaaggccaggaagtggagttgaaaccgaaattgctggtgattgatgagatagagttgttggagtgtaatttaccggaaattaaaatacgggtggtttgcagcaaggggacttacattcgtgcattggcacgtgacatcggagaggctttgcaaagcggggcgcacttgaccgggctgatacgtacccgtgtgggagacgtcaagttagagcagtgtctggatccggcaaagttcgcggaatggatagatcagcaagatgttgagatatctgattga

SEQ ID NO: 1100 - DNA, 429 bp, B.fragilis
gttatctgtccgttgtttactgtttattgtttaccgtttgttattattatggcaaataccctgtgcaaagccgaaaggctgaatagtaagattctgattgagaagatgtttgcgggcggctcaaagtcgttttccatctttccgttgcgtgtggtgtatatgcctgttgaaaatcaagatgttcaggcatctattttactgagcgtttcgaaaaaacgatttaaacgtgcagtaaaaagaaatcgggtgaaacgccagttgcgtgaggcttaccggatgcataaacatcaacttttgcagattcttactgataagcagcaacagttggctattgcctttatctatctttcggacgaattaacgtcctcggccgaaatagaggaaaagatgaagattctactggctcgtattagtgagaaactggtatga

SEQ ID NO: 1101 - DNA, 222 bp, B.fragilis
attaacaatacaggaagttataccaagaaattcgtagtaatcatcccttttcctgtatttaaaaaaagaaatgaagaaactctaaacttttggtataacttcctcttaatagttagcaggtacaagaatatgtttgactaccgtcaaaatgacagtttccccacttatcataaaccttgtagcaacgtcctactccgtcagaacacgtacgggagcaagtga

SEQ ID NO: 1102 - DNA, 1146 bp, B.fragilis
atcgaaatgacaaaaaataaattgctttcgtgtgttattggagtgataatcctatcactattggttggagcctatttctatcaacgaaataaggtggctgtacatcaacaggcggagaggctattcgtacagatgcttcaagaagagatagaaagaaaagaaagaaatttaaatctatttcatctgttttctgagagttcatctgatactttacctttgaaaatttgcattatcacagaagaggggaaaaaagagtatgaggttgattccctgaaaagtaaaaagaacatttctcagaacctgagaaaccggtcaatacactctatattatgtgagaaatcccatttattgccggattctttaaatgaacattggcagagtatgcttaagaaagatcacattgatacagagtccactatacatgtgcggatggaaaatcttcaaggaaagattattagttcatcaagtcacgatggtgtgtgggatacttcttctgggattataacttcatatataggtaatcgttgtgagatagaggtcatcggtcttttagcttttagttggaaaacaatattatggtatcattggcaaccttttggatggattgtaatttgtttgttattgatgcttttatttatctgcttttattataaaaaggtgaatcgccctccggaattaaaagaggttccttatgaggttgtcgttgaaaaggaagtcgttgttgagaaagaggtcattcgtgagataatagttgaaaaagaaacatctccggaaaaaaaggcacctttaataaagcaaatttgtaaagtagaaggacaactatatggtttacgttatggagttgtttttgatgcccagaatagagttcttaattgtaatggcaagaaaatgtctttgtccccccaacagtgtcagattctaaagctttttttagatgctcccgattatactgtgactgatgaggatattattaagtttatttggaaaggtcaatcgaacgttcagataaatacgttttgttctgccggaaacaaattagggaagagattagagcaagctggttgtggtgtttgtttcaggcgttttggaagcgatcgttatcgtatgttgttcatagacgaccttgttgataatgatttgacataa

SEQ ID NO: 1103 - DNA, 765 bp, B.fragilis
atttttaggacgttgaaaattaagaaagtattagtgtcgcagccaaagcctgcttcagagaaatctccttattacgacattgctgaaaagtatggtgtaaaaattgatttccgcccctttatcaaggttgagagcgtctctgcgaaagaattcagacaacagaaagtatctattttagatcatacggctgttatatttacatcgcgtcatgcgattgatcatttcttccatctttgtacggagttgcgtgtgacgatccctgagacgatgaagtatttctgtgtaacagaagctgttgctctttatattcagaagtatgtgcagtatcgtaagcgtaagatcttctttggtgctacgggcaagatcgaggatctgattccttcgattgtgaaacataaaacagaaaagtatctcgtcccgatgtcggatgtacacaacgatgacgtgagggatctgctggataaaaataacatccagcatacggaatgcgtaatgtatcgcactgttagcaatgactttatggagggagaggagtttgattatgatatgttggtattctttagtcctgccggagtatcttcgctgaagaagaacttccctgattttgatcagaaggacattaagatcggaacattcggatcgactacagcacaagctgttcgtgatgccggactccgtcttgatcttgaagcacctaacgtgaaagctccttcaatgacggctgccctcgatttgtttattaaggaaaacaataaaggaaaataa

SEQ ID NO: 1104 - DNA, 843 bp, B.fragilis
gtttgccgctatatgatttttgtccaggactctcttggcgcacaggaggcagatactgtgcagcatgtaattagtgcagccggtgctccccaggatacgttgggtagccgggtggatttacaggcggtaagtaagaccgtgaccggggcggagggtatgccgattccttattctccaagaacagacgatgggttggctatgatactgttgggatgtttttttgtttcagcgtatgtgttggcacgcagcaagaagtttctgttgcaacaggtgaaagattttatgttacatcgtgaaagaacgagcattttcgcttcttctacggcggctgacatgcgctatttgctattacttatcgtgcagacctgcgttcttggaggtgtttgtatttttaactattttaatgatatcaggcccgcattgatggagcgtgtttcgccgcatatacttttgggagtttatgtggctgtttgtttactctatcttttgtttaaatggattttatattcgtttttgggatgggtgttttttgacaaaagcaaaaccgatatatggctggagtcttattctacgctgatttattaccttggattcgctttatttccgtttgttttgtttctggtctattttgatttgaatgtcacctttttagtttcaattggttgcgttttggtaatttttactaaaatattgatgttttacaagtggttaaagcttttttcctgtaatatttatggggttttccttttaattttatacttttgtgcccttgaaatcgtaccttgtctgatagtgtatcaaggtatgattcagctaaataatgttttgataataaatttttag

SEQ ID NO: 1105 - DNA, 915 bp, B.fragilis
ttcgatgatttatgtattcagaaagaaacgctgatgaagagtaaaagcagaaataacgctgtgtcatattttgatatgcagttcatcacttccagtatcagtaccacgttggtattgctgttactggggcttgtggtgttctttgtattggcggccaataatttgtctgtttatgtgcgggaaaatattaatttttccgtgcttatcagtgatgatatgaaggagacagatattctgaagcttcagaaacggctgaataatgaaccttttgtgaaagaaacagaatatatctcgaaaaaacaggcattgaaagagcagacggaagccatggggaccgatccgcaagagtttttggggtataacccgtttacggcttcaatagaaattaaattgcattcggactatgcgaactccgacagtattgcgaaaatagagaaattgattaaaagaaataccaatatacaggatgtgctttatcagaaagacttgatcgacgcggtaaatgaaaatatccgtaatatcagtcttgttctgctggcattggccgtgatgttgacatttatctcttttgcgctgattaataatacaatccggctggctatctactcgaaacgtttcttgatacatacgatgaaactggtgggagcgagctggggatttattcgtcgtccgtttttgaaaaggaatatatggagtggggttctggctgcttttattgcagatacgatcctgatgggggccgcttactggctggtatcctatgagcctgaattgattcgggtaattacgcccgaagtcatgttactggtatcgggcgcagtattggtgttcggtgtggtcatcactttcttgtgtgcttatctttctattaataaatatctgaggatgaaagcaagtacgctatattatgtgtaa

SEQ ID NO: 1106 - DNA, 231 bp, B.fragilis
aacgtatatcttatgaaaatgaaaaactatttgaaagtaactgtattttgggtcgctgtcctttcggtttggtgcttaaagccgacaaaaaaatctcaagatactctcttgttgcagaatgtcgaagctttggcaagtggagaagagccttcacagattcattgttattggcgaggctctgtagattgtcctgttagccatgataaggtagaggttgtatatgagtactaa

SEQ ID NO: 1107 - DNA, 1314 bp, B.fragilis
ttcataattcataattttattatgggatatttattcacatccgaatcggtgtctgaaggacaccccgataaagtggccgatcaaatatcggacgctgtgcttgacaaactgttggcttatgatcccagttcgaaagtagcttgcgaaaccttagtaactaccggacaggtggtgcttgcgggagaagtgaaaacaggtgcttatgttgatttgcaactgattgcacgtgaagtgatccaaaagattggttacacgaaaggcgaatacatgttcgaaagtaattcgtgcggtgtactttctgccattcatgaacaaagtgcggacattaaccgtggtgtagaacgcgaagacccgatgaaccagggagcaggcgaccagggtatgatgtttggttatgcaaccaacgaaacagaaaactatatgccgttgtctcttgacctggcacatagaatacttcttgtgttggccgatatccgccgcgaaggtaaagaaatgacttatcttcgtccggatgcaaagagccaggtaaccattgaatatgatgataacggtactccggtacgcattgatacgattgttgtttcaacacagcatgatgaatttatattaccggctgatgattctgccgctgcccaactgaaggctgatgaagagatgttggcagtgatccggaaagatgtgattgaggtgctgatgcctcgtgtcattgcttctattaatcatccgaaggttcttgctttgttcaacgaccatattatctatcatgtgaatccgaccggtaagtttgtgatcggtggccctcatggagatacaggactcaccggacgtaagatcattgtggacacttatggtggaaagggagctcatggtggcggtgctttctccggtaaagatccaagcaaagtagatcgtagtgctgcttatgctgcccgtcatattgctaagaatcttgttgctgccggcgttgccgacgaaatgctggtacaggtttcttacgctatcggtgtggctcgtcctattaatatttatgtaaatacatacggacgcagtaacgtgaagatgagtgatggagagatcgccaaaaagatcgatgaactgtttgaccttcgtccgaaggctattgaagaccgcctgaaactgcgttatccgatttatagtgaaactgctgcttacgggcatatggggcgtgaacctcagatggtgactaagcattttcaatctcgttatgaaggcgaccggactatggaagtggaactgtttacatgggaaaaacttgactatgtggacaaagtaaaagccgctttcggtttgtaa

SEQ ID NO: 1108 - DNA, 1320 bp, B.fragilis
ttaaactttaaaacttattatcattcgatgaattttgtagaagaactaagatggcgtggaatggtgcatgacatgatgcccggcacagaagagttattggctaaagaacaggtgactgcttatgtgggtattgacccgacagccgattcattgcatatcggacacttatgtggtgtgatgatattgcgtcacttccagcgttgtggtcataaaccattggctttgattggtggtgcgaccggtatgattggcgatccttcgggtaaatcggccgaacgcaatctgctggatgaggaaacactgcgtcacaatcaggcttgtatcaaaaagcaactggctaagtttttggacttcgaatctgatgctcctaacagagctgaactagtgaacaactatgattggatgaaggagttcactttcctggattttgcccgcgaagtaggtaagcatattactgtgaactacatgatggctaaggaatcggtaaagaaacgtctgaacggtgaagcccgtgacggattgtcgtttactgagtttacctatcagttgttgcaaggttatgactttcttcatctctacgaaaccaaaggatgtaaactgcagatgggaggctctgatcagtggggaaatatcactaccggtactgaactgattcgtcgtactaacggtggtgaggcttatgcattgacttgtccgttaatcaccaaagctgacggtggaaaatttggtaagaccgaatcgggtaatatctggttggaccctcgttatacttctccttacaagttctatcagttctggctcaatgtgagtgatgccgatgctgagcgctatattaagatatttacttcactcgataaggcagaaatcgacggactggttgccgaacataatgaagctccgcatttgcgggtgctccagaaacgtctggcaaaggaagtaactgtgatggttcactctgaagaggattacaatgctgcagtagacgcatccaatatcttatttggtaatgccacttccgatgcgttgaaaaagctggatgaagatacattgttggctgtgttcgaaggtgttcctcaatttgagatctcacgtgatgcgttggtagagggagtgaaagcggttgatttgtttgtcgacaatgccgctgtatttgcttcaaaaggtgaaatgcgtaaattggttcaaggtggcggtgtctctttgaataaagagaaactggctgcttttgatcaggtgattactactgccgacttgcttgatgaaaagtatctgttggttcagcgtggtaagaaaaactattatttgattattgcaaaataa

SEQ ID NO: 1109 - DNA, 897 bp, B.fragilis
cccctgtttaatcaaattttatttcaaatgaaaaatcttatactggtgttaggttgttttttctttctaatctcatgtcagcagaccgagaaggaaaaacttgaagaacttgttaaaaattggaatgggaaggaggtactatttccgacaaatcctagttttacgttatatggaaaaactcctgtcgattttaaaatccctgtttcggattataagatcgtgacctatgtcgattcgttgggttgttccagctgtaaattgcaattgcctaaatggaaggaatttatgaaatatgcggattctatagtaggctatcaaataccggttcttttttttcttcatcctgctaatgttcgcgagatgaggtctgtgttaaaacaaaatcgttttgattatcctgtttgtatggatacggaagatacttttaataaagtgaataagtttccttcacagctaaattttcaaacttttttattagataaaaacaatcatgtaattgcgataggaaatccggtccataattacgatgtaagagaactctatatccatcttatttcaggaggaatagatggagattctctttcaaatatgcgaacagtgataaaaatagaggaagatatggttgatttggggagttttgattggagacgagagcagcatataacttttgagatacacaatattggtaataataatttggtcgtttatgataataagacatcttgcggatgtacttctgttgaatattccaaagaacccgttcagcccggaaagtctttagcagttaaagtaacttataaagcagaccatccggaacactttaataaaactattatactatattgcaatgcttccgcttctcctttggaattaaagataactggaaatgctaaataa

SEQ ID NO: 1110 - DNA, 183 bp, B.fragilis
tactttcttaattttcaacgtcctaaaaatttattatcaaaacattatttagctgaatcataccttgatacactatcagacaaggtacgatttcaagggcacaaaagtataaaattaaaaggaaaaccccataaatattacaggaaaaaagctttaaccacttgtaaaacatcaatattttag

SEQ ID NO: 1111 - DNA, 270 bp, B.fragilis
attatgagtaaaaagatttttgcggccctgatagtcgctgtagtcgcaacttttgcaggctacaatatatatcagtcacagaaaacagagaaaatagtttcagacttggtgatagctaatgtcgaagcattggcaggcgatactgagggcggtgctactatcacttgctcccgtacgtgttctgacggagtaggacgttgctacaaggtttatgataagtggggaaactgtcattttgacggtagtcaaacatattcttgtacctgctaa

SEQ ID NO: 1112 - DNA, 2031 bp, B.fragilis
ttattaataaaaggctctgtgatgctccgtggtgaaaagagttatatgaatatgaaaattatgaaatatattgggttaggcttgcttctgcttgtctgctcatgcgggggtagagacagacaagtggaggaggccttatccctttcgggcaataaccgtaatgaacttgaagcggtgctgaagcattatgaaggagatggccggaagctggaggcggcacgcttcttgattggcaatatgcccggaagttatggagctaatccgatagtagagcaggattgttctgctttttacgaggcttatgattcattgggacaaaagtatgactatcgggtaggaacggaatgggggaaacaggtagatagtctttggaaggattttagtaatcgacatcgggtaaggcaggaacttaactatgatattacccgcatgaaggcggaagatttaatccgggaaattgatctggcatttcgggcatgggtggagaatgtgcattcaagaaactgttcgtttgaagatttttgtgagtatatactgccttataggcgacagaatggcttattgattgacaatgcacgccgggagttcaacaaacggcatcagggaaagtattttgtgaaagagggaaaggattggcaacaagagatcgattcgttgttatatgaatataagtatctgactcattccggtttttgggggacgaagattccgatatggaatgcggtgactcttgagaagatgcgtcatgggttatgtgcacagcgctgttggtataactctttgttattatcatcattggggattccggttgccattgactttgttccggcatggggaaaccgaaataattcgcatacctggaatgtggtgctaataaacggggaatcgcatgcttttgaggcgttttgggataatgatcgctggaaatataagcggatttataataaccgggatgatgatgaactttggggaagattccgccttccgaaggtatacagatatacctactcaaatcatattgaaggaccgttggcagatgtagaggtggataaagctgatattccggagctatttcgtagtgtgaaaaaggtggatgtttcttcggagtattttgaaacggccgatgtaacggtggagttgacaggtgaggcgcctcaaggggtgaaatatgcgtatttggctgtgttcggatatcaggactggcaccctgtgcagtgggcaaagatagaaaatgggagggctgtctttcgggaaatgggtaaggacatggtttatttacccgtttattacaagcggggaggattattgcccgcagcagaacctttcagattgcggaatgacggaacgatggagaagctgagcggaaatgaaggaacagaggaggttgccgtgaggatggtgacgggagcgccggcttatgatcagaatagggaatatctggggtgtatgaaaggaagccggatagtaggattacttgatggaaaatcagaagaagaactgtgcagatggacggactcgctggctctgcagtcggttgtacggaaggtgtccgcacgattaccttaccgttttgtaaggttattattaccgtcggatagcattgctttgggggagctttctttttatacggaagaaggacggatcgggaatatgaggataattactccgatgagggctaccggaaggaatgaagtgcccgggatgataaccgatggtttgggggcgacgggctatcgaggcagggtggcagaaaggctggtagatatagatctgggaaaagagtatatggtcagtcatattggaatgacttcttacctgaaaacacagttgttctgtccggatgaatttgagttaagatattgggataatggttggaagactgtggagcgtaagcaagctgatcataaagggtatcttgtatttgagagagtgccccggggagcattgctgatgttgaaaaactgtcgctggaaaggaaagacggcagagcgtatatttacttatgaaaaaggagatgtgaagtgggaatga

SEQ ID NO: 1113 - DNA, 279 bp, B.fragilis
gtttttaaaaacattataagtatggtaaacttttcattagagggcaaagtggcatgggtcacaggtgcatcttacggcattggctttgccttggctactgctttctcggaggcaggagcgaagatcgtatttaatgacatcagccgggagctggttgataaaggcttggccgcatacaaagaattgggaatcgaggccaggggatatgtgtgtgacgttaccagcgaagagcaggtgaatgctttggtagcgcagatcctcttcaccgcggggctgcaa

SEQ ID NO: 1114 - DNA, 807 bp, B.fragilis
aacaggatggaatggtttgaagcactgatccttggattgattcagggactgactgagtatttaccggtaagcagtagcgggcatttggccattggttcggctttatttggtatagaaggagaagaaaatctggcatttaccattgtggtgcatgtagccactgtgttcagtacattggtgattctgtggaaagagatagactggattttccgtggtttatttaagtttgagatgaacagtgaaacacgctatgtaatcaatatcttgatttcgatgattcctattggtatcgtcggggtgttttttaaagatgaagtggaggccatttttggctcgggattactgattgttggctgcatgctgttgctgacggctgcgttactgtcgttttcgtattatgcaaagccacgccagaaagagaacatctcgatgaaggatgcatttatcattggactggcgcaggcgtgtgcagtattaccgggattatctcgttcgggcagtacgattgcaaccggtttgttattgggtgataataaagcgaaactggcacaattttctttcctgatggtgatgcctcctatattgggagaggcgctgctggatggtatgaagatgataaaaggtgaggctattgcgggcgatattcctactttgtcattgatagtaggtttcattgcggcttttgtttcaggttgcctggcttgtaagtggatgattaatatcgtgaagaaaggtaagttgatttactttgctatttattgtgcaatagttggagtggtcaccattgtcgtttcacaattgcaataa

SEQ ID NO: 1115 - DNA, 246 bp, B.fragilis
ataatattttggatttattgctacttttgcttcgtattaacagactaccttatgaaaaataaactaaaaaccgcttttacattattggtgtatattgctgtcacagtgggtatttacgccttaatctgtcatctgaatcaccagcccttcgacgatttgcgcatactgtatgccgtactgatcggctgcgtagcctaccttccccgacacctgatggttcgcaaatcacgaaagagccagaaatag

SEQ ID NO: 1116 - DNA, 258 bp, B.fragilis
ggcgagtgctgccagttgtcttatttgtctttgatagtcgctgtagtcgcaacttttgcaggctacaatatatatcagtcacagagagtagaaagtatcatgtcggatttgacgatggccaatgtagaggcgttagctggttctgagattaatgatgaggattgtgtcagtgcatctaatcgttattgctctgttttgatagtgaccccaaatgggaattatctagaaacttattttgaccaaaaaacaaagtactga

SEQ ID NO: 1117 - DNA, 1584 bp, B.fragilis
tcaatgaaacgtcgcgattttctgaaatgttcacttgccgtgggagcaggtttggcagcctctccgtcaacctatgcgtttaatggcgaaagcaaagagaccggtaatgattcttccaaactgtcaaaggctcctgccacaaagggagggaagccgcatatcatttttattatgagtgaccaacatcgtggagatgctttacattgcatgggcaataaggcggttatttctcctaatatagataaactggctcaggaaggcagtttgtttgtgtgtggttacagctctgcacccagtagtacgcctgcacgtgccggtttgctcacggggatgtctccatggcaccatgggatgctgggatatgggaaggtggcttccaaatataaatatgaaatgcctcagatgttgcgtgacttgggttactacactttcgggataggaaagatgcactggtttccacagaaagctttgcatggttttcatgctacgttggtcgacgagagcggacgcagtgaaacccgtgattttatcagtgactatcgggaatggtttcagttgcaagctcccgggaagaatccggatttaacaggaatcggctggaataatcataatgccgggacttataaacttgaagagaggctgcatcctacggcctggacaggtcagacagcttgtgaattgatacgcaattatgatagcgatcaacctttgttcctcaaggtctcttttgctcgtcctcatagtccgtacgatcctccgaaacgatatttggatatgtatgagaaggtagatattcctgtaccgttcgttggagattggtgtgggaaatatgctgaacgcaaagatccggaacgggtttcaaaggatgcggcttttgcaaatctaggcgaagagtatgctgtcaattcacgacgccattattatgcaaatgtgacatttattgatgaccagattggacagatcattcagattctaaaagagaaaggaatgtacgaaaatgcaatcatttgctatacggccgatcacggtgatatgttgggagatcattatcattggcggaaaacctatgcatacgaagggtcggccaagattccttatatcataaaatggccttctgccatgactacacaggctatcagaggaaagcggattgaacagccagtagagctacgcgactttttacctaccttcattgaacttgcgggagggacggtaccggatgatatggatggaaaatctttggtagccctggcttcaggaaataaaaacggctggcgaaaatatatcgatctggaacatgccacctgctacagtgccgataactattggtgtgcgttgactgatggtaaaatgaagtatatctggtttattcatacgggtgaagagcaactgttcgatttaagttcagatcccggtgaacagaagaacctttccggaaatagtcgttatgcagataggctggttgaaatgcgtaaagcgatggttgaccacttgcaagagagaggaacagagtttgtaaaagatggaaagctggcggtaagagatcaaaccttactttatagtcccaattatccgaaagattga

SEQ ID NO: 1118 - DNA, 273 bp, B.fragilis
aatgatagaagccacaccttgcaaaggctgcataaatatggacgtgtcacacagcatcaagcattggaacctccagataaccaatggaccggaatgcaggcaaagtcacaaaaagatgctttcgttcatctctacatttatgttaatacactattgcggaagtcttcaaattataaaaaagataatccgcttacatggtggaaagttgattggcagctatcacggacggtcaataactctccgggttactgtacctatcaacggatattgtaa

SEQ ID NO: 1119 - DNA, 2079 bp, B.fragilis
cgcccgtgcggatccttccagccccgtggtgaagaccaggtcacggctttcaataccggctggcaatttaagaaaggtccttttgctacagatccgatgcgggccgcctcccaatgggatggaaagtgggaaacggtcgaaattccacatacctggaatgccatggatatgcaggtacagtcgggctctttctacgaaggggcaggctactaccgcaaaacacagttctttcctcacgacttggagggtaagcgtgtttttttgcgtttcgaaggggtaggagcctgtgccgaagtgtatgtcaacgggaaactggcaggtacgcacaaaggtggttattctgcctttgcatgcgaaataggtacagcgctcaaactcggtgccgagaatgaaatcattgttaaagccgacaataaagcccgtcccgatgtaattccggtcaatcaaaaccttttcggtgtctacggcggtatttatcgtcccgtatggctgattgtaaccgaacagaataacataacggttaccgattgtgcctcgccgggtgtctacatcacccaaaaggatgtatcgaagaaatcggccgatatcaccgtaaaagtgaaattggataatgcaggacttcaacctgctgctgtaacactcgaaaacactatttatacgcaggagggccgaaaagtcggtacacacagccggtcgtttgacttgagtccgcaagggacacaaacttatttgtccacttttaaactgaagaacccacatctctggcagggacgtaaagatccgtatctttataaagttgtctgcaggctgatggcagacggaaaagtaatcgatgaagtggtgcagcctctcggggtgcggaagtatgagatagtagccgggaaaggctttttcctgaacggagagaagtacccgatgtatggtgtgacccgtcatcaggattggtggggattgggtagcgcccttaaaaacgaacatcacgatttcgatttggctgccattatggatgtgggagccactactgtccgttttgcccactaccagcaatcagactacctttattcccgctgtgatacattgggactgattatttgggccgaaataccttgcgtgaaccgggtgaccggatacgaaactgagaatgcgcaaagccagcttcgcgaattgatccgccagagtttcaatcatccttccatttatgtatgggggcttcacaatgaagtatatcaaccacatgagtatacagctgcattgacccgttctctccatgatcttgccaagacagaagatccggaccgttacaccgtttcggtcaatgggtatggtcacatggatcatccggtcaacctgaacgcagacatacagggtatgaaccgttattttggctggtacgagaaaaagatacaggacatcaagccatgggtggaacaacttgaaaaagactatccctatcaaaaattgatgttgaccgaatatggtgccgatgcgaatctggctcatcagaccgaataccttggggatgccctgaattggggaaagcctttttatccggaaacatttcagactaagacacatgagtaccagtggagtattatcaaagaccatccgtacatcattgcttcttatctctggaacatgttcgattttgccgtacctatgtggactcgtggcggtgtgcctgcccgtaacatgaaggggctgattaccttcgatcgtaaaacaaagaaagactcttatttctggtataaagccaactggagcgaagagccggtactctatctcacacagcgtcgcaatgccgatcgtgaaaagcgaacgacagccgttaccgtttattccaatatcggaattccgaaagtatacttgaatggacaggaactgagtggcattcgcaatggctataccgatgtacattatgtgtttgacaatgtatcacttgccgacggaaaaaatatactgaaagctgtagtctcaactaaggggaaggaatatactgacgagattgaatggaattattccggtgagaaaaacagggaaatcgattcatatgaaaataagaatgaacattcgggcttttga

SEQ ID NO: 1120 - DNA, 240 bp, B.fragilis
ataacaatgggtgataaacaaaaatttgccttcgataaaacgaacttcattctgcttgctatcggcatggcagtggttattctgggctttatcctgatgacagggccttcatcgtcggaaacggtgtttcaggcggacattttcagtgtgagaagaattaaggtggctccggtggtctgtttcctgggctttatttttatgatatatggcgtgatgcgcaaacccaaaacaaaagaataa

SEQ ID NO: 1121 - DNA, 204 bp, B.fragilis
ggtgttacggggttgcttgatatgtatattttttgtttttcaaatttttctttatgcagggatggaacagacaagcgggaggaggctttgttattttcgggcaataaccgtgatgaatttgaaacggtactgaatgcaatctatcttggaggaatattggaattagttgactcgtacaagagttcttgtttgcgtgtgaaatga

SEQ ID NO: 1122 - DNA, 1065 bp, B.fragilis
tttattattatgaataaaattgtatcgttttttattttaattcttgtttgttcttgttcagataggaaagagcatatagcaaatattctgtcaatgaattctatagatattaaaactaataggattaataaagacgaagtaattgctagaggtgcatttccttttgaaatgattgattcattattctttcttttcaatggagatccttcgtctggagcattggttttatgtgaatcgaatgcttccgaactgggacacttcttgcaaaaaggaaatggttttggagaatgtatcactcctggatatataggacattgcaatgatactatttatgtttctgaacgttctagaacaaggcgaatgacttatttactatcaaatcataatgatagtttgcaatataagtgtcttgaagatgttagtcctaaaatgaattcagaattttattatcagatttgtcgtctacaaagtggtttatttgtaggtgcccgtttatttggaaaagaacatttgtttacattgttagacgaaagtttggatacacttaccacttttgcacgggtgccgatagacattgaggaaaatgcaaataataagctcgctccttttattggtcatttatgtatagatgataatacggtttattatgcttctaatgacttttcttatatggctgcttatgatattttatctgagaaagagataaaaccagtatttgagaggatgtatatatctccaataatccaaaaatcagcgaatgggatttcattagataaatacaaacatcttttgggctttggtgatatcagggtttatcagaattatatttttgcgacgtatatagggaaacctgatataacaatggatcaagagaatgatatttcagctttagtccccactcatttgctggtttttaataaagatggagttccaattgtaaaatttaagtttccgtttaaaataagatcattcgtgtttaccaaatccaagatgtatctattagatgtggattgtaatatagaatctgtcgatttggtagagttgtggaagcatttgcccgattga

SEQ ID NO: 1123 - DNA, 1074 bp, B.fragilis
acgcacattattatcatgaaactgtcgcaatttaaatttaagttacccgaagaaaagattgctttgcaccctacaaagtacagagacgagtcgcgcttgatggtactccacaagcgtacgggagagattgagcacaagatgtttaaagacatcctgaattattttgatgataaagacgtgtttgtattcaacgataccaaggtgtttcctgcacgcttatacggaaataaggaaaaaacaggtgcgcgtatcgaagtgttcttgttgcgcgagttgaacgaggaattgcgtttgtgggatgtattggtagatccggcacgtaaaatccgtatcggcaataagctttactttggggatgatgactcaatggttgctgaagtaattgataatactacttcacgtgggcgtacgcttcgttttctgtatgacggacctcatgatgaatttaaaaaagcattgtatgcattaggagaaactccattgccacatacgattctgaaccgtccggttgaagaggaggatgcagaacgtttccagtctatcttcgctaaaaacgaaggggctgtgacagcaccgactgcaagtctgcacttcagccgtgagctgatgaaacgtatggaaattaagggaatagactttgcatatatcacattgcatgcaggactcggaaacttccgtgatatcgatgtggaagacctgacaaagcataaaatggactctgagcagatgtttgtgacggaggaggctgtcaagatagtgaatcgtgctaaagatctgggtaagaatgtatgtgccgtgggaacaactgtaatgcgtgctattgaaagtacggtaagtacagacggacatttgaaggaatacgaaggatggacgaacaagtttatcttccctccatacgactttactgtggcaaatgccatggtatcaaacttccatatgccgctttctacgttattgatgattgtggctgcttttggtggctacgatcaggtgatggatgcatatcacatagcgttgaaggagggttaccgctttggtacttatggagatgcgatgctgattttggataagtga

SEQ ID NO: 1124 - DNA, 852 bp, B.fragilis
ataagaaatatgaaaacaaactatgagattcgctatgctgcccatccggaagatgcaagaagctacgacaccaagagaattagaagagattttctgatagaaaaggttttttcagccgatgaagtaaacatggtatattccatgtacgaccgtatggtggtaggtggggccatgccggtaaaggaagtgttgaaattggaagctatcgatcctttgaaagctccttattttctgacccgtcgtgaaatgggtattttcaatgtcggggggtccggtatcgtgagggcgggtgatgcgatatttcagttagattataaagaggcactttatctgggggcaggtgaccgggacgttacctttgagagtacggatgctgcacatcccgctaaattttattttaattcactggccgctcatcgcaattatcccgataaaaaggtgactaaagccgatgctgtagttgctgaaatgggaacgttggaaggttcgaatcatcgtaatatcaacaagatgctggtaaatcaggtgttgcccacctgtcagttgcagatggggatgaccgaactggctccgggaagtgtgtggaatacgatgcctgcacatgtccatagccgtcgtatggaggcttatttctattttgaagtaccggaagagcatgctgtgtgccattttatgggtgaggttgacgaaacccgtcatgtgtggatgaagggcgatcaggcagtcttgtcaccggagtggtctatccattcggctgcggcaactcacaattatacttttatctggggtatgggaggtgagaatcttgattatggcgaccaggacttttcattaattacggacttgaaataa

SEQ ID NO: 1125 - DNA, 639 bp, B.fragilis
tctatggatattctcgatatacatacacatcggatgcctgttgaacttggacaggcgatacaaaattgtcagcccgcagagtttgatccgttggccggtgcttattattctgtcggaattcatccgtggtatctgactcgtgaaaaccttgaccggcagtgggagatgttgcttgcagcgatacagtgtccccaggttctggcaataggtgaagccggtcttgacaaattggttcggacagactatatgttgcaacaggaagtatttgagaaacaggctatgcttgcacacgaaatgaaatatccgttggtgattcatgcagtgcgttcggcgaacgaaattatctgcctgagaaaaaaaatgaaaccctctaatccttggattatacatgggttccgtggaaagaaagaactggctttgcagtacatccgggaagggatctatgtttcattgggtgagaaatatcaggaggaagtgctttggggcattcccttggaatatttatttttggaaacggatgaaagtatgatagatattcattgcctttatgaacgtgctgctttgctattggagatacctctttgcaaacttatgcaacaagtgcgtcaaaacattaataacgtcttttttaggcaataa

SEQ ID NO: 1126 - DNA, 231 bp, B.fragilis
gaaactggtatgaaaggcctgttgtcatatatattgttgcttcctatctacttttacagagcatgcatttcgcccatgactcctccttcatgtcgtttcactcctacttgttcgcaatacgctattgaagcgattaagaaacatggcccttttaagggactttatcttgctgtcagacgaattctccgttgtcatccctggggtggatcaggatacgatccggttccttaa

SEQ ID NO: 1127 - DNA, 606 bp, B.fragilis
actaaacccatgcaagaaatgaaccaaataacttccgtatgcgtatattgcgcttcaagtacaaaaatagaccagacttattttgatgcagccataaaattagggcatctgttggcaaaccggcatatccgtttgataaatggagcggggaatataggattgatgcgttcggtggctgatgcagtattgcagaatgggggagaagtgaccggagtaattcctcattttatggtagaccagggatggcatcacacaggattgacagagcttatcgaggtagaaagtatgcacgagcgtaagaggttgatggctgaaaagagtgatgccgtgattgcactgcccggaggatgcggaactttggaagagctgcttgagattattacctggaaacagttggggttgtatcttaacccgatcgtgatattaaacactaatggtttctttgacccgttgctggagatgcttgaaaatgctatagaaggtaatttcatgaggaaacagcatggagatatctggcatgtggcacatactccggaggaggctgtagagttggtttattccataccggtgtgggatggttctattcgtaagtttgccgctatatga

SEQ ID NO: 1128 - DNA, 1128 bp, B.fragilis
actgactttttggttagggtgttacgggtttgcttgatatactttaaaaatgaaatatacgttagttgtttaaaaataacgaagatgaaacaaaaatatatcttatttctttcattgtgttttgtgcttttttcatgtaggaagaacgatgttggttcggtctattcatttgacacagtatgcaaaattgtagactataatcttatttgttcagatgaaaatgctccttggggagctataatgaatatggaaatagtagacagcattttaattctccagcatgcaatggatgaatatgcattttcatttattaatgtaaataatggggagctattatctcaatgggggcgtacaggcgaaggaccagaagagtttatagattttgggtctggttttgaaatcgttgactcgagaattgtttttctggatcgaatgaagaaagaaaggatttcggtattattatctgatatcttaagcaaaaaagaacatccggatataacaagggaggcttatccttataatgtggatttcagggttttggagattaatgctgttggcaataaaaaaatagtaacaggcgggtttaagaaaggttattggggagctcttgactcacagaatcatattatacctaatgtggcagagcttcctttcgatgcgggtgaggtgtccggtttagagaagggtatcgttttcggaggtatattgaaggcaaatagtaaacaatccaaatttgtgctttcaatacgtgcttctgatattttcgaaatttatcgtgtttctgacgatggaataaatcgtgtctatgtgagtccttttaagcatattccgaaaacctggaagaagggaggcggttatgcaattgattataaccaaagtattggaggaataaaaaatatagcagtctcggatgacttgatttgtttttcactctttttacaaaattacaatgaggctgcaaaaacagactttgcgtctaatgaactgttctgttttgattgggatgggaataaagtgaaaaaatatgtgttaccttttcctataggtaatttctgtattgatggaactcatatctatggagttcggaactttgaagataaaattatcatttatcgttttaacatgtaa

SEQ ID NO: 1129 - DNA, 3297 bp, B.fragilis
agtaaacaaataaattcagtaagtatgagaaaactttttgtatgtattgcactgggtctcaccacgcttaccggcaatgccacatcaccgctatggatgcgcgatgtacagatttcgccggacggaacagaaatagcgttttgctacaaaggagacatttataaggtatctgcgggaggaggaacagccatccagctcacaacacagccttcgtatgaatgtacccccatttggtcacccgacagtaaacaaatagcttttgccagtgatcgtaatggcaactttgatatttttgtaatgcctgcgacaggaggtacagcacaaagactgactacccattcttcatccgaactgccttcggcttttacaccggatggaaaatacattctcttttcagcatccatccaggatccgtcacaaagtgctttgttcccgacaacagccatgacagaactatacaaggttcccgtgaacggaggacgtacggagcaggtactgggtactccggccgaagccatttgttatgcgccatcaggagagttctttctctatcaggatcgtaaaggttttgaagatgaatggcggaaacaccacacttcgtccatcacccgcgacatttggctgtacgacactaaaacaggaaaacataccaacctgaccaatcatgccggagaagaccgcaatcccgtactttcaccggacggaaaaagcgtatatcttttaagcgaacggaaagggtcatttaatgtttatagttttccattggacaacgcacaagacctgaaagcagtaacatcgttcaaaacacacccggtacgtttcctgtcaatgagtcacggcggaacgctatgctatgcatacgacggagaaatatatacccaaaaggataatgccactccacagaaaataaacatagatattgtccgtgatgatcaggacaaaatagcagacctgacttttacaaacggggcaacatcagggactgtatcaccggatgggaagcaaattgcatttatcgtacggggagaagtatttgtaacctcaactgattatgcaactacaaagcaaatcacccatacacccgcacgcgaagccgggttaacatttgctccggacaatcgtacactggcttacgcaagtgagcgtaacggcaactggcaactttttcttgctaaaatagcccgtaaggaagaagctaatttccccaatgccaccatcatcgaagaagaggtgctgttaccatccgcaaccgtggaacgggcctatccgcagttctcaccggacggtaaagagctggcatttatagaggagcgtaaccgtttgatggtaatcaatttggatacgaaaaaagttcgtcagatcaccgatggttccacctggttcagcacagatggaaacttcgactatcaatggtcacctgacggcaaatggttcaccctcgaatttatcggcaaccggcacgatccttactcggatataggattggtaagtgcaaagggtgacagtccgattaccaacctgaccaacagcggttacatgagcggatctccccgttgggtactggacggcaatgccattttgttcacaaccgaacgatatggtatgcgtgcacatgcttcctggggttcacagaatgatgccatgctggtatttctcaatcaagatgctttcgacaagttccgcctgagcaaagaagattatgaattgcaaaaagaactggaaaaggaacaacagaaagacaaagaaaaagcctcaattgacccgaaaaaagataagaagaaggatccccaaacagatactgagaagaaagatgagatcaaaaatatcctagtagaactgaatggccttgaggatcgcatcatacgcctcactcccaactcttcgaacctgggcagtactattatctcaaaagacggcgaaactctctactatctgtcagcattcgagggcggatttgatctatggaaaatggatctccgtaaaaaagagaccaaactgcttcataaaatgaatgccggatgggcttctatggatatggacaaagatggaaaatccctgtttgtcctgggaggtaatgccatgcaaaagatggacctcagcggagaaaccctgaagccgatcaactataaggcagagatgaaaatggacctggctgctgaacgagaatatatgttcgaccatgtatataaacaacaacagaaacgtttctacaacaccaacatgcacggagtaaactgggataccatgtctgctgcttatcgtaaatttttgccacacatcaataataactatgactttgccgaattactcagcgaatggctgggagaactgaatgtatcacataccggcgggcgtttctctccatctataccgggagatgccacagccagtctgggggtacttacagattggaattataaaggaaaaggcgcatcgatcatggaagtgattgagaagggccctttcgatcacgcccgctcgaaagtaaaagccggaactatcattgaaaaaatcaacggacaggaaataacccctgaaacagactatcatacgttattgaacgacaaagcaaacaaaaagacactcgtttcattatacaatccgcaaagcggtgaacggtgggaagaagtagttatcccgatcggcaacggaatactcaataatctgctctacaaacgttgggtgaaacaacgcgcggccgatgtagataaatggtctgacggacgtctgggatatgtacatatacaatcgatgggtgatgacagtttccgttccgtctactcagatattttaggaaaatacaataatcgcgaaggaatcgttatcgacacccgtttcaatggcggcggccgccttcacgaagatattgaagtattgttcagtggtaaaaagtatttcacccaagtcgtccgcggacgcgaagcttgcgatatgcccagccgccgatggaacaagccgtctatcatgctaacgtgtgaagccaattactcgaatgcacatggcacaccatgggtatacagccatcagaaactaggtaaattggtgggtatgcccgtaccgggaaccatgaccagcgtttcttgggaacgtctacaagacccgtctctggtattcggtattcccgtcataggctatcgacttccggatgggagctatctggaaaacacacagttggaaccggatattaaagtagccaactcaccggaaacaatcgtcaaaggggaagatacacaattgaaaacagcggtagaagaattgctgaaagaactcccggcaggcaaagggaaaaagcattaa

SEQ ID NO: 1130 - DNA, 1773 bp, B.fragilis
gaacataaaattaaaatttatctagctataattatgaaatcaattctcactttcttactaattatcttaatggacatacaatttaattacgcatgcccttgtagcccaaccaatacacttattgaaatgaatgaaagtttcgcgagtcagtttcaaacggccaccattattccaatgttcttatggcaaccgtcatggtcttatcctattgagggcctggcaatagggttacttatctcccttatcgtatattaccgaatggtatacagcacaaagctatttcctcacgaaaagctgagactgatcttaaacataacccataaaactcagacaccgttaactttgatccaccacctactggaagaaatcatttcggacagtctctccgaatctacatcccaaaaagtaaagcggatacttagatacaccagtcatattatgagttgctaccagaacattgcggtattcgacgataaggagaatgaactgcacccgggctcctctcccattgaattcgaactttacacttttataacctcaatcgtcaaccaatgccgggcgtacgccgatactcgtcaaataaaattaaatattaataaagacttcagttatatcagttgccgggtggacgaaataacgatgactgccgctctgcaatgcctgctgaataaaatgatagaagccacaccttgcaaaggctgcataaatatggacgtgtcacacagcatcaagcattggaacctccagataaccaatggaccggaatgcaggcaaagtcacaaaaagatgctttcgttcatctctacatttatgttaatacactattgcggaagtcttcaaattataaaaaagataatccgcttacatggtggaaagttgattggcagctatcacggacggtcaataactctccgggttactgtacctatcaacggatattgtaataccatccaatgtccggaagtagtgcctcctgtaatgaaagatgataaaatcatccgtcccgataaaaaacagcatcacatactgttggttatggcagatacagagttaagcaactatttgcataaggcgttctccatacttttcagaataacgatccttgaaaatccggaacagatattacatttctcgggagatcggctaccggatattatcgttattgacgaaacggtaaacggcatacgcggcaaggaaatctgttctaaaataaaatcgaatacaagcatggttcatattcctgtcattctcctgatcagtaacaatgataacggaagttatcttgcccatgcggactgtggagtagataaattggaaccccgcgcaatcaatatttgcagactcaaaatggatatacaaatacttatcaataagcatgaacgtatcatgaaactcctggagaaaaacctgtcggacaatctgccttcaccaactgcaaaaagtgaagaggacgcactgttcataaacaaagtgaacaagcttctggaaaagaatctttcaacagaaagctatacagttgacatgttaagtgccgatatgggaatgtgtcgtaccaaattctacaccaaaataaaagaaattacagacaagacacctacagaatacatgcattatttcaaaatgaataaagctaaaattttattggttacccaacaatatacagttacggaaatagccacttttctaggcttttgtaatgccaaatatttcggaaaacgatttaagaaattctataaagttccacctacacaatatattaaagaggttttctaa

SEQ ID NO: 1131 - DNA, 1131 bp, B.fragilis
tgtaataaaattatgaagaatatcttgttaacacttctcttgtttatacttttttcatgtagaagcactggagataaaaccgactgtgaagtattacatgtcgatttggttgaacgccctgttccaacagaagaattattttctaaaatatctgtcattccattggaaaccaatgatagttcctttcttgtaaggcctgtgaaagttattataaaagataacagatattatattgtcgatgaaggggttccggctgtgttttcttttgatgaagaagggcatcttttgcataaaataggtaaaaagggacaaggtcccggagagtatcgtgaaatatacgatgccgttattaaagaaaaagaaaatacagtgtatatgctgtctccatttggctctctttatgtgtattctctggatggaaaattcataaaagaaataaaactgccaactaggtcgaattatcaattgatagaggagctggatagtaagtatttcgttacatggacattacctgcttctgagaatgaaaattgtatcagcgttatttctaaagagtctttcaataatgtgaaagaattttggcatgtccctcccgttctcactactctgaattctaaacctttttataattatgaacataaagtatatttttcgaatccttatcaaaatgaagtatatgaagtaaggacagatagcttacgggttgcataccgttgggattttggaaaagataatcttgatttgaaggagtatggattcactttattagaggatcaaaaggttgaggaatataaattaatgttgcagtgtttacgtgattctactgtaccttatttattaaggcatcaatttcagaataaaaaatattattataccatgttgacgtttggctttcggcatcggataaatctgttttatcgaaaggatgacggcaagagtttcttttttgagaaaacagcggaaggtgttttgctccatcctttagcctttaatgaagattttctgacttgtattgttttcaatgaagactttccaaactatgaaaaagtgcttccttcggaggaatataagaagctggaagagcgtttagaagatgataacccctgtttaatcaaattttattttaaatga

SEQ ID NO: 1132 - DNA, 1068 bp, B.fragilis
ctttatagaataaatatgaataatatgagatttaatttagtcgttttatttgtaattttactttctttctattcttgtggcagggaagaaaaaactgtgtatgattttcctttagaacaatcgcttaagagtgataaggaagttagtttaaacaaggaactattagctccctatctgatgtgttcttatgattccactctgtgtctaatagattggactgccaatccgatggtgcatgtttataacatgaatacagggaaagagatggttgcttttgggaataaaggcatgggaccggatgattttctatctatatcccaaatgtatgtagatatgggcaagcgttctttggtactgtatgatcagtctttgcaaactataagttcttttcaaattgatagtttagctcaaggcagtctttcaaagatagattgtgtttcagctcctaagttaggaatgaatagggtatatgcttattcggattccatattttacggaagtgggacttttgaaagtggcttgatagcgaaatgcaatcagaaagagattttaaatcaatatctcccttttccacacacagagcaagcggtaaatcgggatgtaaactatttgttgtttcagggggatcttattatgaagccggataaaaaacgttttgcttacttggcgtatgagtgcgatttattatctattcagaaagtggtaaatgacacgtgcctggaaagtgtagtacatttgaatacgtatacgccgttatttgagaatcaatctactaacgaagtgtcttctgttaatgtctctaccgattctcctaaaggatttcttcgtggggtagccactgaaaactatgtttatgcactttacagtgggcaaattgggaaaaataaggcaatagcaaatgaaatttatgtatttgattgggaaggacgtgctgtaaagaaagtgatactggatagatggggtgtatgcatctcggtggatagtaatgatgaacgactctgcctgatgacaaaggaaacggatggtggagaagagcgttatcattattattgttatcagttaaactga

SEQ ID NO: 1133 - DNA, 1080 bp, B.fragilis
attaaaaagatcatgggaaaatatatcagtatattaatcttaatagagactattcttttaggatgtcactcgacaaaagagaagattgagttttcaaacagagtgatttgtagcgatagcatatcgcgagaactggttgttttaaatgatacgtttttattttcgtatcctttgcaaatagaatgtatagactcaatgctactggtattggataatgttaataataatttcttccatctatttactctaaagggtgtacccataaaatcatttggagaaaaagggcaaggtcctattgactttataaatgtggaatcattcaatttatctgaagatagaaaaatcatgtatgcctacgatacgtcattacgtaaaatagtgaaatatgatgtttcttcttttttgaaagattcattgaaatctgaggttatacaggtgaattatgatagcttgcctcaaaccgaagtgcctacaataatctatgatatgctttctcttaaagattcaaactttctggtaaaagcaaatcataagggccttcggtttggattattaaaagatggaaaggttactcaattatacaattctttctctgattgtgtaaatacgaacgatgacgaagaagtctggtcagttttctgtagcaataccaaaaccaaattaagacctgacaggacaaagatgttgaatgcaacctatcttggaggagtattggaattgtttgatttggatgataattgttccttatcattggcaaagatactttatatttacgagcctaaatatggtattgccgaaggggcaatacctaaatatgttgttttcaatgaaacgactcagattggttttgaggacatatatgtaaccaataatagtatatatacattattacatagtatagggagtgaaactttaccttcggaaattactgtatttgattgggcgggaattccaataactaaaattaaaacagggtgctccctctctaatattgccgtcgatgggaaggataacacaatctatgtaattgccgagaacgaacagaatgcttatgagctttcttgtttgtctttaaattga

SEQ ID NO: 1134 - DNA, 246 bp, B.fragilis
cacttatactttgaagccatgaaaaactatatgaaattaatctttgggttaatagtcttgatcgggtattggcctaccacgaaaattcctaagagagtaaattccctatttttgcaaaatgtagaggcgcttgccggcagtgaacacgttaccaatttaggttgcttgggtgacggatctgtagattgtcctattaaccatatcaaagtagaacatgtggttcaaggatttagtcttggggagtga

SEQ ID NO: 1135 - DNA, 252 bp, B.fragilis
cacttatactttgaaaccatgaaaaactatatgaaattgatctttgggcttggtttaatagccttggtcgggtattggcctgccgcgaaaactcctaagagagtaaattccttattcttgcaaaatgtagaggcgcttgccggtagtgaacacgttaccaatttaggttgcttgggtgacggatctgtagattgtcctattaaccatattaaagtagaatatgtggttcaaggatttagtcttggggagtga

SEQ ID NO: 1136 - DNA, 1230 bp, B.fragilis
gataatattgtaaagtattacatttgtttgcaaaaacaaacagtgatgaaacgttctaggttatttttatggatttttgggatattgatgcaagcatttttaattagtatgcacttctatcagaggaacatggaagcaatgtatgccgaaaccgagtatcttctgaaggaagttttgaatgaggaactacacagaaagcagcaagaattgaatctattttatatctccaaagtaacaatcgatactattcctttaaagattcgtgttacaacaagtaagggagtcaagacttttactgttgatgctaaaaagagtaaaaagaatatttctcaaagtatggcagagcggtcttggcattcagctgcttgtatgaagagtcgtttgtctacagatactttaaatttgctttggaatagaaggcttaaaagccagcaaatttttgctaaaaccgatgtacatataaccacaactcatttagataatactatttcttattgtaaatgtaagaattgcaaagattattgttttggaacgcataaattcactttttatgtgggaaatagatgcgaaatcgaggttatagctttttgctcttatttaagatgggccgtatatcagtatcatagtatcccatttgaagttatatggagtgtgacggctgttcttatcattattctctgtagttggtatttgataaagaagtatatatctaaaattcgaaatgataaaaaacatttagctaatgaccgagatcgtgaaagaaaggttcgtatacaattggaaaaggatcagaaaaggttggaggtaaaacaaaaagaatatgaaaaacggataaaagacttttcagcaaaaggcgaagaatacgaggaagagagaaaaagtatggagaaaatactgaaagagtatgagaatcaaattcaaaaactgaaagaattaagggaatctgggaaggaaccattactttacagattgagtccaaaagttactttcgattcttatgcaaaggtattaatttgtagcgaccaaacaatatctcttacttcacaagcatgtcaactgttggatgcttttctgaatgcttccgagtatattttaacttatgaggagctcttgcgatatttatgggaagatggtactggggatatgattcgtttgcgagtcgcaatttctcgtttacgtgttgcgctaagtatagatcctgaaaatttctatttttcagaaggatattaa

SEQ ID NO: 1137 - DNA, 1131 bp, B.fragilis
tctaataaagttatgaagaatatctcgttaatccttctcttgtttatacttttttcatgtaaaagcactggagataaaaccgactgtgaagtattacatgtcgatttggttgaacgccctgttccaacggaagaattattctctaaaatatctgtcattccattggaaaccaatgatagttcctttcttgtagggcctgtaaaagttattataaaagataacagatattatattgtcgatgaaggggttccggctgtgttttcttttgatgaagaagggcatcttttgcataaaataggtaaaaagggacaaggtcccggagagtatcgtgaaatatacgatgccgttattaaagaaaaagaaaatgcagtgtatatgctatctccatttggctctctttatgtgtattctctggatggaaaattcataaaagaaataaaactgccaacgagggcaaattatcaattgatagaggagctggagagtaagtatttcgttacatggacacttcctgcctctgagaatgataattgtatcagcgttatttctaaagagtcttccaagaatgtgaaagaattttggcatgttcctcccgttctcactactctgaattctaaacctttttataattatgaacataaaatatatttttcgaatccttatcaaaatgaagtatatgaagtaaggacagatagcttacgggttgcataccgttgggattttggaaaagataatcttgatttgaaggagtatggattcactttattagaggataaaaaggttgaagaatataaattaatgttgcagtatttacgtgattctactgtgccttattttttatgcgatcaatatcagaatgataaattctattatatcatgttggtgttcgggcttaagcattcgaaaaatctattttatcggaaggaagacagtaagagtttcttttttgaaaaaacaacagaaggcattcattttgaacctttagcttttaatgaagatttcctgacttgtattgttttcaatgaagactttccaaactatgaaaaagtgcttcctccggaggaatataagaagctggaagagcgtttagaagatgataacccctgtttaatcaaattttatttcaaatga

SEQ ID NO: 1138 - DNA, 198 bp, B.fragilis
cctgcaaaagttgcgactacagcgactatcagggccgcaaaaatctttttactcataatctacttttatgatgttaattatttttctcccatgtctctctttcggggagccacctcctccgtaaaaaaagtaaatgctacatttactcattccaattattttttcgctatcttcgtgccgggcaacctccttttttaa

SEQ ID NO: 1139 - DNA, 465 bp, B.fragilis
gtgatgaaagtatatttgggattaggtaccaacttgggtgataaggagctaaatcttcgtgttgccctacaaaaaatagaggagcggatagggaaaatcatttctctttccgctttttatgctactgctccctggggatttcagtcggaaaacaactttctgaatgctgcggtgggagtggagacagtattgtcccctgtcgggatactggaaagtactcaacggatagagcaggaaatagggcgtttgcataaatcacgggacggtgtgtatagtgaccgcctgattgacattgatcttttgctctatggcgataagatactacaggatgaaaggcttatagtgcctcatccgttgatgaccgaccgtaagtttgttctggaaccccttgccgagattgcacaggacgttgttcatccggtgtttcataagacgattaaagagctatttctggctctttcgtga

SEQ ID NO: 1140 - DNA, 936 bp, B.fragilis
cgtttcggggtacacttaaatatgcagataaaaccaatgaataaactcactataaatgcctgtccgctatgtgggggcgcacatttgaaacgtgctatgacctgtacggatttttatgcttccggtgaacagtttgacttgtacacctgcgaagattgcggatttacttttacgcaaggagtcccggtagaggcggaaataggcagatattacgaaacacctgattatatttcccattcggacacgaagaaaggtgccatgaatgccatttaccatcatgtacgtcagtatatgcttggaagaaaggcgcgtttggtgatgaaagagtctcatcgaaaaaccgggaggatactggatatcggtacaggtaccggttactttgcccatacgatgcagaataggggatgggaagtagaggccgtggagaagagcggacaagcccgtaattttgcacgcgaacatttcgggctgaatgtgaggccggaggctgcattgaaagaattagttccgggaacgttcgatgtaatcacgttgtggcacgtcatggagcacttggaacatttggacgaaacgtgggaattgttacgtgaactgttgaccgagaaaggggtattgatagtggctgtgcctaattgctcgtcgtatgatgcgatgaaatacgggaagtactgggctgcttatgatgtaccccgtcatttatggcattttacgcctgccacgattcagcagttcgggtcgaagcacggatttattctggcagcccgtcatccgatgccgttcgatgctttctatgtatcgatgctgacggagaaacataaaggtagtgcatactcctttgtgaaaggcatgtggaccggaacggtggcatggttgagtgcccaggctaaaaaggaacggagtagttcgatgatttatgtattcagaaagaaacgctga

SEQ ID NO: 1141 - DNA, 234 bp, B.fragilis
tgggtgatgtcagtcttttgtctgcaagaaacttgtttcttgcagacaaaagactacatggataactcttccaagcaaaacatccatagggaaaaacaccttgtgttttctttcactcaccgatacattttgaacatcactttcggcagacaccccctcggctctacggtcatacctgacactcttaaagcttatactgacataatgtctgctatccaaacaagacatatttaa

SEQ ID NO: 1142 - DNA, 333 bp, B.fragilis
aataaaaacactatgtacacaatacaggcaaatccaagtggcacacgcagcatggaaatatctgaagagaatttggtaaccattgaaaaatactctttattccagcatctgatagacagcaatggaattgtagatgaagctgttctggaaaagctgaaactcaatatacgttctctgatcgcaagtcaggaagaagacagtaaagacctgctcgacctttgtatagatgtgatttatcacaacaatatgaaagcattcgggttgcagcaactcatcaagctctatctcacttggttgtcaaagcaggaagcagaagaagaggaggaggcatga

SEQ ID NO: 1143 - DNA, 453 bp, B.fragilis
tcatttgtagcgtactacatgaaccaattttatataattatgaaagcaaaaatgttttttttagtagtagccatgctactttgcagaggtgtagcctatgcatacagcccttcggcgaacgatccgatttcaaagtcgggaggaattgagcaagatattccacctccccatattccaccgcctccgttgccgagtcagatatttcttcatgtcggtgaaatttccgaaactccatatcccatgatcggggcaatggtatgggaatgtgataatccaccggtaggtatagaacaagaagaatcatatatctttggaactatgattatcctgcgtataaaaggagttgcagcgggaagatatcaagtggatatgaaatggtacaatccgctcaatccgggccagcctccattaggaagacaaaccattgaggtcatcgttcagccgtggccttaa

SEQ ID NO: 1144 - DNA, 450 bp, B.fragilis
ggtgtagctctgccttgcggatggctacaccctatttcggtcccttctcagacgaccggacaaccggacagacagagcacggatttatttaattatttcaaatttattactcagaaccaaagaaagtcattatctttaccgaaaatattttctatatactcacataaaacatttggaataatggcaaagagaagagaacttaaaaaaaacgtaaattatatcgcaggtgaattattttcagagtgtctgatcaacagtaagtttataccgggtaccgacaaaaagaaagctgacgagttgatggtggaaattatgaaaatgcaagatgaattcatcagtcgaatcagtcatacagaaccgggtaacgtgaaaggattctacaaaaaattccgttcggacttcaatgcaaaggtaaatgaaatcatcgacgctatcgcgaaactgaattaa

SEQ ID NO: 1145 - DNA, 2241 bp, B.fragilis
atttgtagtaacattcataataacactataatgaaaaaacatttgtcattgatattagttctgttaccggtactttttctggcactccccgctctggcacaagaacgtaaaaaagtcggagtggtactcagtggaggaggtgcaaaaggggtagcacatatccaggcactgaaagtcatagaagaagccggcattccgatcgattatatagtaggtaccagtatgggatccattatcggcggattatactctatcggatatactcctcagcaattggacagcatggtgcgcaaacaggactggatgttcttactgagcgaccgggtgaaacgtagcgccatgtcactcaatgaacgtgaaaagtcagaaaaatatgttttttcgtttccgtttaccaaaagtcccaaagatgcagtttcaggtggcatcataaaaggacaaaatctggccaatctttttacggaactgacagtgggatatcacgattccgtagatttcaacaaacttcccatcccctttgcctgcgtttcacaaaatatcgtaaatggcgaacagattgtgttccacaatggaatacttgccacagctatgcgggccagtatggctattccgggagtattcaccccggtacggaaggatagtatgatcctgattgacggcggcatgatcaacaactaccctgtagatgtggccagatcgatgggtgcggatatcatcatcggggtagatgtacaaaacaatctgaaaggaatcgacaaactaaacagcgctccggacatactctctcaaatcatcgacctgacaactaaaaacaaccatcaaagcaatgtcggcctgaccgatacttatataaaggtaaatgtagaaggatattcctcggccagttttactcccgcagccatcgactccctgatgcaccggggagaagtagcagcccgcaagcaatgggcttctctgctcgctctcaaaaagaaaatcggcattgcagacacgttcgtaccccaatcgcacggcccttataccatgttctcaaaggaccggaccctgcatgtgaaagaaatcaccttctccgatgtagaagaaaacgataagaaatggttaatgaagaaatgtaaactgcaagaaaacagcagaatcagcatgcgtcagattgagcaggcactgttcatcctgcgtggaaaccagtcttactcaaatgccagttatacactgaccgatactcccgaaggttacaaactaaacttcctgctagagaaaaagtacgagaaaacgattaatgtaggcatccggttcgactcggaagagatagcttcattattaataaacgctacggcacagttaaagactcatattccctccaaagtctccgtcaccgggcgattgggcaaacgatacatggcacgggtagactatacattggagccgatgcaacaacgaaacgtcaacttttcgtacatgttccaatacaatgacatcaacatttacgatcatggtgaccgtgcctataacactacttacaaatatcattccggtgagtttggattttcggatgtatggtataaaaactttcggtttgggttcggagcacgaatcgagtatttcaaatacaaagatttcctcttcaagaaaccggaatttacgatgaatgtcaattccgaatatttcatcagctattttgcacaattacgttacaacactttcgacaaagggtattttccatctaagggaagtaacttctccggagcttattcgctgtacacagacaactttgcccgatataacggacatgcccccttctctgcactcagtgcttcctgggaaagtgtattctccataagtaaccgcctgacattgatcccggcactttatggcagggtattgatcggccaagagatcccttatgcttatgaaaatgcgttaggaggcgatgtattcggccgttaccttcctcaacaactcccgtttgcaggaatttacaatatagaactaactcacaattccgttgccgtggcttccttgaaactacgccaacgcatgggtagcaaacattatatcacgttggccggaaatttcgccttgagtgatgacaattttttcaaaatcctgaaaggtaaccggatttacggttgcagtatcggatacggcctggacagtatgttcggtccgttggaagcttcattaggatattccaatcaatccaaagacgtgggattctacgtaaatttaggattctctttttaa

SEQ ID NO: 1146 - DNA, 3072 bp, B.fragilis
ctacctgaaaaatcaattgggagtagatacccacagattgagaatgctgtataccgaataaatggacagttagcaacttcctcagccaatgacttatcggcaattgccggtttttcatttatttcttctacttttgcacccgataatcattcaaccgagcatatgaaaaaactatgtatatttctcctgctgctctttgctgcgacaggaatcttgtttgcacaagaaatagaaaaaagcgtgaaagagcggctcagtaattactttgagacttacaccccggcatctgccaataccggaagctgtaagttaaaaagcgtagacatagacttcgaaggcaggaaactatctatctatgcttccgagagttttgcttatcagccgtttgtaccggaaacagtagacgaaatctatcatcagatagaagaattgctgcccggcccggtacgttttttccgaactacaatttatgccaacaaccaacctatcgaggagttgattcccaatttctttcgcgggaagaagaaaaaagataaatcgcggctttcaaacgcagaatataaaggagcaccttgggtgataaacacctcccgcccttacgaaataaccaaaggattgcagaaccggcacatctctttgtggcagagccatggcaaatattacaagaacgataaaggcgaatggggatggcaacgtccacgtttgttctgcactaccgaggacctgtttacgcaatctttcattctgccttatgtcatccctatgctcgaaaacgccggagctaatgtctataccccccgggagcgggatactcaaaagaatgaggtgattgtggacaacgatacacgaaacggttccatctatctggagatgaaaagccgcaaagcccgttgggagaaaaccgacggttatgggttcgcacaaagaaaacctgtatatgaagatggagaaaaccctttcctgacaggtagcgcacgcttcacccggactgaaaagaaaaagaataaggcatttgccgaatggattcctacaatccccgaaacagggagttacgcagtatatgtatcctatcagacacttccaaacagcgtcagtgacgccaaatatctggtatttcacaaaggtggtgttacagaatttaaagtcaaccagaggatcggcggtggtacatgggtatatctcggaacctttgagtttgacaaaggcagcaatgattatggcatggtggtactaagcaatgagagcagcgaaaacggggttatctgtgccgatgccgttcgtttcggcggaggaatgggaaatatatcccgcggcacagtaagcggactgccccgttatctggagggagcccgttattctgcccaatgggcaggtatgccctatgatgtctacggaggcaaacaaggaacaaatgactatgctgacgacatcaatgcacgctccaacaccatcaattacctgtccggtggttctgtattcaatcccggacaaaaaggactgggtgtcccctttgaaatgaacgtggcgctgcatagtgatgccggatacagtaaaacgaacgatatagtgggatcactcagtatctataccaccgatttcaataacggactgcttaactcgggaaacagccggtatgcttcacgtgacctggcagatctcctgctcacccaaatacaaaaagacattcgtgccaaattcaatatacagtggacacgccgtagtatgtgggatcgcaattatagcgaaacacgcctgcctgccgctccatccactatcgtcgaattgctttcacaccaaaatttcgcagatatgaaactcggtcacgacccgaatttcaaatttaccgtaggacgtgccatttacaaagccgtattacagttcatcagcagtcagcacaacaaggagtatgtagtgcaaccactccccgtcagcaacttcgccatcgagtttggcaaaaaaagaaacaccctggaactctcatggcagggtgaaaacgatccgttggagcctaccgcccgtccccgcgaatacatggtatacactcgtatcggatacggtggtttcgacaatggagtacgtgtgaataaaccttcgtacaccctgaaaatagaacccggattggtctattcatttaaggttacagctgtcaaccacggaggcgaaagttttccatccgaaatcttatctgcctataaagccaaacaagaacatgcacgagtgctgatcatcaatggttttaaccgattgagcggacccgcagtaatcgacacaccggacgaagccggatttgacctggaacaagaccccggtgtcgcttatcaatacaatatttcactttgcggggcacagaccggctttgatcgctctcaggcgggaaaagaaggaaaaggaagtctgggctatagcggaaacgaactggaaggaatgaaaattgccggaaacactttcgactatccttttgtacacggcaaggcaatccaagctgccggaaactacagtttcgtatcatgcagcgatgaagctgtcgaaaacgggcgtatacaaccggaacattatcccattgtggattttatcctgggactggagaaagatgatattttaagcaacccggcacgcaaaacgtattataagacattctcttcacccatgcaacggatattaaccgcttactgtcagtcaggaggaaaccttctcgtcagcgggtcttacattggcagcgacatgagtaattcacagggtaaccgggagtttacggaaaaaattctgaaatacggcttccaaggttcactcaaagatacccgttcgggacagatcaccggattgggacgcaccctgcaaatcccccgtttgcccaacgagaaggcttatgcagtaacagctcctgattgtatcgttcccgtagactccgcgtttccggtatttgtctatcaacccggacaatacagtgccggaatcgcttataaaggaaattaccgggtattcgcaatgggatttccattcgaaagcatcgaaagcgaaacagaccgtgccatagtaatggcggcaatactaaaattcttcggagaaaaataa

SEQ ID NO: 1147 - DNA, 3075 bp, B.fragilis
tttaaaagaaactcttcctccctctcgttgggagaggggcggggtgagaccttactgaatatgaaagttagtttttttatagatagacctgttttctcgatcgttatctcgatactgatagtcatcatcggcatcatcggactgaccatgttgcctgtcgaccagtatccgcagatcactcctccggtagtgaagatcagtgcctcttatccgggagccagtgcgcttacggtttcgcaggctgtagcaactcccatcgaacaggagattaacggaacaccgggtatgctttatatggagtcgaacagttccaattccggaggcttctcggcaacggttacttttgatgtttctgccgatccggacctggccgctgtagaaattcagaaccgggtgaagctggcggaaagccgtttgccggctgaagttattcaaaacggaatttcagttgaaaagcaggcgcccagccagttgatgacccttacattgatgtcgtccgatccgaaatttgacgaaatctatttgagtaattttgcgacgattaatgtacttgatgtaatccgccgtattccgggagtaggacgtgtgtcgaatatcggtagccgttattatgccatgcaaatctgggcagaaccggataaattggctaacttcgggctgactgtgcaggatttgcagaatgctttgaaggatcagaatcgtgaatcggctgccggtgtacttgggcagcaaccggtgaaggggctcgatgtgacaatccctatcactacgcagggacgtctttctactgtagaacaattcgaaaatattgtgattcgtgccaatacaaatggctctattattcgtctgcgagatgtggcacgagtttcactggaagcctcatcatatagtacagagagtggcatcaatggtaagaatgctgccgttctgggaatttatatgcttccgggcgctaacgcaatggaagtagcgaaaagtgtaaaagaggcgatggatgaaatcagtaaaaacttccctgaagggctgagctatgaggttccgttcgatatgacgacttatatttccgagtctattcatgaagtttataagaccttgtttgaagcattgatcctggtagtactcgtcgtttatctttctttgcagagttggcgggctacgttgattccgattgttgccgttcctatttcactgatcggtacatttggtttcatgctgattttcggtttctcgctgaacatattgacattgctcgggttgattcttgccatcggtattgtggtggatgatgctattgtagtggtggaaaatgtagagcgtattatggaggaagagaagttgccgccatatgaagctaccaagaaagccatgaatggattggcaggtgcgttgattgctacctcgctggtactttgtgccgtatttgtgccggtgagcttcctcagcggaattacgggccaactttaccgccagtttactattaccatcgctgtatccgtactgatttcgactgttgtggcgctgactctgagtccggtcatgtgttcgctgattctgaaaccggacaatggcaaaaagaagaacattgttttccgtaaaatcaaccattggttgaacgtgggcaatcataaatatgtaatcgctatccgtagggtaatcggtaatccgcgtcgtgtattggccggtttcggagtggtgcttattggtattttgttgattcaccggttgattccgacaagtttccttccggtggaagaccaagggtacttcaagatagagttggaattgccagaaggtgctacgctggaacgtacccgggaggtgacggatcgtgccatcacttatctggaaaagaatccgtatatagcctatgtacagaatgttaccggaagcagtccccgtgtaggtagcaatcaggctcgtagtgaattgactgttatcttgaagccgtgggaagaccgcaaggatacatcgattgatgagattatgtcaaacgtccgtcacgacctgagtgagtatccggagtgtaaagtctatctttctactcctcctgttattcccggtttgggaacctcgggtggttttgagatgcaactggaggctcgtggcgaggctactttcgaaaatttggtgcaggcggcggatacgctgatgtattatgcctctcagcgcaaagagttgacgggactttcttcttcacttcagtcggatattccacagctttatttcgatgtggaccgtgataaagtgaagatgctaggtgtgcctttggcggatgttttttcaacaatgaaagcttataccggttcggtttatgtaaatgacttcaatatgttcacccgtatctataaggtatacattcaggctgaggcaccgtatcgggatcataaggacaatattaacttgttattcgtgaaggcttccaacggggctatgattccgctgacttctttgggaaacgcatcatatactacgggtcccggcagcattaaacgtttcaatatgtttactactgctgtattccgcggtgaggcggcacaggggtatagttccggacaggctatggagattatggagcagattgcccggtatcatttgcccgataatatcggactggagtggagtgggctttcctatcaggagaaaaaggcgggaggacagaccggattggtattggcgctggtgttcctatttgtattccttttcctggcagcacagtacgaaagttggacggtaccgattgctgtgttactctctttgccggtggctgccttgggggcttatctgggagtatgggtttgcggattggaaaacgatgtatatttccagatcggactggtgatgcttgtcgggttggcagcaaaaaatgccatcctgattgtagagtttgccaaagtgcaggtagaccgtggaggtgatttaatacagtctgccattcatgccgcccaattgcgttttcgccccatcttgatgacttccctcgcctttgtgctgggtatgcttccgatggtgctggcaaccggtcccggttcggcaagccgtgctgctattggtacaggagtctttttcggaatgatc

SEQ ID NO: 1148 - DNA, 777 bp, B.fragilis
ttattcatgaaaatctcgattgtacagacagatattatctgggaaaataaacaggaaaatctccgtttgctccgcgaaaagctatcacctcttcgcggaacaacggagattgttgttttaccggagatgtttacaacaggattcagcatgaacagccggctattagccgaaccggtttccggtaccacgctccggagtctcaaaaattatgccatagaatttcatttgtcattggccgggagtttcatttgtgaagaacaaggttcttattataaccgggctttcctgatcactcccgatggacaggaattttactatgacaaacgccacctcttccgcatgggacacgaagcggaacatttttcggcaggcagccggaaagtgatcattccctacaatggttggaacatctgcctgcaggtatgttacgacctccgctttcctgtctggagcaggaatgtgaacaatgaatatgacctccttatatatgtagccagttggccgactccacgtattcaggcatggaatacattattatgcgcacgtgccattgaaaatcaatgttatgtatgcggtgtgaaccgtataggacaggacggcaacgggctctgttatccggggtattccgctttatatggacctaaaggagaaaacctggcaggaactcccgattcggaagaaaaaatacaaaccattgaacttagcctggaagccctcactacttttcgtcataaattcccttgctggaaagatgcagacccctttctcctttactaa

SEQ ID NO: 1149 - DNA, 339 bp, B.fragilis
acaataaacgaggaacggggaacaataaatgcgaggagaatgggaaatatattgaaagataaaagtatggctttcgcgatacaaatcgtaaacctgcataaatatccgaacaaaagaaaagcttactctctatccgaccagattctaatatccggtacagccatcggagttctgcaaaaagaaacggaatgcgccgaaagcaacgccgactttattcataatatagcatcgccccaaaagaacgtaatgaaacccttttccggcttgaattgttatttaaaacagaatatttatccgaaacagaatattcaagcatgtttgcagacgcaaatgaattaa

SEQ ID NO: 1150 - DNA, 378 bp, B.fragilis
tggagaacggatgactttacagtttactattttatgagcgaaatacaaaatcaaattaaaaaatggccggtaacggcaatcaaaaaaatcaaaagtacattcggtagcgcagaaaagttctacgctaccgtttatcttatagcccgcaacgaacatcattgccagatgatgggagtggccggagcggaacaacgcttgaagacgattcatgcctatcagggtatgattcgctttatgcttgatgaagaaggactcaatggtaaggaaatcctggacacaatagccggagagtatctggaagactttgtgaactatcgcgaacaagacttcggaatgaccaatgaagaatttattgccattatcaaaagaataggttga

SEQ ID NO: 1151 - DNA, 1230 bp, B.fragilis
ctaataaaggataagttaattttaataatacaaacaagcatgagactgttttttacgagaaaagagctaaaactgaggagaaaaagaacaattgcaggcatcgtctgtttggctttggtggcaggcatttactggattctgacacgaccacataaagtagagccggaagtgccgactgtgattgtagagcccgcagaaagggataatgtagagattttcggtgagtatgtggggcgcatacgtgcacaacaatttgtggaagtgcgggcccgtgtggaggggtatctggaaagtatgctctttgccgaggggacgtatgtgaataaaaatcaggtgctttttgtgatcaatcaggatcaatatcgtgcaaaggcagataaagcacgggcacaactgaaaaaagatgaagcacaggcattgaaagcaaagcgggatttggaacgtatcaagcctttgtatgcccagaatgcggccagccagttagatctggacaatgcggaggcggcctatgaaagtgcggtggcaaccgttgccatgagtgaggcggacctggcgcaggcagagttggagttgggttatacattggtccgttcgccgttgtccggacacatcagcgaacgtaatgtggatttggggacactggtgggaccgggtggaaaatcgcttttggctacagttgtgaagagtgatacggtgctggtggacttcagcatgactgctctggattatctgaagagcaaagaacgtaatatcaatatcggtcagcaggactcttcccgttcctggcagccgaacatcaccattaccttagcggataatacggtatacccttataaaggatatgtggattttgccgaacctcaggtagatccgcagaccggtactttttcggtaagagcggagatgccgaacccgaaacaggtattgcttccgggacagtttacgaaggtaaagctgctcttggatgtacgtgaaggagccatcgttgtaccgcataaagcagtgactatcgagaaaggcggagcatatatttatgtgatgcgcagagattctacggcagagaaacggttcattgagttgggacctgaatttggtaataaactcgttgtggagagaggtctgggtgcaggtgaagaagtggtggtggaagggtatcacaagctgacaccgggaatgaaagtgagagctaccttgccccagccgtcagctgagaataaagagactgagtga

SEQ ID NO: 1152 - DNA, 2946 bp, B.fragilis
aactgcacgtgggtgagcgggtggatacgggtttcattacggatgtattgcatagttacgggtttgaatacgtggattatgtatacgaaccggggccagtatgccgttcgtggaagtattatcgacgtgttttcattttcgtccgagtatccctatcgtattgactttttcggtaatgatgtggagagtatccgtacatttgaggtcgattcacagttgtcgaaagagaagaaagagagtattgtgattgtgcccgatcttgccgtaaccggaaaggttacaacttcttttcttgattttatcccgaaagataccactttggcgatgcgtgatttcctttggttgcgggagcgtattcaggttgttcacgatgaatcgctcacaccgcaggctcttgcttctcaggaggccgaagagaatggaggcattactttggaaggaaaattgatcgatgggagtgagttcactgttcgtgcgctcgatttccggcggatggagtttggtaacaagccgaccggcacaccggatgctaccttgacatttcatactacggcacaacctatttttcataagaatttcgatttggtggcggagtctttcaaagagtatctgaaccggggatatgcactttatatctgtagtgacagtacgaaacagacggatcgtatcaaagccatttttgaggatcggggagaccggattcagtttacggctgtggagcggactctgcatgaagggtttgcagacgataccttgaaactttgtttgtttaccgatcaccagttgttcgaccgtttccataaatataatctgaagagtgataaagcccgttcgggaaaggtcgccctttcgctgaaagagttgaatcagttcactcccggtgattatgtggtacataccgatcatggtgtgggacgtttctccggtctggtacgtattcctaacggagatacgacacaggaggtcatgaacctggtctatcagaatgaagatgtggtatttgtttctatccattcgttgcataaagtttcaaaatataaaggtaaagaaggagaagccccccgactgaacaaattgggtacgggcgcttgggagaaactgaaggagcgtacaaagccaaagattaaagatatagcccgtgacttgataaaactttattcacaacgtcgtgaagagaaagggtttgcatacagtcccgatagttttttgcaacgggaattggaggcttcgttcatctatgaagatacccccgatcagagtaaggctacggcggatgtgaaacaggatatggaacgggatatgcctatggatcgcctggtatgcggagacgttggcttcggtaagactgaagtggccatccgtgccgcatttaaagccgtagcagacaataagcaggtagccgtactggtgcctacaacggttttggcataccaacacttccagacttttcgtgatcgcctgaaaggacttccctgccgggtagaatatctcagccgtgcccgtacggcggcacaggcaaaggcggtaatcaaaggattggaagctggagacgtgaatattctgatcggtacgcaccgtatcttgggaaaagatgtcaagttcaaagacctcggactgctgattattgacgaagagcagaagttcggtgtgtcggtcaaggagaagctgcggcagatgaaggtcaatgtggatacattgacaatgacggcaacccctattccgcgtactttgcaattctcgctgatgggagcgcgtgacttgagtgtgatttcaactccacctcccaaccgttatccgatacagacggaggtacatacgttcagtgaagaggtgatagctgatgccattaactttgagatgagtcgtaatgggcaggtttttctggtaaacaaccgtatagccaatcttccggaactgaaagcaatgattcttcgtcacattccggattgccggatagccatcggacacggacagatggagccggcggaattggaacagatcattttcggctttgtcaattatgactacgatgtactgattgcaaccactattatcgagagtggaatcgatataccgaatgcgaacacgattattatcaaccaggcacaaaacttcggattgagcgatctgcaccagatgcgcggacgtgtgggacgtagcaataaaaaggcgttctgttacttgctggctcctccgttgtcttcgttaacccccgaagccaaacgtcgcctgcaggcgatcgagaatttcagtgatctgggtagtggtattcatattgccatgcaggatctggacattcgcggtgcgggtaatatgctgggagccgaacagagtggatttatcgccgatctgggttatgaaacttatcagaagatattgtcggaagctgtgcatgaactgaaaacggatgaatttgccgaactttatgctgacgaattaaaaggagaaggtgtcattagtggtgaagagtttgttgaagaatgtcaggtggaaagcgatctggaattgctgttaccggctaattatgtgacgggtagcagcgaacgtatgttgctgtatcgggaactggacggactgactctcgatagagatgtagatgctttccgttcacgattggaagaccgtttcggccctattccgcctgagactgaagaattgttgcgtatagtaccgttaaggcgcttggctgcccgattgggagtggagaaagtgttcttgaaaggaggacgtatgacactgttctttgtcaacaatgcagaaagcccgtattatcagagtgctgctttcggtaagatgatcgactatatgatgaagtatacccgaagatgtgatttgagagagcagaacggacgtcggtctatgttggtaaaagatattccgaatgtggaaacggctgtcagtgtactactggaaattgtggcattaccggtgaaagagaaagagtaa

SEQ ID NO: 1153 - DNA, 342 bp, B.fragilis
agacctgctcgacctttgtatagatgtgatttatcacaacaatatgaaagcattcgggttgcagcaactcatcaagctctatctcacttggttgtcaaagcaggaagcagaagaagaggaggaggcatgattaccgtcgatacctgtggaatgacgaactatagcccgttgattccggccataaaagcgatgtgtaatgccaatcccggtgacaagatggagattgtaacggatcaggtggctgcattccaggatcttaaggaatatttatcagaacaaggtatcggattccgtgaaatatatgatggagaacggatgactttacagtttactattttatga

SEQ ID NO: 1154 - DNA, 1179 bp, B.fragilis
ctcataacacgaatgttaacccaattaattaatgcacgtatactcaccccccaaggatggatgaaagacggttccgtgcttatcagagacaataagattttagaagtcacaaactgcgatctggccgttatcggagctgaacttattgacgtcaaaggtatgtatgtagtccccggtggagtagaaatccacgtgcatggtggtggaggccgcgactttatggaatgtacggaagatgctttccgggcagcggtccatactcacatgaaacatggcacaacaagtatcttccccacactgtcatcatctacagtccccatgattcaacaagctgcagaaacctgtaccaagttgatggaagagaaaaacagcccaatcctgggactgcacctcgaaggtcattacctgaacatgaaaatggcaggaggacaaattccggaaaacattaaaaatcctgatccgaatgaatacattccgatcgtagaacagtatcattgcatcaagcgttgggatgctgctccggaacttccgggagccatgcaattcggtaaatatattgctgccaaaggcatactgccttccgtagcacatacacaagccgaatttgaagatatccgtacagcttatgaagccggatacactcatgcaacccacttctataatgcaatgcccggcttccacaaacgcagagagtacaagtacgaaggtacagtcgaaagcatttatctgttggatgacatgacagtagaagtagtagccgacggtattcacgtcccccctacgatcctgagactcgtatataaaataaaaggtgtggaaagaacctgtctgatcaccgatgcccttgcatgtgccgatagtgatagcaaagaggctttcgacccgcgcgtaattatcgaagacggagtctgcaaactggccgaccattctgctttggcgggaagtgtcgccaccatggaccgcctgatccgcaccgttgtgcagaaagcagagatcccactggaagatgcagttcgcatggcttccgaaactccggcacgcatcatgggggtatatgatcgcaaaggttccttgcaaaaaggtaaggatgccgatattctggtactggacgaagacctcaacgtaagagccgtatgggccatgggtaagttggtacctgaaacaaatactctgttttaa

SEQ ID NO: 1155 - DNA, 591 bp, B.fragilis
aatcatcgacgctatcgcgaaactgaattaagaatgaagaaagcaatatatagctttatctactatcacctgttggggtggaaaaccaatgtaacggtaccgaactatgataaatgtgtaatctgtgcggcacctcatacaacgaatatggacctctttatcggtaaactgttttatggagcgataggccgtaaaaccagtttcatgatgaaaaaagagtggtttttctttcctttaggaatcttgttcaaggccgtaggcggcattcccgtaaatcgaggacgcaaaagctcactggtagaacaaatggcagaggtctttgccaaaagacctaagtttcatcttgcaatcactcccgaaggaacccgtaaacgcaaccccaactggaaaaaaggattctactacatcgcattgaaagcgcaagtccctattgtgctgatcggaatcgattacaatacgaaaacagttacctccaccaaagcaatcatgcccagcggagacattgaaaaggatatgcgtgaaataaaactttatttcaaagatttcaagggaaaacatcccgagaacttctccattggagacgttgaatga

SEQ ID NO: 1156 - DNA, 1383 bp, B.fragilis
gatatgaaaagaacattaatacaaaacgctaccatagtaaacgaaggacgttctgtgcgcggttcggtagttatcgaaggggaaaaaatagccgaagtacttgaaaaaggacagaaacctgctatcccctgcgaagaaacaatcaatgccaacggatgctatctgattccgggtgtgatcgacgatcatgtacatttccgtgatccgggactaacccacaaagccgacatctctaccgaaagccgggctgccgcagctggaggtgtaacctctatcatggacatgcccaatacaaatccgcaaacgaccacactggatgcgctcaatgccaagttcgatctgcttgccgaaaagtgtagcgttaactattcgtgctatttcggggcaaccaataataactataccgagttcgacaaactggacaagaaccgtgtatgcggaattaagcttttcatgggatcgagtaccggaaatatgctggtagacaaaatgaacagtctactgaatattttcaatggaaccgatctgctgattgccgctcactgcgagaatcacgaaacgattaaaaagaatacggagaagtatgtaaaagagtatattgaaaaatatcctcatcaatattaccatgttcatcatgagacccttccgatgggttatcatgctaaaatacgttcgattgcggcttgttacgaatcgtccgaactggctgtacgcctggcacgcattgcagatgcacgcctgcatatcctgcatatctctacagccagagaactttcactgtttgacaatgatatcccgttagaggaaaagagaatcacagcagaagcttgcgtttcacatctgttattcgactcttccgattatccggaactcggtgcacgcatcaagtgtaatccttctatcaaaacaaaaaccaaccgggatgcgctccgccaggcagtcaactccaacctgatcgatgtaatcgcgacagaccatgccccacaccttctcaaagaaaaagaaggagggccgttgaaagcaatgtccggtatgcctatgatccagttctctctggtcagcatgctcgaactggtgaacgaaggtatctttacgatagaaaaggttgtcgaaaagatgtgtcacgcccctgcacaaatatacaatattcacaaccgcggctttatccgccccggttatcaggccgatctcgtattggttcgtccggatgcattatggacggtaagcgcggatcagattttaagcaaatgcggatggagcccgcttgaaggacgtacgttcgagtggaaagtagaaaagacatttgccaacggacatctattgtatactgacggacaggtagacgaaacctatcgcggacaagagatctattttgaacgatga

SEQ ID NO: 1157 - DNA, 789 bp, B.fragilis
agaagagtgaggagtttggaactcttcactcttcttttgtttaaacagaaaagatacaaattatatatgaaacaagaaaaattcttccgtcttcttcctatagagggagcttataatattcgtgatctgggaggttatccgacatcagaccataaacatgtaaaatggaaaacattcatccgttcgggcgatcttgacaaactgacagaatccgatctggactatcttacctccttgcacatccgaaccgacatcgacttcaggagcatgcaggaaaaaaaagcagcggcagacaaaattccctcaactgttacacaatatattcccttatctatcgaagcaggcgacatgaccgacatggcacacttcaacctgaacaatataccgggaatactcgaacaggcatacgtttatatcatccaaaatgctcaggatacttatcgggaattcttccggattgtttcggaagaacggaatactcctcttttatttcactgctcagcgggaaaagaccgtaccggaattgccgcagccttactactgggagcattgggtgtcgacagggaagtgataatggaagattacatgctgtctgccgaatatataaaagggaaatatgatgcaatcgtacaagctcatcccggatttgcccctctcaccacagtacggaaagaatatctggaagctgctttccaaaccattgacactgactatcaaggtatggataactacctgaaaaatcaattgggagtagatacccacagattgagaatgctgtataccgaataa

SEQ ID NO: 1158 - DNA, 486 bp, B.fragilis
gttgaacgcatggatatattcctgattattctgggtagtatctgcctgcttgtcggattagccggatgtatcgtccctatgcttcccgggcctcctgtctcctatctggcactggtatttctgcatttcaccgataaggtttcttttaccattccacaactattcttctggttgttcattgtggtactgatacaaatactcgactatttcattccgatgttcggtgtaaaaagactcggaggtaccccatggggtaaatggggttgcatcatcggtacctttgccggcatttttctgttcgccccctggggcgtatttatcggcccgtttgtgggcgcagttgtaggcgaattattgggtggaaaagaaacgaaatacgcgctgaaagcaggattcggagcatttgcagggttcctgttgggcaccgtactgaaggtagctgtatgcggttggttcatcttctgctttatccgtgccctcgtatag

SEQ ID NO: 1159 - DNA, 792 bp, B.fragilis
cggaaaagcattacatttgtcttcaaatttagacacaatatgcagacatcggacagcatcgtaatcatccctacctacaacgaacgggaaaacatagagaacatcatccgcgccgttttcggactggaaaagacctttcatattctgatcatcgaggacggttctcctgacgggaccgccgccattgtaaagaccttgcagcaggagtttcccgaccgccttttcatgatagaacgtaaaggtaaactgggattgggaacagcctacatcaccggattcaagtgggcactggaacattcatacgaatacatctttgagatggatgccgatttcagtcataatcccaacgatctgccacggctctatgaggcttgtgccgttcagggaggcgatgtagctatcggctctcgatacgtaagcggagtgaatgtagtaaattggccgatgggacgtgtgctgatgtcttattttgcatctaaatatgtacgaatcgttaccggactgccgatacacgatacgactgccggatttaaatgttaccgtcgccaagtactcgaaaccatcgatctcgaccacatacgttttaaggggtatgcttttcagatagaaatgaaatttacggcctacaaatgcggattcaagattatcgaggtaccggttatctttatcaaccgcgaactgggtacttcaaaaatgaacagtagtatctttggtgaagcggtattcggtgtcatcaaactgaaagtgaacagctggtttcacacattcccccagaaaacaaaaatgaattaa

SEQ ID NO: 1160 - DNA, 2070 bp, B.fragilis
ttgattgtttttatatatatttgttcagagtttccaataacgacaaagactcagtcaaacttaattaataacaaacttatgaagacaaatcttagttctcagattactctcaacagggtctcccccaggtattacagaccagagaatgcattcgagagatcggtattgacccgattagagaaaattcctacagacatctatgaatctgtagaagaaggtgcaaatcatatcgcttgcgaaatagcacaggttattcgtgataaacagaaagcaggacgtttctgcgtactggcattgccgggtggaaattctccgcgcagcgtatatgccgaattaattcgcatgcacaaagaagagggactcagtttccgtaacgtaattgtattcaacatgtacgaatactatccgttgtctcaagatgcaatcaacagtaatttcaatgcgttgaaagagatgttcctcgatcatgtagatatcgataaacagaatatctttactccggacggtacgattgccaaagataccatctttgaatactgccgcctgtacgaacagcgcatcgaaagcttcggcggtatcgatatcgctctgctaggcatcggccgtgtaggtaatatagccttcaacgaaccggggtcacgcctgaactccaccacccgactgattttgctggatagcggttcacgcaacgaagcatccaagatcttcggcaccatcgacaacacccctatcagttctattacgatgggtgtagccacaattcttgctgctaagaaaatctatttgttggcatggggtgaagaaaaagcccacatggtgaaagagtgtgtagaaggtaacgtaacagataccattccggcatcttacttacagacccacaacaatgcacatgtagctatcgacctgtcagcagcttccaacctgacacgcattcaacgtccatggctggtcacttcctgcgaatggaatgacaaactgatccgtagcgcaatcgtgtggctgtgccaattgaccggcaaaccaatcctgaaactgaccaataaagattacaacgaaaatggcttgagcgagctgcttgccctcttcggatctgcttataacgtaaatatcaagatattcaacgacctgcagcacaccattaccggatggccggggggtaaaccgaaagcagacgacacatatcgtccggaacgtgcaaaaccatatccgaaacgagtagtcgtattttctccgcatcccgatgacgatgtgatctctatgggtggtacgatccgccgcctggtagaacagaaacatgaagtccatgtagcttaccaaacttcgggaaacattgccgtaggcgatgaagaagtagttcgcttcatgcatttcatcaacggattcaaccaaatctttataaacagtgaagatcaggtgatcagtgaaaagtacgccgaaatccgtaaattcctgaaagacaaaaaagacggcgatatggatacacgcgatatcctgaccatcaaaggtctgatccgccgtggcgaagcgcgcacagcttgtacttacaacaacattccgctggaacgttgtcacttcctggacctccccttctacgaaaccggtaaaatccagaagaatccgatcagtgaagccgacgtagaaattgtccgcaacctgctccgtgaagtgaagcctcatcagatctttgtagccggtgaccttgccgacccgcacggaacacaccgtgtatgtacagatgccgtatttgctgccgtagaccttgaaaaggaagaaggagccgaatggttgaaagactgccgtatctggatgtatcgtggcgcatgggccgaatgggaaattgaaaacatcgaaatggctgtacctatcagtcctgaagaattacgtgcaaaacgtaactctatcctgaagcatcagtcacagatggaaagtgctccattcctgggcaacgacgaacgcttgttctggcagcgtagcgaggatcgtaaccgaggtactgccgctctttacgacagcttgggactggcttcttacgaagcaatggaagcattcgtagaatacatcccactataa

SEQ ID NO: 1161 - DNA, 615 bp, B.fragilis
tgggctaaaattgcatttatgacaattactgaactgcaacatcaatatgcggggcatccgaatgtagaggccctgaataaactgttgggggagcccgcagtcagacatatctattgcggcggcttatatgcttccgctgcttccttgttcgcttcggcgttggttgaaaagagtccttgcccgtttgtttttatattaggtgacctggaagaagccggttatttttatcatgatcttacccaagtgttgggtacagagcgcattttgtttttcccttcttcgtttcgtcgttcggtgaagtacggacagaaagatgctgctaacgagattttgcgtaccgaagtgctcagtcgcttgcagaagggtgaagagggattgtgtatcgtcacttatcccgatgcattagccgaaaaggtcgtttcacggcaggagttgagcgagaataccctgaaactgcacgtgggtgagcgggtggatacgggtttcattacggatgtattgcatagttacgggtttgaatacgtggattatgtatacgaaccggggccagtatgccgttcgtggaagtattatcgacgtgttttcattttcgtccgagtatccctatcgtattga

SEQ ID NO: 1162 - DNA, 198 bp, B.fragilis
ttatataaaattggttcatgtagtacgctacaaatgattatccgggcacaaataatcagattagaagactctattatgaaattagaaaaatattatagaacgaaaacagccggattagaggggcaaccgaataagaagaagaataagaggatggcagacattgtggcagttaatgttaaatatgtcttgtttggatag

SEQ ID NO: 1163 - DNA, 1929 bp, B.fragilis
ctgtatgcggttggttcatcttctgctttatccgtgccctcgtatagcgaaattatccgtatctttgtccccatgaaagaatatcgacttaccgattggttacccactaccaagaaagaagtagagcttcgcggctgggacgaactggatgttatcctctttagcggcgatgcttatgtggaccatccttcattcggagccgccgttatcggtcgtatccttgaagccgaaggcctgcgtgtagccattgtgccccaacccaactggcgtgacgacttgcgtgactttcgcaagctgggacgtccccgactctttttcggcatcagtgcaggttgcatggactccatggtgaacaaatatacagctaacaaacgcttacgtagcgatgacgcttacaccccggacggacgtcccgatatgcgaccggaatatccctcgatcgtatacacccaaattctgaaaaaactctatcccgatgttcccgttgttttgggaggtattgaagcaagtatgcgccgcctcagccattatgactattggcaggatcggttaaagaaaagtatactttgtgaaagcggtgccgacatgctgatttacggcatgggagaaaagcctatttgtgagttggtccgccgattgacagccctgtgtgataatcaggatggagtgatttcatcatccgacattcattctccggcattatcctctatcccgcagacggcttatctgaccaggaaatatgaatccgacgagaatgatatcaccctctattcgcatgaagaatgtttggctgataaaaagaaacaggcaaccaacttccgtcatatagaagaggaaagcaataaatacgcggcagcccgaatcgtacaggctgtcgatggtaaaacagtggttgtaaatccaccctaccctcctatgacagagaaagagctggaccgttcgttcgatctcccttacactcgtttgcctcatcccaaatacaaaggcaaacgcattccggcttatgatatgattaaattttccgttaatatccaccggggatgttttggcggatgcgctttttgtaccatctccgcccatcagggaaaatttatagtcagccgaagcaaggaaagcattctgaaagaagtaaaagaggtagttcaattgcccgatttcaaaggaaatctgagcgatttaggaggtccttctgccaatatgtataaaatgggcgggaaagatctctccctttgcaaacgttgtaaacgcccctcttgcattcatcccaaagtgtgtccgaacctgaatacggatcaccgtccgctattggatatttactatgcagtggactctttacctgagatcaaacgaagtttcatcggaagtggagtgcgatacgacttattgctccatcaaagcaaggatgctaccgtcaacaaaatcacagcagaatatactcgcgaactaatagcccgccacgtcagcgggcgcctgaaagttgcaccggaacataccagtgaccgggtactgagtatcatgcgtaaacccgctttcagccaattcggagaatttaaaaagatattcgacagaatcaaccgggaacttggcttgcgccaacaattgatcccttatttcatctccagtcatccgggctgtaaagaagaagatatggcggaactggcagtcatcaccaaacaactggacttccatctggaacaagtgcaggatttcacccctacccctatgaccgtagccaccgaagcttggtatacaggctttcatccgtatacactcgaaccggtattcagtgccaagactcaacgggaaaagttggcacaaagacaatttttcttttggtataaaccggaagaacgacggaatatcatcaatgaattgcgccgcatcggacgggcggacctgatagacaaactatacggaaagaggaaatga

SEQ ID NO: 1164 - DNA, 677 bp, B.fragilis
ttaccagtattaaaacagtcaaatatggaaaagcataacccgtcatcattcaccgttgatagctcctcccccgctcatcgttcatcattcgccgttcatgatttaaccccttatatcaactggatttacttcttccacgcctggggattccaaccgcgttatgctgccattgccaatattcacggatgtgactcttgccgtgctatctggctgaccactttcccggaagaagaacggagcaaggcttcagaagcgatgcaactttataaagaagctaaccggatgttgaacgaactggacagaaattttgaggtaaaaactatttttaagctctgtcctgccaatgcggatggagataatctgattataaacggtatcaccttcccattgctccggcagcaagtcaagaagaaagaaaacgaaccgttcttatgcctcagtgatttcgtacgcccgctatcttcaggcatcaccgatgtggtaggagcttttgcctcatccatcgatgcggacatggaaggactttatgagaaagacccctataagcatcttttggtacaaacgctatccgaccgcctggccgaggccgctaccgaaaagatgcacgagtacgtccgcaaagaagcctggggatatgccaaggatgaaaatctttccatacccgatgtcttcaacac

SEQ ID NO: 1165 - DNA, 408 bp, B.fragilis
gcggttggctcccgccgtcagtgtctccccgtatcgaaggtaacactccatcggtatatccactttgcctttatcgaggatgcagctttgcggacgattacagaggaacaacatgccgtgggtggaaacagcaatgcgtatcaccggattaatgtaggcattcttatagttgatagcttccacagccagactttttccgattacatcaccacgggtattgacgatggggacatattccgtatgcgccattacatgattaaagtaacggatacctatttgattgagcaggatgctgagaataaatatagtaggcggcaatacgtgataaagtacaagtatggaagtccgggtgaggggatgtgctaccaaaaccgtcaggctgatgacagcaaaatggagaatacctaa

SEQ ID NO: 1166 - DNA, 792 bp, B.fragilis
tcactaccatctttaagaaataataaaaaaaacaaaaagatagggaggatggtttcagccaacccctataatcgttacatttgctttcaaattagaagattacgatatatggaaaccatgttcgacaccttgttgcaactccccctttttcagggactttgtcatgaggatttcactaatatattagaaaaagtaaaacttcacttcactcgtcacaaacccggagaaccattgataaaaagtggtgaggtctgtgatcagttacttttcttgctaaaaggcaggctctcttccgtcaccgtatcggaagacgacacgctgactgttattgaatatttcgaagctcctgccgtattagaaccttactccatgtttggaatgaatacccggtatatatcttcctatattccgcataatgaagaagcgcaaatggtaagtatcagtaaatcgtttgtcatgggcgagttgttcaaatatgatatttttcgtcttaactatatgaacatcgtcagcaatcgtgcgcaaaatctctatacacgcttatgggataaagctcccaaagacattgaagacaaaataatccgtttcattttgggacacattgagagaatgacaggtgagaagctgttcaaggtaaaaatggatgatttggcccgcatgttggacgacacccgcctgaatgtatcaaaagctctcaacggactgcaagaattaaatttgttggaacttcaccggaaagaaatccgcatacccgatttatcactcctgacagaatggaacgagaaacgataa

SEQ ID NO: 1167 - DNA, 1254 bp, B.fragilis
ctcatttggtttcattatgaaacagatgaattgtacatttgcaggctgaacctaaaaatagaaccctatatgaaatataactttgatgaagtgatagagcgccggggaacagactcggtgaagtatgacgcagtatcggaacgttggggacggagcgacctgcttccgatgtgggtggccgatatggatttccgtactcctccttttgtgatagaggctatccgtcggagattggatcatgaagtattggggtatactttcgcttgcgaagcttggtatacatccattatcaattggcagaaagaacgtcacgggtggaatgttacccgggagatgctgacgtttacgccgggtattgtgcgtggattggcttttgccctgcaatgttttacggctccgggggacaaagtgatggtgatgcctcctgtttatcatcctttctttctggtgacagaacacaaccacagggaggtagtctacagtccgttattgctgaaagacgggcaatatcagattgattttgaacgcttccgtgctgatgtaaagggctgtaaaatgttgattttgagtaatcctcataatccgggagggcgtgtctggactcgggaggagttggccgagatagcagagatttgttttgataatcaagtattggtcatctcggatgaaattcatgccgatctgacattgccgggatacacgcatcctacgtttgcattggtatcggaaaaggctcgacggaattcacttgtgtttatgtctcccagtaaagctttcaacatgccgggacttgccagttcgtactgcattatagaagatgaggccattcgtcatcgttttcagacttatatggaagccagtgaatttagtgaaggccatttatttgcatatcttggagtggctgccgcgtatagcaacggaacggagtggctggatcaggcattggaatatattcaggagaatattgattttacagatgaatatttaaaaacacatattcccgcaatccggatgattcgtcctcaagcttcttatctgatttttctggactgtcgcggtatgggtgtttcgcagaaagaattagttgacttttttgttgacggtgcacatctggcattaaacgatggcgctatgttcggtaaggaaggcgagggatttatgcggcttaatgtggcttgtccgcggagtgtgttaagacaggcactggatcagataaaggaggcatacgagttgaagcatgacacaatagcataa

SEQ ID NO: 1168 - DNA, 2589 bp, B.fragilis
tccccgataaccttggacttcttgtcttttattactaactttgttatcactataaacctaacaaccagtgcaattatgaagaaaggattcaaaattacagcaatcgtcatcggcgtcattctgatactgatgtttctccttccctttgccttccgtggcaagattgaaggtatcgtaaaatcggaaggcaacaaaatgcttaacggtcattttgattttagtagccttgatatcagcttattccgcaatttccccaaagcttccgtcaccctgaatgatttttggctgaagggaaccggagaatttgaaaacgacacattggtgaaggccggtgaggtaacagcggctattaacctgttttcgctttttggagatgacggatacgatgtatccaaagtatctgttgaaaacacccgattacacgccatcgtacttcctgacggaaaagctaactgggatatcatgaaacccgattcatccactgccagcgaaacccaagaaagtggtgaatcttctactttccgaattaaactccagcgttttgtcatcaaaaacatgaatgtggtatatgacgaccggcagtccgcgatgtacgccgacatacacaatttcaatgcgctttgttcgggtgatctgggtagcgaccagactttactcagcctggaagccgaaactgaagccctgacttataaaatgaacggtatccctttcctctcacaagctaacgtctacgccaagatggatgtagatgccgatctggcacacaacaaatttacactgaaaaagaacgaattccgtctgaacgccattaaagccggcattgacggatggatagagttgaaagaccctgctatcgacatggatttgaaactcaacaccagcgaaataggattcaaagaaatcttgtcactgataccggccatttattccaaagagttcaagaatctgaaaacagatggtacagcaactcttgaagctacagcgaaaggaatactgcaaggtgacacggttccacagttcgatgtccgactggctgtaaaaaacgccatgttccgatatccatccctgccggcgggagtcgatcagattaacatcgacgcacaagttcggaatccgggaggtaacattgacctgaccgagataagcatacatcctttcagtttccgactggcggaaaatccgtttagtctgacagccgacataaagacacctgtcagcgacccggactttacagccgaagccaaaggggtacttaatctgggcatgatcaagcaagtctatccgctggatgatatggagctgaatggtactgttcgtgcggatatgacaatggccggacacttgtcatacatcgaaaaggaacaatacgatcgtttctccgcttcgggaaccattgccctcagtgatatgaacttgaaaatgaaagagatgccggatatagaaataaaaaaatccctgttcacattcactccgaaatatctgcaactcagtgaaacgacagtagccatcggaaagaatgatcttactgccgactgccggttcgagaactatatgggctatgctcttaaagggggcacactgaaaggtaccctgaatgtccggtcgaaccatctgaatctaaacgattttatgacggccacaactgacagtgccgcccaaacatcacaagcatcttcgaccgaagaaaccgccagtatgatcgaagttccgcagaatatcgacttccagatggatgccggcctgaaagaagtgttatttgacaagatgacttttacaaacatgaatggcaaacttattgtgaaagacggaaaagtcgatatgacaaatctgtcaatgaacaccatgggaggaagtgtcgttatgaacggatactattcgaccgccgatccgaagaagccggaaatgaacgcaggattccgtatggaaaatatcggttttgcacaggcttacaaagcactggatatggtgcagcaaatggctcctatctttgaaaacctgaaaggcaacttttcgggtaatatgcatatccggactttactcgacaaccagatgagccctgtcatggatacgatgcaaggaaacggaagcctttcgacccaagatcttagcctcagcggcgtaaaagtaatcgaccagatagccgaagccgtaaagaagcctgaactcaaagagatgaaggtgaaagatatggcactggatttcaccatcaaagacggaagagtatctaccaagccgttcgatatcaaactgggtgactatgtcatgaatctttccggaagcacaggactcgaccaaaccatcgactattcgggaaagatcaaattaccggcatcggcaggtgatatcgccaaactgactaccctcgacctgaaaataggaggtaccttctcctcacccaaagtatcactggatacgaaaagcatgaccaatcaggcagtagaagcggtgacagacaaggcaatcagcgaaatagggaaaaagctcgggctggattcggctacaacggccaacaaagactccgtgaaggagaaggtaaaagagaaagccgtagaaaaggcacttgattttcttaaaaagaaaataaaataa

SEQ ID NO: 1169 - DNA, 1107 bp, B.fragilis
atggaaaaaacgaagcgggatagcagacatattgatcctttgaaagacgaagaaaagttcttccagtggttaaaattcaagagcgttcggatgaatcaagaacacctctcgaaagatgactatgaacgcctgcgtcagcgaatccatgtttcgctgcgtatgttacgtcggaaaagaacggtcaggagggtagcttattatggtgtatccgtatgcgtcattattgcattaggaattgttgcttatctgaatcattatgagagagtggaacctgtgccgtctgttgtcgaaaaaaaagcagagattgtctggcaacctttgaagtcggaagatattcgtctggttagcggtgatagcataacttcgttccggcaaaacgtgcaattgctcttgagcaaggatggatcagctatggtatatcatcctaatagcgggcagaagcgaatcagaatggaacaggacgaggttaatgaactggtggttccttatggtaaacgatcgaaggttaaactggaagatggaacggaaatctggctgaattccggttcggtacttaagtttcctactcatttctcgggagagaaacgggaagtaagcttgaagggtgaaatgtatgccgaagttacggcagatagtaaaaaaccgtttatcgtgcatacggcccattttgatatacaggtatatggaacgcgtttcaatatatcggcttatgaagatgaaccgactccttcgtgtgtacttgtagatggaatagtcggattccgtccggaatccggtcctgaaatacgcatgaagacaaacgaaaaagtgctttatgatggcaagcgatttgaaaaaagaaaagtgagtgcgtccagatatacttgttggaaagaaggctatctggaattggatgatgccaatatcatggatgtactgaaccggatagggagatattataatctatcgtttagcttcggcgataagaagcggctgaccggtaggaagtgttcaggaaaaatttatttatccgataatatagataatgtattgacaactatatcattgctgtattctactgattacaggaaagaagaacggactatttttatatctgagaacccataa

SEQ ID NO: 1170 - DNA, 942 bp, B.fragilis
tattctatgactaaaccggctccgacgcctttatataacgaatttactttctttctgaaaaaatactttccctataaggtacagaagatatctcttaatgcgggttttacatgtcctaaccgagacggaacgaagggattgggaggctgtacgtactgtaataaccaaacattcaatcccgagtattgtaaaacggagaaatccgtcacccggcaacttgaggaaggaaagcaattctttgcccataaatatccggatatgaaatatctggcttattttcaggcttataccaatacctatgccgagcttgaaggactgaaagggaaatatgaagaggctttgagtgtggacggggtggtgggactggtcatcggcacacgtccggactgcatgcctgatcccctgttgcgatatctggaagaactgaataagcacactttccttttggtagaatatgggattgaaactacccgggatgttactttgaaacgtatcaaccgtgggcatacctatgccgatacggtagaaactgtcaaccggacggctgcttgcgggattctgaccggaggacacgtcatcctcggtcttccgggagagacccatgacgaaattatcgctcaggcggccgaattgtcccgtttgccattgaccactcttaaaatgcatcagttgcagttgatacgtggtacgaaaatggcacgtgagtttgagtgccgccccgaggattttcatctctttagtgtggacgagtatatcgatctggtaatcgactatgtggaacacctgcgccccgatctgatacttgagcgatttgtttcacaatcaccgaaagaacttctgattgcacccgattgggggctgaagaattatgaatttactgcccgcgtgcaaaaaagaatgaaagaaaggggtgcttatcagggaaaggcatacctggtttag

SEQ ID NO: 1171 - DNA, 879 bp, B.fragilis
aaacagtactatatgggaaacgataaacgggtgcgcaaacccgaatggcttaaaatcagcattggagccaatgaacgctataccgagaccaaacgcattgtcgaatcgcactgcctgcacaccatctgtagcagtgggcgttgccccaacatgggcgaatgctggggaaaagggacagctacgttcatgattgccggtgacatctgtacccgcagttgtaaattctgtaatacccagaccggacgacctctgcctttggatcccgacgaaccggcccacgttgcagaatcgattgccctgatgaaactctcacacgcagttatcacatctgtagaccgcgatgatctgcctgatttgggtgcagcccattgggcacaaacaattcgtgaaatcaaacgactaaatccggaaacaactaccgaagtactgattcccgatttccaaggacgcaaagagcttattgaccaagtgataaaagcctgtcccgaaatcatctcccataacatggagactgtgaaacgcatcagtccacaggtgcgtagtgccgccaactatcacaccagcctggaagtgatccgccaaatagccgaaagcggtattacggcaaaatcgggcattatggttggtctgggtgaaactcctgctgaagtagaagagttaatggacgacctgatttccgtcggttgcaaaatcctcaccatcgggcaatatctgcagccaacccacaaacacttcccggttgcagcatacattactccggaacagtttgctgtttataaagaaacaggactgaagaaagggttcgaacaagtggaaagcgcaccattagtacgctcctcgtatcatgcagaaaaacatatccgatttaataataagtag

SEQ ID NO: 1172 - DNA, 450 bp, B.fragilis
caactggaacaaagcatgaaaagagaacgtatagtaagaactgaaaacattgatagacagagaataaaatatagagtattgtttggttttattttcattatgtgctgtaacggggcagctttaccgtcggaggacggcaagatgccggactggaaattttcttttagtctgaaacgtataccgatgatccggatttttgatgaaatcgagcaaaaaagtgattttgtctttgcatggtcctgcgatatcgacaacgagattcatgaggaaatcagtatttgtgttacggaagaacccattcaaaaggtaatggaaaaggttttgaaaggatcgggacttgtttatcagagactcgacaggcaaattgttgtttatcgtttgctgggacacaatgcctgtagagtagattctgtgagagtgatgactaatatggaacagaatgatcgatag

SEQ ID NO: 1173 - DNA, 1095 bp, B.fragilis
gtctgcgtgcaatggctacttacgaaaaggggctggacgaatataaagacgaaaacggtaatatcatttacggttaaggtaatgaaaatacggaaagacgatattcttcttattttgctgagtctgcttttcgcagactgccgggtggggaaagcggaacctgtggcggaccctatggaagaagagggaatttccgtagtcagatatgataagctgttggacgaatacgttcgtttcaacagcttttctgctttacaaaaaatgaacctggagtatgccttgcccaccaaactgttgattgaagatgtattggctattggccaggtgagcgatgaccatattttccagcgattgaaaactttctattcggatacaaccttggtccgtcttatagaagatgtggaggccaaatacccggaattggaatcggttgaaaaaaatctgaccaaagggttcgggaaattacaaaaggagattccggatatcatgattcctatgatatatacgcagatctcggcattcaatgaatccattgttctgtctgacagcgtgttgggtattagtcttgacaagtatatgggtgaagactatccgctttacaagcgtttctattacaactatcagcggcgtactatgcgtcctgaccggatcgtccccgattgtttggtgttctatctgatgagccagtatccttttccgatggattactcccgtacattactcgatgtaatgatgcattatggtaaaatcaattatgtggtacaacatctgttggactattcctcatcggaagaagcgttgggatattcggatttagaaagggaatggtgtaaagagaaccaacagcagatgtggagatatattcttgagcaagatcatttgcatgctacggatccgatggtggtacgtcaatatacccgtccggctcctttcactaacactttaggcgagaatgcgccttcgatggtaggtacctggatcggtacgaaaatcatcacttcgtatatgaaacatcataagaaaacaactttacggcaattgcttgaaatgagcgactatgaacgtatgttcacggaatcgcgttttaatccgtaa

SEQ ID NO: 1174 - DNA, 258 bp, B.fragilis
tacaggcataaaaataaagaagaggataggccggaagaacttttggcttatcctcttctctttatcagtctgacacgaaagtctgttgaggaactaatctttcagaccgtctttgatcccttccattgctttctcaccttttttagcagccttttgcgcaccttcttttacgtctttggctgcatctttggctgtatctttgactttctcaaatgcatctttggtgctttctttcacgtcatctcctattttctttaa

SEQ ID NO: 1175 - DNA, 2712 bp, B.fragilis
tgtatgacaaaaaaaatcaacctgtttccaagccttatacggtttcgggaaaccaatcgcctaaaaatggcaattgctgcatctatcatgctatggtgtatggcaccccaacaagcagttgcagatacgtatgaaaaacacgaagttgccagtattcagcagcaaaaggtaaaagcgaacggtactgtagtagatcagaccggcgaacctctaatcggcgtttctgtaaaagtaaaagacgcgcctaatggaacaatcaccaatttagatggtaaattctccatcgatgtagccaaaggtgctacacttgaaatatcctatgtgggatataaaacggtcattgtaaaagccgaatcaaccccaatgcacattgtcttaaaagaagatagtgaaatgatagatgaggtagtggtagttggttatggctcacagaaaaaggttaatgtcaccggtgccgtaggcatggtcaattccgaagtacttgaagctcgtccggtacaaaatgtatcgcaagctttacaaggtgtggtaccgggtttgaacctctccgtcaacaacggtggtggttcactggatagtgagatgagtattaatattcgtggtacaggtaccatcggcgacggctccggatcgtctccattggtattgatcgatggcatcgagggcagcctgaatacagtaaaccccaatgatattgaatcggtatcagtactgaaagatgctgcatcagcttctatttatggtgcacgtgccgcattcggtgtggttttggtaaaaaccaaaagcggacaatcgggaaaacccagagtgacctattcgggtaatgtgcgcttctctgatgcgactaatattcctgaaatgctggattcttatactttcgcacaatactttaaccgtgcagcggcaaatgataatggtggtactgttttcagtaaagagcaactggaacgcatcaaagcataccaggatggtaccttaaaatcatcagctacctttaacgaacaatcacgccgatggaactactatacgggatcgaatgcaaataccgactggtttaaggaagtgtatgaagattgggttccttccatggatcacaatcttagcatcagtggtggcacagataaaactcaatatattgtcagtggaagctttctcgatcagaaaggtttgatccgccatggcaaagataccttccagcgctacactttaaatggtcgaatcacaagtaacatcacagactggtttacattgggatattcaaccaaatggacacgtgaagattatgatcgtccaagttacctgacgggattgttcttccacaatgtggcacgccgctggccgactgtacctgtctatgacgataacggatacctgaccgaaccatccgaactgatccagctggaagacggaggcagacaaatcaaccagaaggacctcttcacacaacagctgcaactgaccttcgaaccaatcaagaactggaaaatttatgtagaaggaagtttgcgtgtaaccgccaataaccaacattgggaagtactgcctgtttatcagcacgatgtagacggtaacccggtaggtatgacatgggatgcaggtgtaggcagctatccggtaggcggttcaaaagtgtctgaatatgcttataaagagaattactattctaccaatatctattcggattacttcaagcaactggataacgggcactatttcaaggcaatggtaggtttcaacgccgagctgtacaaggaccgcagtgtaagtgcggacaaatcaaccttgattactccatccgtaccgacaattaataccgcagtaggtgaacccagtgtagcaggtggatacagacatacctcagtggccggtttctttgcccgtttaaactggaactacaaagaccgctacatgctggaagccaacggacgctacgatggttcttcacgctttatcggcgacaaacgttggggattcttcccgtcattctcaggtggttggaacatcgcccgtgaagcatttttcgaagaaaccgccaacaagttgaaaattggtacactgaaactgagagcatcgtggggacagttgggtaacaccaacaccaatgaagcctggtatcctttctatcagactttaccgcaaggacagaactacggatggttagtaaacggtgtacgccagaattatgccagcaatccgggtatcgtcagtagcgaaaagacctgggaaaccatcgaaacatgggatgccggtctggactggggattattcaacaaccgtctgaccggttcattcgactatttcgtacgttacacatacgacatgattgccaccgctccggaactcccctctattctgggtacaggtgttcctaaaatcaataatgccgacatgaaatcgtatggtttcgagttggaaatcggctggagagacagaatcaaaaacttctcttatggagtgaaatttgtcctctcggatgcacaacaaaagattctgaaatacaacaatcccgacaagagtcttagtaatccttattatgaaggacagaagctaggagagatatggggatacaaaacaattggaatcgcacaaagcgatgaagaaatgaacctacatcttgccaatgccaagcagccgatggggcagaaatgggcagcaggtgacatcatgtatgccgatctcgacaatagcggctcagtggaccaaggtgtcttc

SEQ ID NO: 1176 - DNA, 732 bp, B.fragilis
tatatggaaaagaaagagttttcatctcctgctcggagatacggtaagttttttatcgcctttatttttataacggcaggagtgcttttgctggctcgcaatctgggatggatttcttataccttgtttggtattttggtttcctggcaaatgttactgattcttttaggaatttacttgattttgcggcgtcagattttgcggggcgggatactgcttgctatcggtgcctatctgatcagtccgtatttggaatggatgcctgcaggagttcatgtcactcttttcccgattgtcctgattgttatcggacttgcttttctgttcaggccgaaacgtgcccggcacgagcgttcgcaccgagggaactttgccagtagccaatataactcaacagatggagtgctgcactccgaaaacacatttagcggcatcaggcaggtggtgctcgatgaagtgtttaaaggcggaactatacaaaactcttttggcgggacggttatcgacttgcggcgtacgactcttcccgaaggagaaacgtttctcgatattgattgtacatttggtggaatagaaatttatgtgccttccgattggaaagtagtgtttcggtgtactacctgtctgggcggttgtcaggacaaacgttttggcgggggtatgatcgatcagaaccggatattggtgatccggggtgatttgacattcggaggtattgatataaaaagttga

SEQ ID NO: 1177 - DNA, 825 bp, B.fragilis
aaacaatcgaacatgagactaatcattcagccggactatcagtccgtttctcaatgggcggcacattatgttgctgctaagatcaaagctgccaatcccactccggaaaaacctttcgttctgggatgccccacaggatcatctccactgggtatgtataaggcactgatcgacctgaataaaaaaggaatcgtatcgttccagaatgttgttactttcaacatggacgaatacgtaggactgccgaaagaacatccggaaagctactattcttttatgtggaacaacttcttcagccatatcgacatcaaaccggagaacacgaacattttaaatggaaatgctgccgatctggatgctgaatgtgcacgttatgaagaaaagatcaaatcgtatggcggtatcgacctgtttatgggaggtattggtcctgacggtcatattgctttcaacgagccgggctcttcgctgagttctcgtacccgtcagaaaacactgacaacagatacgatcattgcgaactctcgcttcttcgacaatgatattaacaaggttcccaagacttcgttgactgtaggagtgggtactgtgctttctgcccgtgaggtgatgattatcgtaaacggacacaacaaagcacgtgcattgtatcatgccgtagagggtgccattacacagatgtggacgatcagtgcattgcagatgcacgaaaaaggtatcatcgtttgcgatgatgctgctactgccgaactgaaagttggtacttatcgttatttcaaggatatcgaagcagatcacctcgatccgcagtcattgctgaagtaa

SEQ ID NO: 1178 - DNA, 963 bp, B.fragilis
tcaaattcactgtattttttgtggttttcctcttttctttgcacacttttcgtgcttttatgcagaaaatctatatctttgcaacctaatttaacattaaaaggtatgagttacaatttgttgaaaggaaaaagaggtattattttcggtgcattaaacgagcagtctattgcctggaaagtagccgaaagagccgttgaagaaggtgctgttattacattatcaaatactcctgttgctgttcgcatgggacaggtttctgctttatcagaaaagctcaattgcgaagtgattgctgctgatgccaccaacgtagaagatttggagaacgtattcaaacgctcgatggaagttttgggcggacaaattgattttgtattgcactctatcggtatgtcaccgaatgttcgtaagaaacgtacttatgatgatctcgattataatatgttgaatactacgctggatgtttcagctgtttcgttccataaaatgattcaggctgccaagaagcaaaatgcaattgcagaatacggttctatcgtggcattgagttatgtagctgcacagcgtactttctacggatataacgatatggcggatgcaaaagcattacttgaatctattgcccgcagttttggttatatctatggtcgtgagcacaacgtgcgtgtgaatactatttcccagtcgcctacctttacaactgccggttctggtgtgaagggtatggataaactgtatgactttgctaatcgtatgtctccgctcggtaatgcttcagccgacgaatgtgctgattactgtatcgtaatgttctccgatcttacccgtaaggtaactatgcagaacctgttccacgatggaggtttttcaagtgttggtatgagtctgcgtgcaatggctacttacgaaaaggggctggacgaatataaagacgaaaacggtaatatcatttacggttaa

SEQ ID NO: 1179 - DNA, 474 bp, B.fragilis
ttggcggcactacgcacctgtggactgatgcgtttcacagtctccatgttatgggagatgatttcgggacaggcttttatcacttggtcaataagctctttgcgtccttggaaatcgggaatcagtacttcggtagttgtttccggatttagtcgtttgatttcacgaattgtttgtgcccaatgggctgcacccaaatcaggcagatcatcgcggtctacagatgtgataactgcgtgtgagagtttcatcagggcaatcgattctgcaacgtgggccggttcgtcgggatccaaaggcagaggtcgtccggtctgggtattacagaatttacaactgcgggtacagatgtcaccggcaatcatgaacgtagctgtcccttttccccagcattcgcccatgttggggcaacgcccactgctacagatggtgtgcaggcagtgcgattcgacaatgcgtttggtctcggtatag

SEQ ID NO: 1180 - DNA, 1110 bp, B.fragilis
  unsure (1097): Identity of nucleotide sequences at the above locations are unknown.
cataatttgtggaatttatataaaaagactttcaggatgaaaaaaaatagttttgagacacaaatattgcatactccttttgaaaaagaggatgcatatcattctctttcaatgccggtgtaccatactgctgcctacgaatttgagactgcagaagagatggaagctgctttctgtgggcagaaagccgggcatgcttattcacgcataacaaatcctacggtacagtactttgagcagcgtgtgcaaagagtgaccggagcgctgagtgtgacagctttgaactccgggatggctgcgataagcaatgctttgatcacactggcaagcgcgggagctaatgtggtgacttcgaaacatttatttggcaatacctattcatttctgaaaagtacattggaagcttttggggtagaagtacgcttctgtgacctgacatgtcccgaagaagtgaagcaacagattgatggagatacttgtgcgctttttttggaagttattaccaatccgcagttggaagtggccgatctgaaggctcttgccgacatagcacataaggccggagtaccgttgctggcagatacgacagcgattcctttccatgtattccatgcgactgacttcggagttgatatcgagattgtgtccagtacgaaatatatttcgggaggagctacctgtataggaggactgattatagattacggcacttttgactgggagcattccgctaagttggctgctctgagtgcagataccgggaaggaggcttttactgtcaaactcagaaaagaggttcaccgtaatcttggagcatatatgaccccgcaggtggcttatatgcagacactcggacttgaaacgatggaagtacggtttgctcgtcaggcagaaacctgcctgaaactggcacaatgtttgcaagaactgcctgagattgagtcggtgaactataccggattggaatctaatccgttttatgaattgagtacccgccagtttggttctcttccgggagcgatgttgacgtttgatcttccgtcgcgtgagatatgttttcgtttcataaatcggttgagattcatacgtaagggcancgactttatttga

SEQ ID NO: 1181 - DNA, 201 bp, B.fragilis
agtgtagcgctggaaggtatctttgccatggcggatcaaacctttctgatcgagaaagcttccactgacaatatattgagttttatctgtgccaccactgatgctaagattgtgatccatggaaggaacccaatcttcatacacttccttaaaccagtcggtatttgcattcgatcccgtatagtagttccatcggcgtga

SEQ ID NO: 1182 - DNA, 1125 bp, B.fragilis
aaacatatgggtaacaaaggagtactttcttctgcatttaatatgtcattgggctttatccctgttattgtttccatcctcttatgcgaatttataacacaggacatatcaatctatatcggtacaggtatcgggcttatctattcgtataggtctctgtctcgtaaaggggcccgcatacccaattttatcctctatatctctacgggaatcttgacattactgactctggcaagctttattcccggagatttcgttccggaaggagcattgccgcttacacttgaagtcagcatactgattccgatggttattctattcctgcacaggaggaagttcatcagccactacctgcgtcaaaatgcccaatgcaaccggcggttgtttgctcaaggagcagaatctgccattgtatccgcacgggtcgtactgattttaggtattctccattttgctgtcatcagcctgacggttttggtagcacatcccctcacccggacttccatacttgtactttatcacgtattgccgcctactatatttattctcagcatcctgctcaatcaaataggtatccgttactttaatcatgtaatggcgcatacggaatatgtccccatcgtcaatacccgtggtgatgtaatcggaaaaagtctggctgtggaagctatcaactataagaatgcctacattaatccggtgatacgcattgctgtttccacccacggcatgttgttcctctgtaatcgtccgcaaagctgcatcctcgataaaggcaaagtggatataccgatggagtgttaccttcgatacggggagacactgacggcgggagccaaccgcttattgagcaatgcttttccgaaggcctctgatctgaaaccgacatttaccatctcctatcattttgaaaacgaacagaccaatcgtttggtctatctgttcattgtcgatatggaagacgactccattctctgcgatccacgattcaaaggaggaaagttatggactttccaacaaatagagcacaacttaggtactcacttcttcagcgagtgtttcgagttggaatacgagcacctgaaacaggttattggtataagagaaaaatacaaggtatcttag

SEQ ID NO: 1183 - DNA, 2022 bp, B.fragilis
aacatttcgggatcatctgacgtggaatttacaatagacaccggtaataaggagtttcaggatgcactgaatctgattcagtatactcgtcaatcagttttcctcacggggaaagcgggaacgggtaaatctactttcctgaaatacatctgtaagaataccaagaagaaacacatcgtgctggcacccaccggaatcgctgccattaatgccggtggcagcactctgcacagcttcttcaaacttccttttcatccgttacttcctgatgatccgaatctgagtttgcaacggggacgcatccatgaattctttaaatacaccaagccacaccgtaaattgctggaacaggtagaactggtcattatcgacgaaatatcaatggtacgcgccgatatgattgatgccgtagaccgcattttgcgtgtatacagtcgtaatctgcgcgaccccttcggaggaaaacaagttttactggtaggcgatgtattccagcttgaaccggtaatcaaaggggatgaacgggaaattatcaaccgcttctatcccactccttattttttctcggcacgggtcttcaacgagatcgaattggtatctatcgagttacagaaagtatatcgtcagtcagatgcagtctttgtcagtgtactcgaccacatccggagcggagcagcaggggcagccgaccttcagctgctcaacacccgctatggcgctcaaattgatgcttcggaagaagatttatacatcactctggctacgcgccgcgatacggtagaaaccatcaatgaacggaaacttaccgaactccctggcgatcctgtagtgtttgagggagagatcaacggcgactttcccgaaagtagcttgcccacctcaaaagaactgaccctgaaaccgggagcacaaatcatctttatcaaaaatgactttgaacgccgttgggtaaacggtaccatcggtgtagtaagcggcatcgacaacgacggtatcatctacgtcatcaccgatgatggcaaagagtgtgatgtccaccgggaatcatggcgcaacatccgttacaagtacaacgaagagaaaaaggagattgaggaagaagaactgggtactttcacacaatatcccatccgcctggcatgggccatcaccgtgcacaaaagccagggtttgacctttagccgtgtagtcatagactttaccggaggagtgtttgccggcggacaagcttatgtagctctcagccgttgcacatcgcttgaaggaattcaactgaaaaagcctatcagccgcgcggatatttttgtccgtcccgagattgtcagtttttccggaagattcaacaaccggcaagccatcgacaaagcattaaaacaagcacaggccgatgtgcagtatgccgcagctgcccgtgctttcgacaaaggagatttcgagacatgcctcgagcagtttttcctggccattcattcccgttatgatatagaaaagcctgccgcccgaagattaattcgcaggaaattgggagtcgtcaacctattgcgggaacaaaaaaggaaactacaagcacaaatggaggcacagaaaaaaagcctgcaaaagtatgcccgagagtatttgctaatgggaaacgaatgtatcactcaggcgcatgacgttcgggccgcccttgccaattatgacaaagcgattgagctctatcccgaatacatcgacgcctggatacgaaaaggaatcacgctgttcaacgaaaaagagttcttcgatgccgagaattgcctgaaccgggcagtcagcctgcgtccttcagagttcaaagcactctataaccgaggcaaacttcgcctgcagacagaaaacatagaaggggctttatcagacctcgacaaagcaactagcctgaaacctgaacatcccggagcacacgaacttttcggagatacattattaaaagtcggtaaagagacagaagcagccatccaatggcgtatagcagaggaactacgaaaaaagaagaaataa

SEQ ID NO: 1184 - DNA, 624 bp, B.fragilis
cagacaattatgatactcaaactttacgaaaaaaataataatcctcaggacctgcaacggattgtagacctactgaacgacgggggattgattatctatcccacagacaccatgtatgccatcggttgccatggcctgaaggaacgtgccatcgaacgcatctgccggatcaaagagattgacccgaagaaaaacaatctctctattatttgctatgacctgagcagcatcagtgaatatgccaaagtggacaacaacattttcaagttgatgaaacgtaacctgcccggacctttcacttttatcctgaacggaactaaccggttgcccaaaatctttcgaaaccggaaagaagtaggtatccgtatgccggataacagtatcatccgtgaaattgcccgtctgctggatgctccgatcatgaccaccacgttgcctcatgacgagcacgaagacatagagtacgtcactgacccggaactgatcgacgaaaaactcggtgacgtagtggacctcgtgatcgacggaggtatcggggggattgaaccttcgacagttgtgaactgcactgaaggagaagctgccatcgtccggcagggaaaaggggaactggaagaggcctga

SEQ ID NO: 1185 - DNA, 435 bp, B.fragilis
catttgattatgaaaaaagtattattctttgcattggtgctgaccattgccacagcatgcagccaaacaaaagattcgtatctggagggctttaagctttttatcgaaagcgtacagaaaaacgctcaagactatacaaaagccgactgggaaaaggctgacgaacaatttacgaaactgaaagacagttataataacttcagtaaacaaatgacttcggacgaaaaaggagaagtgataaaactggaatccacttatgctgccctaaagttaaagaaaataggagatgacgtgaaagaaagcaccaaagatgcatttgagaaagtcaaagatacagccaaagatgcagccaaagacgtaaaagaaggtgcgcaaaaggctgctaaaaaaggtgagaaagcaatggaagggatcaaagacggtctgaaagattag

SEQ ID NO: 1186 - DNA, 2238 bp, B.fragilis
aaacaacctataaaatcatctaagccaatgaaaagaaaattcatttttctgtttttctgtctgtgctgccttgccggctttgcacaaggaggcaaagcgctcgacctgaaagaaattaactcgggcaagttcagccccgaaaacatttatggtgtggttcccatgcctgacggcgaacactacacacaaagaaatgccgaaggtacacagatcgtgaaatattccttccgcacgggtgaaccggtggaagtggtattcgatgtgacaaaagcccgcgaatgcccctttaagaaattcgacagttaccaattttcaccggacggatcaaaaatactgattgcaaccgaaaccaagcccatctatcgtcattcttatacggcagtccactacctgtatccggtgaaacggaacgacaaaggagtgactaccaacaatattgttgaaaagctatcggacggtggtccgcagcaagccccggtattctctccggacggaaacctggtggcgtttgtccgtgataataacatcttcctggtaaagcttttgtatggcaacagcgaatcgcaagtgactgaagacggcaagttgaacagtgtactgaacggtattcccgactgggtatacgaagaagagttcggtttcaaccgtgccctggaattcaatgccgataataccatgctggcctatgttcgtttcgacgaatcggaggttccatcatacactttccccctgtttgcaggtgaagcaccgcgttatgatgcactgcaggattatccgggagaatacacttacaaatatcccaaagcaggttaccccaactccaaggtgtcagtacatacgttcgacatcaaatcgaaagtgacccgtcaggtgaagctgccgatagacgccgacggatatatcccgcgcatccgtttcactcaggatcccaacaaactggccatcatgacactgaaccgtcaccagaaccgcttcgacatgtattttgccgatcctcgcagcacagtgtgcaaactggccctacgcgacgaatctccttattacatcaacgaaaatgtattcgataacattcagttctatcccgaatatttcagctttgttagcgataagagcggatatcctcacttgtactggtatagcatgaacggtaacttgatcaaacaagtgaccagcggtaactatgaagtaaaaaactttatcggatggaatccggataccaacgagttttattacaccagcaatgaagaaagcccgatgcgtcaggcggtatacaagatagaccgtaagggcaagaagatgaaactgagcaatcagccgggaaccaacagtcccatcttcagcagctcgatgaaatatttcatgaacaagtttaccagcctcgatactccgatgctgattaccttgaatgacaacacaggtaaggtcttgaagactctcgtaacaaatgataaactgaaacagaaactggccgaatatgccataccgcaaaaagaattcttcacgttcaaaacaacagaaggagtcgatctgaacggctggatgatgaaaccggtcaatttcgatcctgccaaacgttatccggtactgatgttccagtatagcggtccgggttcgcaacaggttctggacaaatggggaatcagttgggaaacctacatggcgagcctcggttacgtggtagcttgtgtagatggtcgcggcacaggtggccgtggcagtgaattccagaaatgcacctacctgaacctgggtgtaaaagaagctaaagaccaggtggaagctgccaaatatctgggtggactgccttatgtggacaaaggacgtattggtatctggggatggagtttcggcggatatatgaccatcatgagtatgagcgaaggtacacccgtgtttaaagccggagttgctgtggccgcacctacagactggaaatattacgatacagtatataccgaacgctttatgcgcacgccgaaagaaaatgccgaaggctataaagcagcttcagcattcagccgtgcagacaacctgcatggtaacctgctccttgtacacggtatggcagatgataatgttcacttccagaactgtacagaatatgcagagcacctggtacaactcggaaaacagttcgatatgcaggtatacaccaaccggaatcatagcatctatggtggaaatacccgtaaccacttgtatacgaagctgacgaacttcttccggaataatttataa

SEQ ID NO: 1187 - DNA, 846 bp, B.fragilis
aacatggatatacatcctatacaagaatcttcccggcggtggatgacggcattgatattggccgttgtagcagcagggatacaaacaactctactttggggctatgccggagccgacacgcttccggctgcaatagacgggattttatctgtcggattgctttgcctcctggcctatctggcatggtatgtcattggccttgtctctatattgcagaccgacttactgatagccgctttggctctgcttttctggctggcgggaggctttgctgtgcaatatgtgctggaacagaatatgggacaagtatatgctccttttggtgagacgcttcctttccgtatattgtttggagcattggcctggggagtgatgatgttgtggtatcgcttgcagtcgctgaataccgttcaggaagagatattagaagaggctgtttcgagagaggaagcccttcgtgaagaattgaggcagattgaatgccgcgaagataaagcgttgccggaagaggcggaatgtattgaccgcatcacggtgaaagatggtacacatattcatctgatccgtaccgacgagttgctttacatacaggcatgtggcgattatgtcacattggtgaccccttcgggacaatatgtcaaggagcagaccatgaagtattttgatgcccatctgccatcagcaggatttgtgcgtgtgcatcgttctacaatagtgaacgtgacgcaaatatcacgggttgaactctttggaaaagaaaattatcagctctcgttaaaaaacggcgtaaggctgaaagtgagtaattccggatataaattactgaaggagcggttggaactttaa

SEQ ID NO: 1188 - DNA, 1209 bp, B.fragilis
aaaaaaagaatggaacagaaaacaagaattaaaggaaacgttcattatgtgggagttaacgaccgtaacaagcacctctttgagggaatgtggcctttgccctatggagtttcgtataactcttatctgattgatgatgaaatggtggcactgatcgatacagtggatatttgctatttcgaagtatatcttcgaaaaatcagaaatatcataggcgaccgtcctatcaactatttgattataaatcacatggaaccggaccattcaggttctatccgattgattaagcaacactatcccgacattgtgatcgttggcaataaacagactttcggtatgatcgaaggtttttatggtgtgaccggcgagcaatatctgattaaggatggtgattttctcgctcttggacgtcataaactgcgcttttacctgactccgatggtacactggccggaaacgatgatgacatttgacgaaacagatggcatactcttctccggtgatggtttcgggtgttttggtacgctggatggcggcttcgtggatacacgcatgaatatcgaccattattggggcgaaatggttcgttattattcgaacatcgtcggcaaatacggttcaccggtacagaaagctttgcaaaagttgggtggacttcctatctcggctatttgttctacgcacggtccggtatggactgagaatatcacgaaagtggtaggcatttatgataaactgagccgttatgacgcagatgaaggtgtggtaattgcatacggcagtatgtacggtaataccgaacaaatggcagaagccattgcagctgagctttcggcacagggcatcaaaaacattgtgatgcacaatgtcagcaaaagtaatccctcttatatccttgccgatatattccgttataaaggattgattatcggtagccctacttacagtaaccagattttcccggaagtggagtcgcttctgtccaagatattggttcgtgaattgaaaggacgttatctggggtatttcggttcgttcacgtgggcaggtgccgccgtgaaacgtatggccgagtttgcagagaaaagtaaatttgaattggtcggtgatcctgtagaaatgaaacaggccatgaaggagatcacatatcaacagtgtgagaacctggcacgtgctatggccggccgtttaaaaaaagacagagtataa

SEQ ID NO: 1189 - DNA, 879 bp, B.fragilis
cagacagcagttaaaatttaccatcattgtggtattcagttactctatatcaggctttttcagtacatttgtgctccattaaagaaaagacgtatgataaaagccctgtttttcgatatagacgggacgttggttagtttcaacactcacgaaattccttcgtctaccctcgcagccatagccgaagcaaaagctaaaggtatcaagatattcatcgctaccggacgcccgaaagcgattatcaacaacctcaccgcccttcaggaacgggaactgatagacggctacatcaccatgaacggagggtattgtttcgttggagatgaggtgatttacaaacattccatcccggtacaagatgttaaggcactggctgcactttcggacgaaagaaactttccctgtatctttgtagccgaacataccgtagctgtttgcaataccaacaagctggttaacgaaatctttcatgatttcctgcatgtagatatcctgcccatccaaactacagccgaggctacgcagcccgaaatctttcagatgactccattcatcactaccgaagaggagaaaacggtattgcctttactcccgaactgcgaatccggacgctggtttcctgcatttacagatatcgtagctaaaggtatccgcaaacaaaaaggaatagatgaaatcattcgtcatttcggtatcggacaggaagaaacaatggcatttggtgatggaggcaacgatatcagtatgttgcgccatgcagccatcggagtagccatgggcaatgcgaatgacgatgtcaaagaaaccgccgactatataaccacttctgtagacgaagacggaatacaaaaagcattaaaacatttcgggatcatctga

SEQ ID NO: 1190 - DNA, 615 bp, B.fragilis
aaagctaaatttatcatttacaaactttatacaatgctgccaaagaaaaaaaacctggaagaagagagagcgaaacatacggttgatagtctttataaggactatgttgacgacttgttttcgtatgctttgggattcgggtttgacaaacagacagcgatggatgccattcatgatgtgttttgcagggtatgtatccgagaaagagaagtgcaggagatacagaatcctaaattttacttgttgcgtgccctgcggaaccagttgattgacacctataaactcaaacgaaactactcggaggttcttaccggtgagattaccgatgaacttccatataaaatcaaaattaccgtagaggatgaaataatcgcagcggaagagcaggcggaagtatcacagaaagttgacgagattctgagtatacttaccgaacgccagcgcgagattatttatttacgttatatgcaggaatgctcttatgaggaaattgcagagattatgcaaatcagtgttcctgcctgtcgtaaattgctctatcggaccttacttaaactgaagcacaataacacattagtgctcttctatctcttactttctattaatgttggttaa

SEQ ID NO: 1191 - DNA, 738 bp, B.fragilis
tccgtaaaatttcaactattaaataccctattcatggataccgctctttatcttttgcccgtcactttgggcgacactccgatcgagtctgtattaccttcttataataaagaaattattcagggcatcaagcacttcattgtcgaagatgttcgctcggcccgccgcttcctgaaaaaggtagaccgtgagattgatattgactcactcactttttacccgctgaataaacatacttctcctgaagatatttccggttatctgaaaccgctggcaggcggtttgtccatgggagtgatttccgaagccggttgtcctgctgtagccgatccgggagctgacgtggtggctattgcacaacgtaaaaacctgaaagtagttccgttggtaggaccttcgtctatcattctttctgtgatgggttcgggatttaacgggcagagttttgcctttcacggctatctgcctatagagccgggtgagcgtgcaaaaaaaataaaagctcttgagcaacgggtatatgccgagcatcagacacagctatttatagaaacaccttatcgtaacaataagatggtggaggatattctgcataattgtcgtccgcagactcgcttgtgtattgcagcgaatatcacttgtgagggagaatatatccgtactaaaaccataaaagagtggcaaggaaaagtacccgacctgactaagataccttgtatttttctcttataccaataa

SEQ ID NO: 1192 - DNA, 1374 bp, B.fragilis
aacgggtgttcggttcccgggttgggaatctatcactccaagttccccgacgccgagagagtagagatctggcaaaagcagttgacggaggagggttacgacatcattctgggggtacgctcttcggtgttcctcccgtttcggaatctcggactggtcattgtggacgaggaacacgaaaatacgtataagcaacaagatcccgcaccgcgctatcatgcccggaatgctgccatcgtgctggcttcgatgtatggggcaaagacgttgctgggtactgccactccttcggtggagacttggcagaatgccactaccggcaaattcgggtgggtggaactgaaagaacgctataaggaaattcaattgccggagattattccggtagatataaaggagttgcaccgcaagaagcggatgacggggcagttctctccgttgctgctgcaatatgtccgcgaggcactcgataataaacagcaggtgattctgtttcagaatcgccggggatttgctccgatgatagagtgccgcacgtgcggatgggtgccaaagtgcaagaactgtgatgtcagcctgacctatcataaaggtatcaatcagctgacttgccactattgcgggtatacttaccagttgccccgttcgtgtccggcttgcgaaggggtcgagctgatgcacagaggatttggtacggaaaagatagaagatgatgtgaagctgatttttccggaagcttccgtagcacgtatggatctcgatactacacgtacgcggtcggcatacgaaaaaattattgcagactttgaacagggaaagaccgatatactgatcggtacccagatggtatccaaaggactcgactttgaccacgtcagcgtggtggggatactcaatgcggacacgatgctgaattatcccgatttccgttcgtacgaacgtgccttccagttgatggcgcaggttgccggacgtgccggacgaaaaaataaacggggcagggtagtgttgcaaaccaaaagtatagaccatcccatcatccgtcaggtgatgacgaacgattatgaagatatggtggcgggacaactggctgagcggcagatgtttcattatcctccgtattaccggatggtgtatgtctatctgaaaaaccggaacgagacgttgcttgatgtgatggcacacaccatggccgagaaactgcgcgcattgttcggaaaccggatactgggaccggataaaccgcccgttgcccgtattcaaactttgttcatacgaaaaatagttgttaaaatagaacaaaatgcgccgatgagtcgtgcccgtgaattagtcttcaccacggggctggaaggatcagcgcggtcagttcat

SEQ ID NO: 1193 - DNA, 1533 bp, B.fragilis
ataacaaactcaataaaaacaaacgcaatgttacgaaaaatcagattaacatgtggcatcatctgcctgacactgatcaccttgctattccttgactttaccggaacccttcacggttggttcggctggctggcaaagatccagttcctccctgcagtactggcattgaacgtaggagtagtagtccttttaatcatcctgacaggagtattcggccgaatctattgctcggtgatttgtccgttgggggtatttcaagatgtagcagcctggattggcaaaaagcggaaaaagttaccctactcctattctcccgctctctccctcctacgctacggggcattggcaatattcatcatcaccctggtggcaggagtaagtttcatcgcaactctatttgctccctacagtgcttacgggcgtatcgcaaacaacctgttccaacccatttggctgtggggaaacaacctgttcgcccatttagccgaacgggccggcaactatgcattttatgaagtagacatctggataaaaagtctgcctactttcattgtagccgcagctacttttgtcatcctgatattattggcatggcggaacggacgcacttactgcaatacaatctgcccggtagggacggtactgggatttctttcacgttactccttgttccgcatcacaatagatacggaaaaatgcaataagtgcggactttgtgcacgtcattgtaaagcggcctgcatcaatgctaaagaacatacgatcgattacagccgatgcgtggtttgcatggattgcctcggtaaatgcaagcagaaagcactcagttaccaattgcggacaaccaaggctcggccagcaaaagcagaagaaaatgctcttgcagcctcatccaaggaagtcaatgaagcacgtcgcaatttccttaccgtaacggcaatggccgctacggcatcagccctaaaagcacaagagaaaaaagtagacggaggactggcggccatagaagataaaaagatcccgaaccgccagactcccattacacctcccggttcgttgagtgcacgaaacatggcagcacattgcacagcttgccaattgtgcgtatcagcttgttccaaccaagtattgcgtccttccactaacctgatgaacctgatgcaacctgaaatatcatatgaacgcggatactgccgtccggaatgtaatgactgttcacaagtatgtccgacaggagccatacaccccattacagcagccgacaaatcttccactcaaatcggacatgctgtctggatcaaagcaaattgcgtgtcgctgaccgatggagtgaaatgtgacaactgtgcccgtcattgtccgacaggagctatccagatgattgtcgccgaaccggaaaaagaggcttctccccaaattccggcgatcaacaccgagcgttgcatcggctgtggagcatgcgagaatctttgtccggcacgtccgttcagtgccatctacgtcgaggggcacgaaaggcatcgtatcatataa

SEQ ID NO: 1194 - DNA, 798 bp, B.fragilis
aaaagtgttccgggtatatttacctctaatatagtggctgttatgaaagtattgattgtagaagacgaaactgctgcctatgaaaatttaacggatattctcacagagataactcccgacatccggatcatggcaaatacggaaagtgtcacacaaaccgtcgggtggttacaatctaatccggctccggatctgatattcatggatattcatttatcggacggatcggcttttgctattttcgacagaatagaactggagactcccatcatattcacaaccgcttatgaccgatatgccatcgaagcttttaaggtgaacagcatagattatttattaaagccggtcaaagtggaagatgtagaacacgcactggagaaatacagcaaactgacccgacaggacttattacaatatttgtcacaactgactctattgaaacctgcacccagatacaaagacaagttattgattgcacacaaagacaaactgttaccggtaaatataaaaaatatttcttatttttacgcaaccggcaaaaacacgtatgtatgcttaaaagacggcaatcgttatccatactccaagactttggaacaaattgcttcctcactgaacccggaagacttcatccgggccaataagcagtttatcgtagcgagggatagcgtaacggatataaccatctggttcgacagccgtctacttatcacgctcgatacagaagtaccggaacgtatttatgtcagcaaaaacaaagcatcggaatttaaaacatggcttgtaaacgataaataa

SEQ ID NO: 1195 - DNA, 843 bp, B.fragilis
ataactatgttttatgattacctttgcaaaggtaaaagcttgtatctaagtacacaatgcttattaataaccatttcttttcccgatatggacattgttgacaaactgaacaaagagttcctgactcaacccttctgcaaaaacgaacagctgccggaagaactgaatgaatataaacgaatcgcatacaactatgcacgaatagaaaattcaatcgccgttctaagtgatatgcataccaatatcagctatatctattatggaggaacagctgagacattgggcatagcccgaaaaggagacaatcaaaatcttgaatcaatctgggaaaaagaagtctttaaatatatccatccggatgacttggcggaaaagtatgtacaggaacttcgtttctaccattttctgaaacagattccacacaaaaaacgtgcagattactttcttatgagtaaactccgtatgcgtgatccttccgggaaatatatccctatcctacacaggatgttctatgtagctacccattcaaacgacagtatgtggctggctctgtgtctttacaatttgtcggtcgaccctactatgagttgtagagtgatcaactcgacaaacggacaggtcatagaactggaaaagcaagattgcagcaaattgctatccgatagggagaaaacaatattacagttgatcgatatggggaaaacaagtcatgagatcgcccgggaactgtttataagcaaaaataccgtcagccgacaccgacaaaatatattggaaaagcttcaggtaaagaactccattgaagcttgcagaattgccaaagaacttaagttactcttctaa

SEQ ID NO: 1196 - DNA, 588 bp, B.fragilis
acgcaggttaccccatgccgaaggctacatgtatgggaggaattaatattaacttttaattattacatcataattatggaaacaacatctatcaagctttattcattgaattacaatgatacgaaaacgtatctgacaacactgctattcgtagtgggcaatatggcactcccccaacttttccatctcattccgcaaggtggtatcacttggttacccatctatttttttactctgatcggagcttataaatacggatggaaagtagggttactgacagcacttctatcgcctgttttaaactcattattgttcggcatgcctcaaccggtgatcttacccgccatactcttaaaatcgacacttctagcgatagctgccggttatgcagcccaccgctacaaacgcatttccatccctatcctcctcctggtcgtgttatcctatcaggtggtcggcactttaggcgaatggatccttgtcaacgattttttcagtgccgtacaggatttccgtatcggtctgccgggaatggctctgcaaatattcggaggctatctgtttataagtcgtttgatttataaataa

SEQ ID NO: 1197 - DNA, 264 bp, B.fragilis
aatcaacctactattctttacattcttacttcattttactatttatctagtataaaatcaattaatatggatagtataggaaaaagaatgtatcgtaatcttggagacgataccaaagcgaaaattagtcaatcattaagaggtagaagcaagtcagcttcgcatatccaagcaatatcacaaggcatgactaattactggaagactataccagtcaaaacagatgataacccaagtgataaaacaaaaaaagaggggcaataa

SEQ ID NO: 1198 - DNA, 639 bp, B.fragilis
acaagtaacaccatgaaaaaagtagtaatatttgcaagagtatcgagcaccaacggaacacaagactatgaacgtcaaataaatgatttgcagacattagcctcagcaaacaactggactgttgaggctgtatttgcagaaaaggtatctggagcgaaaaagaatactgaacgcatagaattaatgaatatgataaactatatcaactcacacaacatacataaggtactagtaaccgaattgtccagacttggacgtgatactttacaagttttgcaagctatagagatactcaatcaaaacaaagtatcagtattcattcaaaattataatattgaaacgcttactccagagggagaaatcaatcctatgagccagtttcttattactatacttgccgaagtagcacgaatggaacgcaagactattagagaacgtgttgcaagtggttaccagaatttccgtagcaatggtggtaaggtagggcgaaaagttggatatacgaaaagcgatgaggttatgagggaagagtatgcagaagaattaagattactgaaaagagggtactcactgcgaaatacctcaaaactgacgggaacaagtatcaacaccctgcgaaaattaacccaattaacataa

SEQ ID NO: 1199 - DNA, 1344 bp, B.fragilis
ttcacgggcacgactcatcggcgcattttgttctattttaacaactatttttcgtatgaacaaagtttgaatacgggcaacgggcggtttatccggtcccagtatccggtttccgaacaatgcgcgcagtttctcggccatggtgtgtgccatcacatcaagcaacgtctcgttccggtttttcagatagacatacaccatccggtaatacggaggataatgaaacatctgccgctcagccagttgtcccgccaccatatcttcataatcgttcgtcatcacctgacggatgatgggatggtctatacttttggtttgcaacactaccctgccccgtttattttttcgtccggcacgtccggcaacctgcgccatcaactggaaggcacgttcgtacgaacggaaatcgggataattcagcatcgtgtccgcattgagtatccccaccacgctgacgtggtcaaagtcgagtcctttggataccatctgggtaccgatcagtatatcggtctttccctgttcaaagtctgcaataattttttcgtatgccgaccgcgtacgtgtagtatcgagatccatacgtgctacggaagcttccggaaaaatcagcttcacatcatcttctatcttttccgtaccaaatcctctgtgcatcagctcgaccccttcgcaagccggacacgaacggggcaactggtaagtatacccgcaatagtggcaagtcagctgattgatacctttatgataggtcaggctgacatcacagttcttgcactttggcacccatccgcacgtgcggcactctatcatcggagcaaatccccggcgattctgaaacagaatcacctgctgtttattatcgagtgcctcgcggacatattgcagcagcaacggagagaactgccccgtcatccgcttcttgcggtgcaactcctttatatctaccggaataatctccggcaattgaatttccttatagcgttctttcagttccacccacccgaatttgccggtagtggcattctgccaagtctccaccgaaggagtggcagtacccagcaacgtctttgccccatacatcgaagccagcacgatggcagcattccgggcatgatagcgcggtgcgggatcttgttgcttatacgtattttcgtgttcctcgtccacaatgaccagtccgagattccgaaacgggaggaacaccgaagagcgtacccccagaatgatgtcgtaaccctcctccgtcaactgcttttgccagatctctactctctcggcgtcggggaacttggagtgatagattcccaacccgggaaccgaacacccgtttcagccgttcggtga

SEQ ID NO: 1200 - DNA, 198 bp, B.fragilis
ctaaaaacaacgaccggacgagtaaatcagtataccatatttcccactatgcgggagctgaatgtgggaggatttgcggcgtgcctttcggtatatcccgaaaaagcacgccacaagaaaaataaatttaaaacggcatgtaaccaaatacgcagcgcaatgaacaggactgaaacctacaactccaccacacaatag

SEQ ID NO: 1201 - DNA, 192 bp, B.fragilis
aagatatcgacaacaaaatcgccttgttcgataaatacggatacactaatattgaaggtcaggaagagtatcttgatctgtcttgaccaggatatcgagaaagcccaaagaactgtagatgaaaagcaagcagcagtggacggtttgaacgctaccttgaagaaactcttggatgcttatgcagctgaataa

SEQ ID NO: 1202 - DNA, 1260 bp, B.fragilis
cccaatagagccatagggattattacgaatatgaataaattgcttatgccatttatgacgcttgtttgcttgctttttacggcttgcaacaaggatgatattttacccggtggaccgatgctctggacgtatgagattctgacaccggaaagtgtagagtatgaaggtggcaccgtaggttggatacctaaagaatgtttcaaggcaaacggtaatgagggatatatcgtgatgacttgcaagaatttcgatatgctcaatcctatttcgggcggttcttacacatacgattgtggatgggcaacgctcaaggtagaagccaatcagttgaagattcattttccccgtcaggtttcggaagccccggatgcatacgaggagattacaatctcgacaaatgatggaaagagaacagcaagtacaattatctgtttgtctagaacctttaaggacgaagggcaacccgatccagagccgaaacctctgcccgaagaagccaagttcaagatgaaaaaggcatacttcactccgtttatgcaccttgacacccaattcccggcaccgctcgatctggtgacgttcagaatcacggatataaacgacaattacaccccgctgggctttcctgagtttacacaatattacgactctattgtttggagtgccgagggtttccctcatacgttcagagtctatgaaagcaatacaacggagggagggatggaaacacatcttgctacggaatggagttcgcacttcttcaaaagcggtaccatcaaaaattacctgaaaggctatcgcaaaggaaaggttgaatatgagacctcgctcgctgtgagactgtacgaacgtgatttcttggggattgaatgggggacaatcgtgttgcagagcccacagaaccttacaacctattgcctgctggacacagattatgagtatcaggtgtatgacatcgtggcaaaggattataaccccttttctaaaataatcccggtgaaccataagcaactctcggattcagacttcccggcagcagcgcaaaaagccatcaaaacactgatggagaataacattggtgaagggcaaaatgctggtggaaaagagaacctgttcaaatgcctgcccgaagagggtgtgaaagctgaattgtattgggaaaacaagactacccgtatactgatgttgcatcaactctccactgaccccgatgacctgacacaagagaagtattatctacacgttgaacctaaacaataa

SEQ ID NO: 1203 - DNA, 1296 bp, B.fragilis; identical to SEQ ID NO: 845

SEQ ID NO: 1204 - DNA, 498 bp, B.fragilis
ttaaactcttataagatgaaaaagaatgtatttattttgtttgtagttcttttaactactagtgtgtttatgtcttgttccagtgacgatgacaatgacaatggaaaagttgaaaataccattattatcaatggtaaagagtatcttaatgatgaatctgcatctgtgtcgtacaactcttatagccagtctattagttttgaggcaggctttagtaatccagaaagtcttatggatataagttactttacgattgcaagtaatgatgctgctagtgtagataagctaaccaacggaatggaacttaatgctaaagttaaagaatttgtaaaaaatacagatttaggctctagctatacttatactacggtaggtggaaaagtcgttgtggataatgttacctctgaaagtataacgcttcgttatgatgattttaagtttacaaaaaatggtggtgaatatacgataaaaggtagagttctttatcataagaattaa

SEQ ID NO: 1205 - DNA, 198 bp, B.fragilis
ccaactgattatcagacgatttatattttccatttttgccattttacacccttattttgttacttagtacactttgaattctcattttctttcgcacctttgcaatatcggaaaacaaaagaaaatcaactatttagcgtaatcacccggttatggtacctaaatcgggataaaaccagtagcgtatggcaaagatag

SEQ ID NO: 1206 - DNA, 195 bp, B.fragilis
aaaaaatgttatgtaagtaaatcaatgttttctcttgccgatgacggccttgcctctatcttatgtaatacctctatctacagttactttgtaggtaaccccaaacagactattgaaggatgcaaatggcgttttgccaaaaggaatagcagtaaaagggaatccttatttataataaggtataaaaaagaatag

SEQ ID NO: 1207 - DNA, 201 bp, B.fragilis
agtcttctatatcccagcatcttccttcccattttcctagaatatagtgactttggctgtgattttggatactctacatataatagtggatggagttgttttgtaattagtaaatacggaaaacaatacatagctgaaaaggacaaatgtatgaatggtcctttcaatttgtttaaagtattagaattaccacaacattaa

SEQ ID NO: 1208 - DNA, 579 bp, B.fragilis
tttatttcatacagcgaatttataatggtaaatgaattgaataaagaaatggatgtggataaatacaaaataagaagttggtctaaagacgatttttccactttagctaaatatcttaataataaaaagatatgggataattgccgtgatagcctaccatatccttattctgaaaacgatgcgcaacaattcatcctgtccgtttcaagtcaaaacgaacaaaataattattgtatcgaagtaaatcaggaagcggctggtaatataagttttgctcgtggtatagatgtagagcgctacaatgcagaattaggttattggcttgctgaaccatattggggtaaagggattatgacccaaatgttagcactggctattagcagctattttcatcatacagatgtgatgcgcatttgtgcaaatgtttatgctggcaacatagcatcgatgagagtattagagaaaataggttttcgtaaatgtggcatacatcgtaatgcctgtttcaagaatggagtatttacagattgccattattttgaattgctaaaagaggaatttaggaatttggttaaatag

SEQ ID NO: 1209 - DNA, 708 bp, B.fragilis
ttacttgcatataacactttacttctcaaatggttttatatatctttgtgcgttgaacgcgatatatttcaatttattatgaacggattttttcttttgaaacgtccttttatctggttggcccgctttcgccaccgttgtggatatggggttcattcaccatttgctttcgacttgataaccaacgtcatttatgagcgtaccccttactatgcctacagttcgttggaagccgaacagaaaaaaatgtcggcaaactccggtaggaaatggaagcatgaatcgaagaaggtgaaccggttgctgtttcggctggttaactatattcagcccgatacgattgtggatgccggaacattatcggcatcgtctttgtatttgcaggccggacatgctaaagccgattatgtgggtgcttccgatttgtcggagctctttctggagaaagatacgcctgtcgattttttgtatttgcaccattatcggaatgaggagtttgtggagcaggtgtttgatctttgtgcatcgagaaccaccggacgaggactctttgttattgagggcatccgctatacgaagaagatgaaagcactctggaaaaagatacagcaggacgaccggacaggcattacattcgatttgtatgatttgggaattgtctttttcgaccgtaccaagataaaacagcactatctcgtcaacttctga

SEQ ID NO: 1210 - DNA, 204 bp, B.fragilis
ctaattttgtattcggataaaggcaactctttccaagacattagagaaaagaagaaacgttatgtttatcttgtaggtgaaaacgtaggaaattttcagactgatgtaagagatagcatagtggttctcacgcatatagcgtggaccgttcttgttacatctgcatcaaaggtttcctatgaacttcacttagacgtggcatag

SEQ ID NO: 1211 - DNA, 723 bp, B.fragilis
tactacctgtattctcttattacccattccacagccattgaaggctcaacgcttacggaacttgatacgcagcttcttttcgacgagggagtaacagcgaaagggaaaccgcttgtgcatcatctgatgaatgaggatttgaagcaagcgtatgaacttgccaaaaccgaatccagtagccttgtacagataactcctgccttgctacaaagattgaatgcaacactgatgcgcactacaagcagtgtacacagtgtaatgggcggttctttcgattcttcgaaaggggattttcgtctatgtggtgttacggctggtgtcggtggacattcttatatgaactatctgaaagttcctgctaaggtagatgaactttgcgctatactgcaagtgaagcagaagacagtggggacacttcgggaacaatatgaactgagcttcaatgctcacctgaatttagtaaccatacatccgtgggtggatggtaatggcagaatggctcggttgctgatgaactacatccaattttgctatcaccttttcccgacgaagatatttaaagaggatagagaagaatatatcctttccctacgccaatgtcaggatgaagaaaccaatcaggttttcttggactttatggtaaggcaattaaagaaatccctctctttggagattgaatgtttcaatgcttcacaaaagagagggttcagttttatgttttag

SEQ ID NO: 1212 - DNA, 276 bp, B.fragilis
ctacaaaggtatcatccatgcgggagtaggaaacggcaacttccacaaaaacattttaccggtactgctggaagcacgcaagaaaggaatcctcgtggttcgctcctcccgcgtacctaccggtcctaccacaatggatgccgaagtagacgatactcaatatcagtttttgcttctcaggaactgaatccgcagaagtcacgtgtattgctgattctcggactgaccaaaaccaatgactggaaacagattcagcaatattttaatgagtattaa

SEQ ID NO: 1213 - DNA, 1380 bp, B.fragilis
ttagcatatcatttaccgattcagagacaatttattcaattatctttgccaaaaataaaaaagaaagatatgattctacaattggcttttgtactgacagctatcattatcggtgcccgtctgggaggtatcggactcggagtaatgggcggcgtaggtttaggaatacttacttttgccttcggattgcaacccacagctcctccaatcgacgtgatgttgatgattgccgcagtcatctcggccgcctcctgcatgcaagcagccggcgggctggattatatggtgaagctggcagaaaagttattgcgtaagaacccgtcacatgtcaccatattaagtcccattgtgacctacctgtttacttttgttgcgggaacagggcatgtcgcttactccgtattgcctgtgattgcagaggtagccaccgaaacaaagattcgtccggaacgtcccctcggcatagccgtcatcgcttcgcaacaagccatcacggcaagtcccatctcggcagccacggtcgccttactcggactgttggccggtttcgacattaccctgttcgatattctcaaaataacgattcccgcaaccattatcggcgtactggtaggtgcacttttttctatgaaagtaggtaaagagctggtagacgacccggaataccagaaacgattggctgaaggatacttcaactcaaagaaaatagagattaaagacgtacacaataggcgcaatgcaatgatatcggtgttgattttcatcttagctaccgcctttattgtatttttcggctctttcgacggcatgcgccccacatttctgatcgatggcgaaacagtcaccctgggcatgtctgccattatcgaaatcgtcatgctttcggcagctgcgcttatcctgctgatcacgaagacagatggtatcaaagcgacgcaaggttctgtttttccggcagggatgcaggcggtaatcgctatttttggtatagcctggatgggcgatacgtttctgcaaggcaacatggggcaactgaccgaatcgatcgaaggacttgtccgccagatgccgtggttgttcggcattgccctgttcataatgtccatcctgctctacagccaggctgctacggtacgtgcactgatgccgttgggtattgctctcggcatttcaccgtatatgctgatcgccatgttcccggctgtaaacggatatttcttcattccgaactatccgacagtagtggccgccatcaatttcgaccggaccggtacaacgaaaatcggtaaatacgtattgaatcattcgtttatgatgcccggactgatatcgaccgttgtagccatcgcgctcggattgctctttatccagatattctaa

SEQ ID NO: 1214 - DNA, 984 bp, B.fragilis
ttaaaaacccaaacctggagatttatgaagaagttaatgttactgacccttttgagtacctttatattttacagttgctcggatgatgattcatgcacaacctgtaaggaggataatggaagtttggtcacccccgatttgagcgttaccctatccgatacacagagtccgatgacgggtgtattggaagcctacccttgccaggcaggaggtgccatttattacggcaattatatcgaaggcaaactgacctcctttccgggaatgtattacctccagaacggagagatctatggagataagaacagggaaatatctctcccggtgggcacttacaacatgatatactggggtaccccgaaatatgaagagctgatttacagcaacccggtcgtcgtcgccccccaaatcactatcggaggagacctttcacaacagtatttcgggctccggaaagtttcggcggatacgacctattatccagtattcgacttagtgtataccgtgaaaccggcacatatcggcacggaagaactgagtgcagccatgcagcgtgttgttgccggtctgaaagtaatcgtcaaaaacaaaaacaacggtatcctaagttccagtattgccggcatggaagtacatgtaggaggcattgccgagaagctgaacatgtatacagccgctccggtcaaccaaaccaaaacagtatctttcccgcttgtactgtcggcagacggtacacagatgagcaatgccacggtcatgctttttccatcatccgccaaaccaatgttcaagctgatcatcaagcttaaaaacggaaataccaaagtctaccagcaaccactcaatgctccgttaaaagctaataacaagttgactctgacattaaccttgggtgatatcttctcggaagaaacttccgggggattcaccatcgataactggcaagaagagaacgaaacaatagatataccgacactggaataa

SEQ ID NO: 1215 - DNA, 252 bp, B.fragilis; identical to SEQ ID NO: 860

SEQ ID NO: 1216 - DNA, 675 bp, B.fragilis
aataaacataatcaaaaggtagaaatgaaaaaagtatgtttaagcctgcttatgggactgatggtacaaatgacctttgggcagacactggaaaaaatgcaatggttcaacgaaccggaacaatgggagataaaaaataatgtattgtccatgtccgttactccgcaaagtgattactggcgtatttctcactacggttttacagtagatgacgcacctttctattatgccacttatggcggtgaatttgaagcgaaagtcaaggttgtcggagagtataaagaacgtttcgatcaggccggtctgatgctccgtatcgatcatgaaaattacattaaagcgggtattgagtttgtcgatgggaaatttaatttaagtaccgttgttactcataaaacgagtgactggagtgtgataacgttagataaaacggtaccttatatctggataaaggctgtcaggcggctggatgcagtagagattttctattcatttgatgataaaacttacacgctgatgcgtaatgcctggttgcaggatcatattcctgtgaaagttggactgatggcggcttgtcccgatggtagtggattcaatgctaagtttgaatacttccaggtgaagcatctgccggaccagcgcagagtggaatggctgaagaagaatgcagaataa

SEQ ID NO: 1217 - DNA, 690 bp, B.fragilis
attttaaataagtccagaatactacgaaaatcaccccgttctgccctcgggtacgcatggggtgatttttttataacccatagtaggatgataaagaagatgaaagggatttggccagaggtatttcctgccgtttttgaagaagggggcttgtatccatgccaccccaagagggaacttccacttaagagggatggtgccaacccgaaactgaaaggcagaaccattaatttgcagaatgcggttaaaaaatgcaaccggttgtgcccattgagatatgacagcattacagtcagtgaaggacgttttatgtttaatgggaaagtgactgccccgcaagtgagggagctctttattcaggagactgacagtgaccgctttcccgtcaccctgcctgtggtcttggatccgggagagatcaacgcaaaaataggagatatcgtactggtggaaggatccggactgaacgaggagatgatgcaaaccttgatggctctcgacgaattcagagggcgggactttaccgggaaagagataaatgaaattaaagaggctttcggcggattcgtgctggaacagattgtgaaacatgccggcagccccgtaggaaactatctgtacgaggcctatcagaacaaactaaacgagaagcaacaggccgaggcacggaaaacgctcggcatcggttag

SEQ ID NO: 1218 - DNA, 372 bp, B.fragilis
ttaataaataaaggagttatgaagaattatcaaaaaaagagcgtagcacaagatgcacgtgtagagttgcatgacagtcttgccctgacgggtgccgaagtatctatcaatcatcttccggccggtgccggagtcccttttgttcattcacataaacagaatgaagaaatttacggcatcctttcggggaagggctttatcactattgatggcgaaaagatagaattgcaggctggggattggctccgtattgctccggatggaaaacgtcagatttctgctgcatctgacagtcctatcggttttatttgtattcaggtgaaagcaggctccttggaaggttataccatgactgatggagtcgtacaataa

SEQ ID NO: 1219 - DNA, 945 bp, B.fragilis
aacaaaaataagatgaaagaaaaagatttaatccgttttatggatcgcatgattgaagagcgaaaagcggaatatgcattaggtacggctcacatttatcaagcgagcagaaatgccctttctgcttttctgaaagcacacgacattccgttcaaaagagtaaggcctgagttattgaagcagttcgaacggtttctcagacggcggggaaacagctggaacacggtgtctacttatatgcgggtgctcagggctgtctataaccgggcggtcgacaggcgtctggcacctcacgtgccacatctgttcaaagctgtatataccggtactcaggccgatatcaaacgagctttgaaagccgaagaaatggggcagttgctcgacacgaagtgcacccggaagcaatcggaactattgcagaaaactcatcacctgttcgtgctgatgtttcttttaagggggcttccttttgttgacttggcttatatacaaaagaaggacctgaatgggaatatcctgacctatcatcgcaggaaaaccggacgtcagatcaccattacagttactaaagatgccatgaatatcattcgggaatatatggatactactacggagtctccctatttattccctattctgagtgcagagggaggagaggataccatctatcgggagtatcagcaggcattgcgcatcttcaattatcaactgacaaaattgggagaactgttgggactgactaccgaattgacttcatatacagcccgccatacctgggccactttagcctattatttggaagtgcacccgggtattatccgggaggcgatggggcactcgtctatcaaagtaacagagacttatctgaaaccattcaatataaagaaactggatgaaacaaatttaagtattatcagttatgccaaacgatcttttgagggataa

SEQ ID NO: 1220 - DNA, 231 bp, B.fragilis
aatatgcacaatatggataataaacaagaaagaacagttgttcacgttgaatataacggacagcattactattttggctcactctctgcaatttatacgaaattcagtcctaaagacttgggtatcgcattggggacattaagaaattatggattgaaagaagaaaagccgtaccagaactctctgtgtactataagaaaaggttttttgataacgatgcctaaaaagtaa

SEQ ID NO: 1221 - DNA, 276 bp, B.fragilis
ccagtctgcaaagataagccctttcctttgttatcacaaatgataactatagaaaaaatgaatgaacagcaactttttattaaaataggagataaaataaaggaaataaggcttgaaaaaggaataagccaacaagacttggcagctaaatgcaactttgagaaagctaatatgtcacggattgaagcagggcgcaccaatctaacaataaaaaacgcatataaaataagtcttgctttaggagttagactaaaagacctattggatgtagaatag

SEQ ID NO: 1222 - DNA, 183 bp, B.fragilis
acagatctaaataaaaagaccttggggcgtagggagtttctcatcggatgttgtctttataggaaagaacctataaaaccaacaaacattatgaaagaatttatgctgatcgcttctctcgtcttgtcattctgcattcttattttatgtagagactatatcgtatttatgctgaaaaaatga

SEQ ID NO: 1223 - DNA, 462 bp, B.fragilis
cgtatggcaaagatagagaataaaacgaaagaaaaccccaagttagagcaaaataagctctcggatggtagaatcagcctgtacttagagtattatttaggtagagaagagaagcccgttttagatgcgaatggcaatcaggtatattatgaagatggcaaaatgcaaggcaaacccaagttttcggtgaagcacaacaggcgaaaagagaacctgaatctatatcttatggataagccccgtactcctgccaaacgtcaacaaaataaggaaacactggagcttgccacaaagatacgtgccgaacgtgaacaagagtttaaagaaagtatgttgggataccgcctaaagaaagattgtaccatcaactttcttgattacttccaagcctacatagacagctatacaaagaaagattgcgcatggtgcaaattgcacttagccgtttcaaagacttcctga

SEQ ID NO: 1224 - DNA, 192 bp, B.fragilis
agtatccaaaatcacagccaaagtcactatattctaggaaaatgggaaggaagatgctgggatatagaagacttcattatttcattgaattatcaaagcaagttacagttaacaatctatccccaacaatatcttgcccagtcagaacgtgaagttcaattacaaaccaactccaataacaatacaaattag

SEQ ID NO: 1225 - DNA, 2547 bp, B.fragilis
acaaatagaaaaatgaaaaacgcaattgtttccttactcctgcttttgatggtcacccagtatgtgacggcacagaaaaaagtgattaagatagcctgtatcggcaatagtataacgtatggtgtaggtacgcgcaatcctgcgaaagacagttatcccgctgtgctggggcagatgctgggcgacggttatgaagtccggaactttggagtcagtgcccgtaccatgttgatgaagggtgaccatccttatatgaaggaggaacgctatcggcaggcattggcttataatcccgatattgtgaccatcaagcttggaaccaatgatacgaaaccgcagaactggcggtacaaatcggattttaaaaaggatatggaaacgatgatacggacgattcgcgctttaccctcaaaacctgaaatctacctgtgttaccctattcccgcctatgctgtacagtgggggattaatgacagtacgattgtacacggcgtgatgcctgttatcgatcagctggctgctaaatatcgattgaaagtaatcgatctgcatactccgctgataggtatgaaagagtgttttgccgatcatgtgcatcccaatgaaaaggccgctgcctgcattgcccgggtcatttatcggcaactgacgggtaaagaagcacctgaacacgtctcccagcctttccccggtcataaaagcaagtggcagggattcgatcaatatacttttacctatcaggatcgtcaggcgattgttgtttgccccgaacgggcggcggcaggtaatccctggatttggcgtcctgcttttttcggtgcttttgcttcggtagatgaggctttgctgaagcggggttttcatgtggcttattatgacttgacccacctttacggaagtccgcgtgcccggaagtcaggtaccgatttctattggaatatggtacagatgtacggtctctctccccgtgtgacactcgaaggctttagtcggggaggattatttgcttataattgggcagccgatcatccggataaagtggcttgtatctatgtcgatgccccggtttgcgatgtgttcagctggccgggacgttcgtccggaaatgccggattatggaaaggaatgttggacgaatggggattgacagaagcccggatgaatacatttcccggtaatccgatcgaccggttgaaacctctggcggatgcccgtattccggtgatttgtgtatgtggcgatagtgacagggtagtgccgttttccgaaaattcggcagtggttcgtcaacgttatacagcaatgggagctccgttcgaacttattctgaaacccggggtggatcatcatccccacagtctggagaatcccactccggtagtcgattttattgttcgccatcaggcaggctatgaagccggacaatgttatacgctgagaggcaattatcagaattcatatcggaagtttgagaaagaacgggtgggtacggttgctttcctgggaggctccatcaccgaaatgaagggatggcgggatatgatttgcgaagacttgaaacagcgttttccttatacaaagttcacttttgttgcagccggaattccttcgaccggcagtactcccggggcattccgcctgacggatgatgtgttgtccaaaggcaaagtcgatctgctttttgtagaggctgcggtgaacgatgacaccaatggatttagtgccattgagcaggtaagaggcatggaaggcattgtccggcatgccttggtctccaatccgtcaatggatatcatgatgttacatttcatttacgatccttttattccgaagttggacaaagggcagatgcctgatgtaattctgaaccatgagcgggtggccaatcattacctgcttccttctgttaatcttgcttctgagattgctgcccggatgcggagtggtgaattcacatgggaacagtttggcggcacacatcccaatcctttgggacatgcctattatgcagctaccataaacaaggtactcgatgaaatgtatgccccttgcgctactgccaaagatgctgccaagcctcatgctcttcctgccgtgccactggatgcatatagttatacaaatggcagattggtcgatatccggcaagcccatataggtaaaggttggcagttggttgctccatggactccccggcttgctgccgaaacgcgtccgggttttgtcgacgtacctatgcttgagaccaatcgtcccggagcgaagttaacacttgactttgaagggactgctgtcggtatcttttgtgtgagtggtccggctgccgggatactggaatatagtgtcgatggtgccccattcaaaaagttggatacgtttacagcctggagtggcggactgtatatcccttgggtgtatatgttcgatacggagttaccgatgggaaaacatcgtctgactcttcggatgtcgaaagaccatcatccgcagagtaagggtacgtcctgccagatcaggcagtttgtggtaaatgattcttgtgaatag

SEQ ID NO: 1226 - DNA, 222 bp, B.fragilis
agaagaacccttgaactttgggaccgggatgtggaacgttggattaactccgaacgtgtgccggtgtactctcctattacctacttcttgtatgacttgcctcgttgggacgggaaggactacatccgggcgctggcccgctacgtacgtacctttcgacgaatcggctataagcgaactgaagcgttatgcttcgttcatagcgaccagcaatcacagtga

SEQ ID NO: 1227 - DNA, 1194 bp, B.fragilis
acacttatgaaaaaattaatggccatgttgctccttgcgggcagcatacaaggagtctatgcccaaaagacggaaaagaaagagatgtttcttgaaaataaatcgttgtatgaagagctgaccaacgtgcagaagaagacggataagttcaatctgtatctcaatatgcaaggtagtttcgacgccaacttccgcgacggtttcgacgaaggagtattcaagatgcgccaacttcgtatcgaagccaagggcaacctcaacagctggctctcctatcgttatcgccagcgtctgaaccgttcgaacgagggaggaggaatgatcgacaacataccgacttcgattgactatgccggtatcggtgtaaagctgaacgaccagttctctttctttgccggtaaacaatgcaccgcttacggcggtttcgagttcgacctgaatccgattgacatctaccaatacagcgacatgatcgagaatatgagcaattttatgaccggattgaacatcggttataacattacacctacccagcagctcaacttgcagatcctgaacagtcgcaacagttcgttcgacaagacgtatggaatcaccgaagactcggaaggcaaacttccggacctcaagtcgggcaagatgcctttggtctataccctgaactggaatggtaactttaatgaggtgttcaaaacccgctggtcggcttccgtcatgagtgaagccaaaggcaagaacctctattattatgcagtgggcaacgaactgaatctggataagttcaatatgttcgtcgatttcatgtattcgcaggaaggcatcgaccgtaacggtaccatcaccgggattgtgggcaatgccggcggacacaatgctttcaacgccggctacttgtcggtagtgaccaagctcaattaccgtttcctccccaagtggaatgctttcgtgaaaggcatgtacgaaacggcctccgtcaccaaagcagccgacggcattgaaaaaggtaactaccgtacttcctggggctacctggcgggggtagagttttatccaatgaagactaatttgcacttcttcctgacctacgtagggcgttcatacgacttcacacatcgtgccaaagtactgggacaggagaattacagtactaaccgattgtctttaggcttcatctaccaactgccgatgttctga

SEQ ID NO: 1228 - DNA, 189 bp, B.fragilis
gtgacaaggaagaacaatattggccggaacatcctatcttcgcaggaaataagtgactcctatgaaagaaagaatattaaatatagagaccgtccatcaatgcaactgctgcctgggctgcaaaacactccatccgctggtaagtgtaatcgacctgtcaaagagcgatctggaacagcaaattattaa

SEQ ID NO: 1229 - DNA, 537 bp, B.fragilis
acagaaaggaaaaaaaatatggaaaatgttattcagatacaatattatcaatcgccatgtggagaactgatattgggggcatatcgggaaaaactttgcttatgtgattggaagatagaagaacgcaggatcatcatcgacagaagaatacaaaaagagttgcaagcttcttataaggagggcatatctgaagtaatcacacgaacgatcggtcaactggatgaatattttgccggacgaagaactacattcgatattcctttgcttcttgtaggtactgattttcagaaaactgtttggaacgaactgttgaacattccttatggaaaaacaatctcttatgcagggttgtctcaaaagttggggaatcctaaagctatccgtgccatagcttccgccaacggagcgaaccctatctcgatacttgttccttgtcatcgtgtgatcggcagtgaccgtaaattagtagggtatggcggtgggctgcctgctaagaagatcttgcttgacttggagtcttccgataggttattctaa

SEQ ID NO: 1230 - DNA, 603 bp, B.fragilis
tgtgttaaccttgacagaaataataaacatactatcattatgaaaaagagtcttgtatatacaaaaacgggtgataagggaacgaccggcctgataggcgggacgcgtgttccgaaaacccatatccgtctggaagcatatggaacggtcgatgaactgaattcgaatctgggcttgctggcaacttatttgatggacgagcatgatttgaattttgtgcagtccgtgcaggataaattgtttgccatcgggtcgcatctggccactgatcaggagaaggtgcaattgaatgatgtcagtattattactcccgctgaggtggaggctattgagcgcgaaatcgatgccgccgacgaaattcttccacctttacattcttttattattccgggagggagtcgtggctctgcggtttgccacgtttgccgtaccgtttgccggagggccgaacgccggattcttgcattatccgaaagctgtacaatctcagccgatttactggcctatatcaaccgtttatcggattatttatttgtcttgtcccgtaaaatgaattttaatgaaggaaaagacgaaatattttggaataatagttgcaagtga

SEQ ID NO: 1231 - DNA, 237 bp, B.fragilis
gaaattaatgatcaccttacataccacatacccgcaatctatgccctacacagcaaatgtacagaatttccggatgaaaccagccggagagttactaaaattactttctattttttgtttttacctaaagatcttaccacagctaaaaatattaatatccgaattttctctactgccatagacttccattatatccaatccctacagtcgctcacgtttcggagccatactccgtaa

SEQ ID NO: 1232 - DNA, 279 bp, B.fragilis
cgcagagccgacccacgcacgctacccgaacttctgatagaaaagcatgacattctaattgaaaaaattggcacacggttgaaaacccatgccacagaaacagatatagcacggttgtttatcgcattagtggaataccgtttcatgcggaagtgtcccatcaagactttcagaaatgcctgtacaaccagtttaatgaacaagaaatcgttcatgaaagaggtcttcagaaagcatacaaaaatctcatttcgccacttggaaacggcaaaaagttga

SEQ ID NO: 1233 - DNA, 519 bp, B.fragilis
atattattagaattagatcaaggagaaagagttatgaatgacagaaagattttagtagcgtacttctcatgtagcggcgtaactaaagctgtggcagagaaattggctgcaattactggagcagatctgtatgaaattaagccggaggttccttatacggaggctgacctggactggaatgataagaaaagccgtagttcggtggagatgagagatgctctctcacgtcctgccatttccggtacgttgtttcatccggaagagtacgaagttctgtttgtaggctttccggtctggtggtatattgcccctactataattaatacatttttggaaagttatgactttgccggtaaaatagttgttccgttcgctacatcgggaggcagcggcataggaaattgtgaaaagaatcttcataaagcatatccggatatcgtgtggaaagatggaaagcttttaaatggacggataacgcgggatctggttacggaatggtttgaaaagattaggttgtaa

SEQ ID NO: 1234 - DNA, 1347 bp, B.fragilis
aatgtggcagatttccgcagcttacattttctaagaagacagaatcattttatgataaacgaatccccggcgcttgcgtcggggattttttgtatctttgtcctcacaatgaaaaagtatgtagatgtcatattacctttgcctctgccccgttgctttacctattcccttccggacgaaggggctgaagaggtgcaaataggttgccgggtagttgtacctttcgggcggaagaagtactatacagccattgttcgcaatgtgcatcactatgcaccgaccgaatatgaagtcaaagagatctctaccgtacttgacacctctccgatactgctgcccggtcagttccggttctgggaatggctggccgattattatctttgtacgcagggtgatgtttacaaagccgcattgccttccggcctgaagttggagagcgagacgattgtggagtataatcccgactttgaggcggatgctcctctttctgaacgcgagcaactggtgctcgacctgcttgccaaagaacccgagcaatgtgtcaccaaacttgagaaagagagcggattgaaaaacattctcaccgttatcaagtcgctgctcgacaaggaagctctgtttgtaaaagaagagctccgccgcacttataaacccaaaacggaagcccgggtccggctggcggcagacgcctccggtgaagagaatctccggcgtatctttgacgagctggagcgcgctccgaaacagttggcgttgttgatgaagtatgtggagctttccggcgtgttgggggacggtgcatccaaagaagtgtccaagaaagaacttctgcaacgtgcctctgcttctcccgctattttcaacggattggtagaaaaacagatattcgaggtctattatcaggaaatcgggcggttgaaccgtttggtcggaaagacggtagaactgaacgtgctgaacgaacaccagcaacgggcttatcatgaattcatgcagagctttcaggagaagaatgtctgtctgctccacggagtgacttccagcggaaagaccgaagtatacatccacctgatagaagagacgttgaggcaaggcaggcaggtgctttatctgttgcccgaaatagcattgactacccagatcaccgaacggctgaaacgggtgttcggttcccgggttgggaatctatcactccaagttccccgacgccgagagagtagagatctggcaaaagcagttgacggaggagggttacgacatcattctgggggtacgctcttcggtgttcctcccgtttcggaatctcggactggtcattgtggacgaggaacacgaaaatacgtataa

SEQ ID NO: 1235 - DNA, 987 bp, B.fragilis
aaaactaaagaagaatatagtatgataaagaaactatgcataatccttctgtctgtatgtactgttgcacctgtcatggcgcaacaatacagcagcagcgatgatgcgtcgtttgctcctaaaaaaggtcagtggcaagtatccatggtaatgggtagttcgcaaatgttcaacaacaatacggagaactatctattgcctacctactggaacggacaaaactttagctttccgaatgtgggattgggcaataatacgtccggaaaccaatcctccgatccggctacttaccttcaactgggagatttgaattctaataatttggtcaatatcatcggtatacagggaaaatatttcctgacagaccgttgggatgtcaacctgatgtttagcatgaatatcggcgtaacgcccaaaaaggattatatcgagggagacaagacggttaccgatatgcagattccggcccttcaatatctggaaggcagaatcaaaaacaactggtcggttaatattggctcaaactattacttcaatacgaagaacgaacgcatcaatctgtatgtaggcggcctgttgggctggcaaatgggaagaatagaaaccacgcttccgtatactggaatcatggtatctgataaggatatgaacacagatgggacggataccgatttacagccgactcccgatgagaacggccaggacaatggtccggtcgtggacgataacgacgtcactggtacacctctggaggtttatatccccaacagcagagccggacagatattcggtttgcgtgcggcaaccgtcgcaggcatcgagtacagtataggcaagggactgattctgggatttgaagttcagccggtagcttaccgctatgacatgattcagattatcccgaaaggaaccccggtctacaaggtggggcatcacaacatcaacttgtttgcattgcccaacctgaagctcggatttagattttaa

SEQ ID NO: 1236 - DNA, 972 bp, B.fragilis
gtcatgaaagaattaaaaagactaagctttgtagtggtcacactactactttccacgatgatggctttcgcgcaaaagcctaatattcacatccttgctacgggtggcacaattgccggtacaggcggttctgccacttccaccaactatacggccggccaggtagcaatcagtacgctgctcgatgcagtacccgaactcaaggatattgccaacgtgaccggtgagcaaattgtacgtatcgcatcgcaggacatgagcgatgaagtgtggctgatactcgccaagaagatcaaccaactcctgaaacgcccggacatcgacggtatcgttatcactcacggaacagatacgatggaagagactgcctatttcctgaacctgaccgtaaaaagtaacaaacccgtggtacttgtaggagccatgcgcccttctactgcgctgagtgccgatggcccgctgaacctctacaatgccgtagtcactgccggagccaaagaatctatcggcaaaggtgtgctgatagccatgaacggactgattctcggagctgaaagcgcaataaagatgaatacgatcgacgtacaaactttccaggcacccaactccggtgcattgggctatatctttaacggaaaagtattctataaccaggctccgctcaagaaacatacgacccaatctgttttcgacgtaaccaacctgaactctcttcccaaagtaggcattgtctacagctactcgaacatcgaccccgatatggtgaccccactgttacatcatgactacaaaggtatcatccatgcgggagtaggaaacggcaacttccacaaaaacattttaccggtactgctggaagcacgcaagaaaggaatcctcgtggttcgctcctcccgcgtacctaccggtcctaccacaatggatgccgaagtagacgatactcaatatcagtttttgcttctcaggaactga

SEQ ID NO: 1237 - DNA, 1179 bp, B.fragilis
aaaaaaggagaaaaaaagaataaaagatcgcataaacacttctattttcagagaataaaccgtattttagcagaaacatttaaaacagtcaatatcatgacaagcaaagataattattgtgtcattatgggcggaggtatcggcagtcgtttctggccgtttagccgcaagacaatgcctaaacagtttctggatttctttggaacaggtcgttcactgttgcaacagactttcgaccgattcaacaaaattattcctacggagaacatacttatcgtaaccaatgcgatatacgcagacttggtaaaagaacaacttccggaattagatccaaaacaaatcttgctggaaccggcaagaagaaatacggctccgtgcattgcatgggcatcatatcatatacgtgctttaaatccaaatgccaacatcgtagttgccccttccgatcatctgatcttaaaagagggagaatttttagccgctatagagaaaggactggactttgtatcaaaatctgataaacttctcactttaggtataaagcccaatcgtccggaaaccggatacggatatatccaaatagcagagcaggaaggagacaacttctacaaagtaaagacatttactgaaaaaccggaactggaacttgctaaggtttttgttgaaagtggagagttctattggaattcaggccttttcatgtggaatgtcaatacaatcattaaagcaggagaaactcttctaccggaattagcatctaagctggctcccggaagagagatttatggtacacctgaagaaaaagactttatcgaagaaaacttcccggcatgccctaacgtttcgatagacttcgggattatggaaaaggctgataatgtatatgtctctttaggagacttcggatggtcagaccttggaacctggggatcattatatgatttatcacctaaagacgaacaaagaaatgtaactctaaaatgcgactcattgatttacaacagcaatgacaatatcgttgtattacccaaaggtaaacttgcagtgatagaaggtctggaaggttttttggttgccgaatcagataatgtattactgatctgcaaaaaggacgaagaacatgccatacgcaagtatgtgaatgacgcacaaatgaaattaggagaagattatatttag

SEQ ID NO: 1238 - DNA, 594 bp, B.fragilis
ttatttatggaaagtgaaaaagaaaaaatgggtacaggcaggctttacgatgctaattatgatacagaattgatagccgaacgtcaggcttgcaaagagttgtgttataccttaaatcatttgcctccctcgcagatagctgaacgggaggccattatccgtcggttgttttgcaagacgaaagaacgttttctgttggaacagcctttttattgtgactatggctataacattgagattggtgaaaatttctatgccaatatgaactgtgtcattctggatgaggctaaagtaacgttcggtgataatgtctttatcgctccatcctgtggcttctataccgcgggtcatcctttggatgtggaacagagaaatcgagggttggaatatgcccgtcccattcgtgtcggaaataatgtgtggattggggcacaagtgtgcgtattaccgggcgtgacgattggtgacaacacagtgataggtgcgggaagtgtagtaaatagagatattcctgccaatgtgattgctgcgggtaatccttgtcgcgtgattcgggaaattacggaagaagataaaacaaaatatttattatag

SEQ ID NO: 1239 - DNA, 1389 bp, B.fragilis
agacatatggaaaaacagaataatcatatagaccgaagaggattcctgaaaattgtgggcatcagtgccgctacaacgacagcggctctttatggctgcggctccggaactaaaagcagccaaggacggaatgcctcctctcctgttccgacagaccagatgacttaccgctcagtaggcggaatcaaagataaagtatccctcctgggatatggctgtatgcgttggcctaccgttccttccccggaaggaaaaggagaccttatcaatcaggaagctgtcaacgaattggtagactatgccattgctcatggagtgaattatttcgatacatcacctgtatacgtacagggctggtcggaaaaagcaaccggtatcgctctcaagaggcatccgcgcgagaaactttatatagccaccaagctatcgaatttctctaacttctcacgcgaaaactcacttgcgatgtatcatcaatcattcaaggatatgcaagtggagtattttgattactacctgctgcacgccattggcggaggcgggatgaaggtattcaacgagcgttatatcgataacggtatgctggattttcttctcaaggaacgagaggccggacgcatacgtcatctcggctggtcattccatggtgacgttgaggttttcgaccaggtacttgccatgcacgatacggcgaaatgggattttgtacagattcagctcaactatgtggactggcgccacgcaaccggaaacaatgtaaatgcggaatacctgtacggcgaactggccaaacgaaatattgccgctgtgatcatggaaccgctattgggcggacggttatcgaatgtaccggagcacatcgtgggacggctaaaacaacgacgtcccgaagacagtgtggcatcgtgggcattccgcttcgccggttcaccggaattggtactgaccgtattgagcggtatgacttatatggagcacttacaggataacatccgcacttattcaccactggttccgctgaccgatgacgacaaagagtatctggaagaaaccgcgcaactgatgatgcaataccctaccatcccctgtaatgactgtaaatattgcatgccctgtccatacggcatcgatattcctgccattctcgtacattacaacaagtgtgtcaacgaagggaatattccgcaaagccagtcaagtgaaaactacaaagaagcacgacgcgctttccttgtaggctacgaccgcagtgtacctaaattgcgacaagccagtcattgcatcggatgcaaccaatgtaccccgcattgtccgcaatccatccacataccggaagaactgcatcgcatcgatcgttttgtagaacagctcaagcaggggacactatga

SEQ ID NO: 1240 - DNA, 186 bp, B.fragilis
aaagcaatggaacaaggcgtttggcaagagatagaacagttataccaaaagtttcagaaacttggtatcaatgaagcggtggactatgatagtactacctgtattctcttattacccattccacagccattgaaggctcaacgcttacggaacttgatacgcagcttcttttcgacgagggagtaa

SEQ ID NO: 1241 - DNA, 201 bp, B.fragilis
cttgttatttgcgcacaagaacctgacaacctgcaaaagacgttaacaatgttaattgaagagaggtataaggatgaagacaccggttcaggcggcgtaaactcacttccgaaacttgagctatcttattcagccggtgtctgttttttcttattaaagcaagcaaaaaggacaattatcaacttgaaaataaagaaataa

SEQ ID NO: 1242 - DNA, 1158 bp, B.fragilis
aaagactcccgttttatttttgggtatcccttgcgttggcttcgtgtcagggggggcaagaaagcagtgaatcaggctctgcctgtgattgatatgaatgaagattatcccgaaaaggagatcgtgttgcaggatattgctgacataagctatattcctttggagactaacgacgaatttctgttcgacggttcggttgaagtggtcaccgatcaatatgtgataaccaaaggacatcggggaaacgacgtctgcttcttcagccggcagggaaaagcactcaaccgcatccacagggtcggtaacggcccgggtgaatacaaggatatcggttcgatggatgtaaacccggcgaacggcgaactttacctgaaggagatgaaccgtcagcagattcacgtctattctctggacggaaagttcaagcactcttttactttccctgaagggaaacggatgagtcgcatgtgcctgttctctcccgactatttgatagcggaacaggagtcaaaggtgccggacgatcaggatgccaacttctatccttatcttttggtctctacccgggacgggcatctggattcactggactatgtgcagaaaagaaatattctcgtcaagcttattgtcaatgcggaaaaccattcatacgcttatcttctggaaccctctttgattcgtaatggctcccgcttttatatcggcaatcccgactcggataccttgtttgcaatgaatccggaccgtaccttagagccattgctcgtccgtactccttcacattcggaggagggaaacaagtatggtttgtttttacggggagcggcgggggcttatttctttctgactaagcaacctatggaagtgccgatgaacagtatcgagtcattggatctgaaaagtgaagagtggctgtacgactgtcgcacgcaggaagtctgccgttacttgttgaagaataaagacgatgcttcgaaacgtgtggacggtatcatgttcttttgctatcccgaagattgcggcttggctgttctgaagtccgaagacctgatggatgcttacgaagccggtcagctgagcggtgaattgaaagagatagcagccggcctgaaagccgatgacaatccggtattgatgttgattcacttcaaaaagtaa

SEQ ID NO: 1243 - DNA, 234 bp, B.fragilis
atacgaaagcttatgtattggacattggaattagcatctaaactggaagatgctccttggccggcaactaaggatgaactgattgattatgccatgcggtcgggtgctcctcttgaagtgattgaaaaccttcaggaaatggaagatgaaggcgaaatctatgaaagcatagaagatatttggccggattaccccagtaaagaggacttcttctttaacgaggaggagtattga

SEQ ID NO: 1244 - DNA, 786 bp, B.fragilis
tctaagattagcttcttcacttcacggatggactcttcgggcgaaagccgggatacttgcttttttgtcaactataaaagagggcttacacttccgaaaactgaattagattccatgagtaaaagaaaacttaccaccaaatttgaagaagaacccttgaactttgggaccgggatgtggaacgttggattaactccgaacgtgtgccggtgtactctcctattacctacttcttgtatgacttgcctcgttgggacgggaaggactacatccgggcgctggcccgctacgtacgtacctttcgacgaatcggctataagcgaactgaagcgttatgcttcgttcatagcgaccagcaatcacagtgatttactctccgatccttcgggaagccgccgcttcatttgtatcaatatcaccggcaggatccgtaatggtgctgccatcaactatctgcaaccctatgcgcaggcagtgcaggaactccgtgagggtgagtgcttttatttctctcccgaagaagaggccgttttgatggagaacaaccaggaatttgagctgcaaaccccggttggacacctctttcaacagtattttcgctctgccgatgagggggaaaagtgcgaaacgctgctcgctgtcgatattttggggcgcatacaaaagaaaaatggttttaaactgtcggctacgaaaattgtgcatttgggcaggatacttcgtaaattgggagtgccttgcaagaaaatgaaaaatgggaatttctattgtgtggtggagttgtag

SEQ ID NO: 1245 - DNA, 855 bp, B.fragilis
ttacttccaagcctacatagacagctatacaaagaaagattgcgcatggtgcaaattgcacttagccgtttcaaagacttcctgaaagagcaatatcctctttatgaatgtaacatcaaacctaaatttatcacaaaggatatgatagtacagtttgtggactacctgcaatcccgtagtgttggcgaaggagcgaaaagtatctatcagcgtttcaagaaagtgatacgctatgccatcgaacacgatgtgatactaaaagacccgtgcaaagaagtaatttgcaaggtagacgacccaatgttacggaaagatgtgctttcactggaagaaattcagtctcttatcaactgccactatgagaatgagaacccgatggtaagacgtgcctttatcttctgcctgtatttcggtttacgcttctgtgatgtgaaagaccttacttataagaatgtagactactcaaacaagctattgaagtttgaacagaataagaccaaagggcattcttctgccagtggcgtagtcattcctttgaatgatggtttactctctatcatcggtgaagctcctgcgaatgggaacaaagatgttcttatttttgacctgccgacttatgaaagttgctccaaatcattaagacgttgggtaaagagggcaggaattgataagcacattagctggcattgtgcccgtcactcatttgcagtgaatatccttaacaatggtgctaatattaaaacaatagccggtttgctcggacatagcgggttgaagcatacgaagaaatacacccgtgcagtggataagttgaaggaagaggcaattaatagtttgcccgagttaaagctttga

SEQ ID NO: 1246 - DNA, 2427 bp, B.fragilis
attgcgacaagccagtcattgcatcggatgcaaccaatgtaccccgcattgtccgcaatccatccacataccggaagaactgcatcgcatcgatcgttttgtagaacagctcaagcaggggacactatgatggaaaagataattgatcttctacactccggaggatattcctgtgtcatcggaaacggaacagagatacgaaccttcacccaacggggcgtcgccgatttatatgacttatttcggcaagacccgtcctttatgaaaggagccggcatcgccgacaaggtaattggaaaagcagcagcaagtctaatggtattgggaggaatccggcaggtatacgcggatgtcatcagccaacctgcacttgcactcctgtgcaatgccaatatagaagtgagttatgtacggctggtgcctttcatcgaaaaccgggataaaagcggatggtgtccgttggaaacagcttgctatggaatagaatccatacaggaaatattccggatcatcgaaaacttcctttccaagatcaggataaagaaaaacctgctcggcattctattggtatgcgcttttctcagttcatctttacaggcacaagtccggaaagatacgacacaagcagggcataattatgaaatagacggcgtggtagtgaccggcacgaggaatgaaaccgatatccgtcacctgccaatgacaatctccgtggtgaaccgtgaaaccatcgggcaacgctccgaaccttccctgctccccacattgacagaacaggttcccggattgttcaccaccagtcgtggcgtgatgggatatggagtgtcaaacggtgcggcaggcggtatcagcctgcgtggtataggtggcagccccactacaggattattggtattgattgacgggcatccccaatacatgggattgatgggacatcccattgctgatgcttaccaatcgatgctggccgagaaagtggaagttgtgcgcggccccgcatccgtactttatggctcgaatgccatgggtggagtaatcaacatcgtaacccgccggcaacgggaagacggagtgagaaccggagtccgactgggatatggttcgtatgacacatggatgaccgaagctaccaaccaagtaaaaaaaggacgtttcaacagcattatcaccggatcttataaccggacaaacggtcatcgtcccgatatggaatttgagcaatatgggggatatacgaggttgggttatgaactggatcacagctggaacgtatcggccgatctgaacctgacacatttcaatgcttccaatccgggaactgtcagtacaccggtttttgataatgactcgcgcattacacgcggcatgacttcttttgctctggaaaacagatacgaacgtacatcgggggcactcaagtttttctataattggggcaaacatcacattaatgacggatatggtacgggagaagaaccgctagactaccgcttcaattccaaggaccggatgatgggaatctcctggtatcagagtgcctctttattttccggcaaccgattgactgcaggaatagattatatgcaattcggcggtgaagcctggaaccgtttcattgcggacaaacataaagaaggcatctcggataaatcggaaaatgagattgccggatatctcgatttccgccaggcaatcggcagttacctgacaatggatgcagggctccgtatagatcaccacaccgtcaccggaacggaatggataccacaagtcggtttgtcggtacaattgccacaagacgcaagcctgaaagcaatggccagtaaaggattccgtaacccaacgattcgtgaactgtatatgttccgaccggccaatcccgacttgttgccggaacggctgtggaattacgaactatcttattcacaacgcttactcaaaggtactttttattacggagtcaaccttttttacatcaacggggacaatatgattcagaccattcgcacagacggacgcccactgaacgtaaacacaggcaaagtcgagaattggggagcagaagccgacatagcatatcacattcaccccatgtggagactgacagctaactacagttggcttcatatggagcatcccctgatagccgcacccgaacataaactatatacaggcatcgatttcacacagaagaaatggagtttctccaccggaatacaatatgtgacaggactctatacggcagtcgatcctcaggaaaaaaaagaaaacttcctcctatggaatcttcgcggcagttatcgcatttgctctattgccgacctgtttgtaaaaggggagaatctgctggcacaacgttatgaaataaacgcaggttaccccatgccgaaggctacatgtatgggaggaattaatattaacttttaa

SEQ ID NO: 1247 - DNA, 501 bp, B.fragilis
cacaagagaagtattatctacacgttgaacctaaacaataaaaaaatgaataaagtaatagtcacattcctccttttaattggtatagtagcatcatcttgtacaacctctaaaagtgtaatatcacaaaaggcggacttgtcgaggtatgaatatgcctcaattatcaacaacgacacttatcatattccggctcaactgatggaatatgaaatacaactatttgatgccatagagagttcccgtcttaaacttgtcaatgatatacgtattgacgaactttctccgaatcaacaatcaaagttgcttatggtaaaatatggagtagatattttagaagaagaatctgtcgtaactgtaaatttcatagattatctcactggtcgcccgatagcttcatgccgtggcgcatatacaaccttaggattcagcgtatcagcagacattagaggtgctataaaacgtgttgctaaacaaatagcagaaacatttcctaagtaa

SEQ ID NO: 1248 - DNA, 2151 bp, B.fragilis
tcgaattatggcatgaacacaaaatcaaaacaccccttactatcgttcccgaaaccccagtttacaacaggaatgataaggttgagcatcaccttgctcttttccactctatgcattggttcatttggacagaagaagtcaccgatcaccgtagaaaccctcttggaagagatgacttcatacgatgaaatgacccgctatcccaccctgccctaccgcagcatgcagcagagcagttacgatcgcagatccgtttctcccgatcggcccggctggtttgccaatgacgatggcgaaggatttatccgccttgaagaacacaacggacggaaagaaaaagttcttttcgaagacgaaggtcccggcgccattacccgtatatggctcacgacctttggcagcatacatacaatcttgcgcttctattttgacggaaaggacgaaccaggctgggtggtaccctcttatgatctccagaagttcggtgtacgaggactcaagaaaggattaatcgaaccggacgataaatggatcaggggcagcctgatttatctacctgtcacttatgccgacggttgcaaagtaaccatggaggaactcactcccgaacggacaaacagacattttctattcaactaccgcaaatatcccacaggcactccggtcgaaaccttctcccggaaagttgcagaacgtatccctcaatcggtcgaaaagacatcggctacattgtatagaaatatagataagggggttgatccacaggcccgctatggaaaaggtgcactgatccaccggcaaaatctgtcattaaacaaaggagaaaagcagcaactaaacctccacaaagggaaaagagcgatcagccttctccaattcaacgtgaaaacggatccggatctgaaacccggaacagatgatttcgcccggttgatgcgcagtctgatcatatccataagcttcgacggacagcaaaccgtatgggcaccattatccgattttgcaggctccggtatgggagcatttgcatcccggagttttttcttctattctgatggtaaaggaatcgtttgcagtaaatggctgatgccctatcgacagaattgtgagatctctgttttaaacctctcaccctacaaaaccgatgtacatatcgatattgtatcacaaccttacaagtgggacaaccgttccctctatttccatacagcctggaaacaagaacgcagactgcccgttgtcacttggatggaacatgaaaaatgcatggactggaatttcaccactatctccggcagaggagtctatcgaggagacctgctgtctcttttcaatcatacgacagagtggtatggagaaggcgatgaaaaaataacagtagatcacgaagcgtttccctcccatttcgggacaggtaccgaagactattacagcttcgacggatactttaaaagccagactccatttgccggacagccccgacaagatatgaaggacttttatggttataacagtttcttcagagtcagatgtttggacggcatacctttcaaccagcaactaaaattcgattttgaattactaggttgggaaaatggcacagtagactattcctcgactgtattctggtatggagacttaaactctcaggcagcgggtttttccggtatagaagaaatagaagcaggtttgctacccacccccacccagtcccccgtctgtagcatagccaatgctatcgacttctgccaaatccaaccaacctccaaatctgaaaggctgcgttatgacagacaaaggctcagcggacatccgggcaagtggaatttaaaagaccatctggtgtgtcatggcggtaaaaaaggtgactacatcgaattcgaattctccggttttgaggaccgtgaatacagtttgaatctattctgtaccaaagcagccgactacggtaatataaagttttacgtaaatcgtcaggaaaacggtaaacagctggactgttacagccaggaagtcgaggccacaggtgccataaacctcggaatgcacaagcccatagatggtaagtttatcctaaggatagaattgaccggacagaatgcattatcgacgggcactttattcggactggattgtatacggattgaataa

SEQ ID NO: 1249 - DNA, 279 bp, B.fragilis
cacgattacggattttgcaagatatccggacggagcttgaacaacagacctttcgacaaattcccgatagaagaatgtacatacggtacacctcattacataacacttgaagaaaaggacaaaattttcaatgccgacctatcagccactccgcaactggcaatacagagggatatatttatattccaaacactgataggctgtcgagtgagcgacctataccgcatgacgcagagccgacccacgcacgctacccgaacttctgatagaaaagcatga

SEQ ID NO: 1250 - DNA, 1443 bp, B.fragilis
agatatattatgaaagaagaattatcgaaagcaactcgtacagagagtgatttaataggtgaacgtgaagtacccgaaaccgccttatatggcgtacaaacccttcgggggatagagaacttccgcattagcaaatatcatctttgtgagtatcccttatttatcaatgcactggccattaccaagatgggagccgctatggctaactttgaacttggactgctgaccgaagagcaggcaaatgccattcttcgtgcatgtaaagaaattctggaagggaaacatcatgaccagttcccggtagacatgatccagggtggagccggaactaccaccaacatgaatgccaacgaggtgatagccaaccgcgcactcgagttgatgggacataaacgtggggaatatcaatattgttcgcccaatgatcatgttaaccgttcgcagtctaccaatgacgcttatccgaccgctatccatatcggtatgtattatacgcacctcaaactggtgaaacattttaaggaggtgatcgatgctttcagaagaaagggcgaagaatttgcacacgtgatcaagatggggcgcacccagctggaagatgcggtgccgatgacgctcggacagacgttcaatggttttgccagtatccttcaggatgaagtcaagaacctggactttgctgctcaggacttcctgaccgtcaatatgggagctactgccatcggaaccggaatcaccgccgagccggaatatgcaagcaaatgcatagcggctctccggaagattaccggactggatatccgtttggccgatgatctgataggagctacttccgacacttcttgtctggtaggttactcttctgctatgcgccgtatagctgtaaaaatgaataagatatgtaatgacttgcgccttttggcatccggcccgcgttgcgggttgggcgaaatcaatctgccggccatgcagcccggttcgtccattatgccgggtaaggtcaatccggttattcccgaagtgatgaatcagattgactataaagtaataggtaacgacctttgtgtagctatgagtggtgaagcggcccagatggaactgaatgcgatggaaccggtcatggcccagtgctgtttcgaatctgccgatttgctgatgaatggtttcgatacgctgcgtaccttgtgtatagacggcatcacggccaatgaggaaaaatgccggaaagatgttcacaacagtatcggtgtggtgactgcactgaatcctgttatcggatataaaaactctaccaagattgccaaagaagcacaggagaccggtaagggagtctatgaactggtgctggaacatgacattctttcaaaagaagacctcgatacgatccttaaaccggaaaatatgattcatccggtgaaactcgatattaagcccaatcattga

SEQ ID NO: 1251 - DNA, 1068 bp, B.fragilis
ggaatcattattttgcttttctttgcagtgagaaagaagagcatcatggattcctttgataaatatatatcccgaaaccttccgctggtcagcctgatcagtgcggttttcatcatatatcccaatatagcctgcaccccgtgggagctaaactctttggaaccatcggaataccttggtttcttttcttacttcatataccgtttcctcttcttttgggggatgatcggtttcctgataaactacaatctgcggcagatcccgacagcactgttcaggaaacgcctgactcacaacttcctgtttgcactgaccggttatctgttcttcgcatccgtttcgtataccatctcttcgcatggtttccatacggattttctgggaagcactttaatctcccagttcttcacgctctgctttttatgcactttggtaggatacatctccatgctttatacccggcaaagagaaaaagaacaggaaatagaacgtctccgttttgaaaacttgcaaagccgttgtgatgcactggccaaccaggtaaacccgcacttcttcttcaactcactgaacggaatatcttcactgatccgaaagaagaacgatgaaaacacgctgacgtatgtcaaccaactatccgatattttccggtatatcttgcagagcgaccgcaaaggagtggttacactgagagaagaactggagttcatccagtccttccgatacgtaatggaggtacgctttgccaataaactgagttttactatcgacgtggatgaagcacagaaagatgtactgacactgcctgtactctcactcctgccattggtagacaacgtcacggtacacaacaggatagacagtgaacacaaaatggatatctccatccggctgaacgaacaatacgaactggtggtatccaatcccatttaccccaaactgtcacctcccgacaccaacggaacgggattaagcaaccttgaaaaccgcttcaacttattaatgaataaacaaatccggatagaaactgatgaaaaagtgttccgggtatatttacctctaatatag

SEQ ID NO: 1252 - DNA, 906 bp, B.fragilis
gtgactcctatgaaagaaagaatattaaatatagagaccgtccatcaatgcaactgctgcctgggctgcaaaacactccatccgctggtaagtgtaatcgacctgtcaaagagcgatctggaacagcaaattattaaatttgatttttataccatcctgatgatggaaggggagattgatgatattttatatgggcgcaagtactatgattattccaatgcatcattggtattcctcacgccgggagaatctatcaaaataaacaaaagcaaagcacttccctcaaaagggtggctgctggcatttcatccggacttgatttctcaaacctctttgggagaacatataaaagattactccttctttttttacaatccggaggaggcactccacctatctcaacgggagaaggccaaggctgtagaatgcatatgcaacatcgaagaggaacttcgtcatgcgatagactgccacagccaaattctgatttcacggtacatagaattgttattagatcattgcaaccgtttctacgaacgtcagtttatcacacgttgcgaagctaacaaaaagattatgaagaaaacagatgtattgttgaaagattatattctatccggaaaattaaaatacaatacatcgccttcattgggatactgtgcaaaaatacttcaactgtcatctcattatttcaatgacctgctgaaatttgaaagtggaaaaaatatcgatgaatatttcgagtcaaaacgtttggaaatggctaaaagcatgctgctcgactctaataatacggtaagtgtagttacggaaaaactgggataccccaatatacgatactttagccgtttatttaaaagaattaccggagtggctccgaataattacagactctcacagaattag

SEQ ID NO: 1253 - DNA, 1764 bp, B.fragilis
aaaatgtatatagaaaaaattaattcgccgaaggacataaaagaattgtcagttgaacaactaagtgtgctggctgaggaagtaagaactgcgttaatcaggaaattaagtgaacacggtggtcatatcggcccgaatcttggtatggtggaaactacaattgcactgcattatgtttttaactctcccattgataaaatagtttttgatgtatcccatcagagctatgttcataaaatgcttaccggaagaatggctgcatttcttgatccggctaaatatgatgatgtcaccggatatactaatccggatgaaagcgagcatgatttctttacgataggacacacctcaacatctgtttcactggcaatgggacttgcaaaaggacgtgatctcacaggtggcaaagaaaacatcatcgctgtaatcggtgacggttcgttgagtgggggagaggctttggaagggctcaacaatgcggcaatgcttggctctaacatgattattatagtcaatgacaatgatcaatccattgctgaaaatcatggaggactttataaaggattgaaagagcttagagacacgaatggggagagtcctgataatatttttaaggctatggggttggagtattattaccttggagatgggcatgacgtgtcagcactcataaaattatttacgcctgtcaaagatatagaccgtgcagtagtattgcatatccatacgatcaaaggtaagggattgaaatatgcagaagaaaataaagaatactggcatgcaggaggtccttttcacatcgaagacggttctcccaaaggacccggatggccggtgaatgaaactgtcagggagtctgttttagacttgattgaaaagaggtcggatgtagttgcaattactgcgggaacaccgtctgtaataggatttacggaagactatcggaagcgtgccggcaaacagtttgttgatgtaggtattgcggaagaacatgctgttgcaatggcaagtggtattgccaggaatggaggaacaccgatttttggagttttcagtccgttcttgcagagaacgtatgaccaactttcgtcagacttgtgtttaaataataatccggctgtaatcatggtgtttatggcttcagtatatgggatgaatagtaatactcatttggggatctatgatattccgatgatttcacatatacccaatctggtatatcttgctccgacgagcaaggaggagtatcttgccatgtttaagtatgccactacacagaaggcgcatcccattgctatcagaattccaatgatgatgcctgagacgggaattgaggataccacggattactctttactaaataaatatcaggtcgtacgaaaaggttcaggtgttgcgattattgcacttggagatttctttgaactgggcgtacaaattgccgataaatataaaatcctgacgggtaatgatgtaacactgataaatcctaaattcatcacaggtattgatgaagagctgctggagtgcttaaaaacggaccatgaacttgtgcttactcttgaagacggcatagtggaaggaggattcgggcaaacaattgcaagtttttatggtttatcggatatgaaggttaaaaattatggaataaagaaatcattccccacagattttcggcctgaagaactgatgagagagaatggattatccgtagagcaaatagtagaggatataaaatccgtatgcagagagcacgttatgtga

SEQ ID NO: 1254 - DNA, 666 bp, B.fragilis
aactatatctttgtcccgaattttaaacacaacttagttatgaaaaagattattagtgctttaatgatggctgtatgtatcggtatggctatgcctgctcaggcacaacttatcaaatttggtgtgaaaggtggtgtaaacctggcaaaagctgatttaaatacgtctgattttaaaacagacaatttcaccggattctttatcggtccgatggctgaagttactattccactgataggtttgggggttgatgcttctctccttttctctcaaagaggtgtgaaagttagcagtcgggattttattgatcctcttgcagatagtgatccaataataggaaatcgtactatcaggcagaatggtcttgatattccaatcaacttaaagtatactatcggtttgggtagttcattgggtatttatgtagcagctggtccggacttttatttcaacttctcaggagataaagtttatgaaaactatggacggttgaataaaaaaaatgctcagataggaatcaatgtaggtgctggtgtgaagctgttgagacacttacaagtaggtgccaattataacattccgttgaataaaacggcagaatggaaagaggctgatttctcttataagactaaaatgtggcagatttccgcagcttacattttctaa

SEQ ID NO: 1255 - DNA, 1206 bp, B.fragilis
aagaatgtcatgttccagcaccagttcatagactcccttaccggtctcctgtgcttctttggcaatcttggtagagtttttatatccgataacaggattcagtgcagtcaccacaccgatactgttgtgaacatctttccggcatttttcctcattggccgtgatgccgtctatacacaaggtacgcagcgtatcgaaaccattcatcagcaaatcggcagattcgaaacagcactgggccatgaccggttccatcgcattcagttccatctgggccgcttcaccactcatagctacacaaaggtcgttacctattactttatagtcaatctgattcatcacttcgggaataaccggattgaccttacccggcataatggacgaaccgggctgcatggccggcagattgatttcgcccaacccgcaacgcgggccggatgccaaaaggcgcaagtcattacatatcttattcatttttacagctatacggcgcatagcagaagagtaacctaccagacaagaagtgtcggaagtagctcctatcagatcatcggccaaacggatatccagtccggtaatcttccggagagccgctatgcatttgcttgcatattccggctcggcggtgattccggttccgatggcagtagctcccatattgacggtcaggaagtcctgagcagcaaagtccaggttcttgacttcatcctgaaggatactggcaaaaccattgaacgtctgtccgagcgtcatcggcaccgcatcttccagctgggtgcgccccatcttgatcacgtgtgcaaattcttcgccctttcttctgaaagcatcgatcacctccttaaaatgtttcaccagtttgaggtgcgtataatacataccgatatggatagcggtcggataagcgtcattggtagactgcgaacggttaacatgatcattgggcgaacaatattgatattccccacgtttatgtcccatcaactcgagtgcgcggttggctatcacctcgttggcattcatgttggtggtagttccggctccaccctggatcatgtctaccgggaactggtcatgatgtttcccttccagaatttctttacatgcacgaagaatggcatttgcctgctcttcggtcagcagtccaagttcaaagttagccatagcggctcccatcttggtaatggccagtgcattgataaataa

SEQ ID NO: 1256 - DNA, 2421 bp, B.fragilis
tttacttacataacattttttttattaacacttaaaaacagaggtatgagaaaatggacttatctcgtagctgcgctcttagtgggaggagcaactacaacattcaccggatgtatcgataacgatgaaccggcgggaatcgaacaacttcgcggagcgaaagcggaattcattaaggcaaaggctgcctatgaagacgcactgacccaaatccaattagtcaaggtagaaagagagaaagttaaacttgaaaaagatcaggttaacttggaactaaaaaaatgcagtttggaagtagaacaagctaaaacagcagaacaaaaagctttttgggaagctgaagctcaaaagagaactgaagagttcaaagcaaaaatactcgatctacagacacttactgcacaggctgagtataacaataaaaaagctttaatggacattgaagtggctctactcaccatgaaggatgacgcatatactgctgaaatcaataaatatcgggctgcgttggttggttatacatttaagtcagagtctaccactaatggagagacaactattacgacgaattctagttatggcgcattggctgatttagccgaagcgaaatcaagtttaatgaaggccgaggttgccagaattaatttcttatctaagaacaaatactatccggaagaattgcagctggagagaacgcatgctgccaaaacgttggaaatccagatggctctgatggaagaatacaaagcattggatgcgacaggcactgatagcaaggctttggcagataagctgaaaggctataaaaccgatttgcaagcccttgacgctaaagaagacgaggcctatactaaaatcgaagaaatgagaaagcccatcttcccgattaatcagcaaattattgaagagaaaataaagttggacgcaacatcctctgcttatacattggccaaagcagatgtagatcctgctttagtaaacggattatacagtgcattgtcaaccggagaagatgaagagaaactcgttgaggatcttgataaaatctttgtccaggatagctggaacgcagaattgctgaattaccaatacaccatgaagaaagatgtggtgattaatgatcttagcctcaataacaaagcaactaaaataggagctattgccgatgctatcaaagcatattatcaaggggagaatagcgaagcattcgacgcaagcggaaaattattagatgcatacaaaacaaaatttgagaatgaacttaagcgtttggaaattgataagaaaccagcttacgaccagttcaaatcggactctaccgcttggattaatgcatacgttgcttatgtagcagccctgaaggcttataataactataaaggaaccaacacctaccaagcgattacgaaagaggtcacaacttataacagcttaaaagctgaagataagaagttggaaacagccaacgcattgcgtacctccatattgggataccttggaaagagaaaagcggtggacggctttaacgcagaattcgctactacttataaagacgctttaactgacgctaatctggctactttcaatgaagcaattgcaactgcagtaagtgacggtataagttcattaatcggcaatgaaactcttgcaacatcattcaatgataaagttgaaggtagcacactctttgccttcttggaggctaatcaagcattgttcggtggttcagaactcaatcttgaaaagagtatcgaacctaaagaaatatcagcaaataaatatgatatgcccaaaaatgtttctcagttgattgataatcccgaaaataattcaggttcatttgttaaatatacctatttggctcaggaatctaattatctggttaacctcgacaaatggcaggctttgtatgccaagatcaaggcggaagcagatcctgtacttgcagaagtggatgctatcaacgagaaaatcgctactttggaatcgcaaattaaagatgaaaacgcagcattgtggcaggcagaattggcttgttatctgattaaaggcgataagtcgaaacgccaaaacgagatcttctcagaaagcaacccttacaaaaactactatacttctaacgagcaagaaccacttttgggtaatgtcgtaactgaatattctaaacttgaagcagaaatcgccctcgttcaaagagctatggaagatggatacttctactatacgtattatgatgccaacagccatacctataaggtaagcgagaagagccttaatttgacaagtttacttgagactcaggaagaagctattaccgacgctaagaaaaccgtagaagatatcgacaacaaaatcgccttgttcgataaatacggatacactaatattgaaggtcaggaagagtatcttgatctgtcttga

SEQ ID NO: 1257 - DNA, 1572 bp, B.fragilis
aaaacaagaattatgaatgtaataatatattgcagagtaagttcagacgaacaaacattaggagccagcttagacgtacaagaagaacgcctacggaaatattgtaaccaaatgggatataacatcattaacaatatcccatacagagaggatgagagtgctaaaacatttgaaaaacgccctgtcatacaaggaataatgagctacatacgtaagaacaaaggcaaagtgaataagttgctattcttgcggtgggatagatattcacgagacattatcagtgccagtgagaacctaaaagaattacttaaattgggagttgaaccaaatgcaatcgaagcacctttagacttcaattcagacacttggcccctattattgggagtacacataggctcggcacaatgcgacaacatcaagaggtcaaaagccacaatggacggtattcatggaacattggcaaaaggaaaatgtgctaataaagcaccaagaggatataagaatgtacgtattagcaaacatgaaacccatgtagaaatagataccaatacagcgccatttatacaagccatgtttaaagaagtggctaaaggtattgaaacaccttgctatatccgtaggaagtttgctagaaaaggatataatatacccgaaagttcatttcttgaaatgctacgtaacaaattttatatcggtaaaattcgtgtgccagcctacaaaggagaacccgaatattatgtaaacggtgaacatgaagcaattatagacgaagaaacattctataaagtgcaagagattttggacggtaaaagaaagaaaacacccaaactatccaaagccataaatcccgatttgtatttgcggaagtttttaatctgtcccgtatgtggttgtgccctaactggtgcgacaagttcgggcaatggcggcaaatacacctactacttttgttgtaacaatcaaaaacatataagaatgagagcagagaacgtaaacgaagagttcgctcgatacacagcccaattaaagcccaataaaacggtattgaacttgtataacgaaattctaaaggatttgcaaaacgaacgcaaaggagaaagtaagaaagaagtagtagcactacaaaatgaactttctactgtccaaaaacgcatcaacagcattgaagataaatatctggacggagatttaaccaaagaagaatataacagaatgttggagagatacaccaaagaagcctcaaccatacaacaacaagttgaaatgcgtgagaaccctaaccgtagtaatatcgaaccaaaactaaactactctatcaatctgataaacaatatagatagctatataagaaatgcgtctgtaggggtgaagattaagctaataagttcgatgtttcccgaaaaaatcgaatttgacggaaaaacatatcgaaccaattcttataacaaagtgcttgatttaatttatcagcaaaccaacgagttacgaggagtagaaaagaaaagcggagagagtttttcaactttctccgcctcagtacccagacccggggtcgaaccgggatggaagtga

SEQ ID NO: 1258 - DNA, 1020 bp, B.fragilis
aagaataactttaattttttaatgaaatcgcaatatgaaaagaaacgattaatcacttttgatagaattaaaatcaaatccaactataaatatcttctcaacactaaagtgaagttcaatgaaatgtttcattcacgtagtggggagaaaataggtatattttatagctcaaaagatgatataaatataccttataacctctatatagctgtcagctatataaaacaaaccttaactcttgaattttccagtaagattttgaaagaaaaatatccagacttaatttcaagagatactatcaaagaatgtctaaccaatataaaccaactacatatttgtgatattgatgtagatagtatcttatccaatggagcaattacatcagtagatgtaacttatgatgcaaaccttattctaagtgataatcttctgaacattcttaattcacaagtaaccaactatagacgcttcaagtgggcacattacgataaagagggcatcacttttactaaagatgtgaaatccaaagactgtacggaaacaatcaccttatataataaggaaaaagaaatatgtaccagccacaataaagactttttaaatagcctatcacaaccacaatcagtaatagactatttcaaagggaaaaccagatttgaaatcacattaaacacagttaaaaagataatgaactatttgaatttgaccgataccaaaatattcagtgtattaaattccgatacaaaccctatccttactcaatttgacaaggttttcggtaattctacagccaatatgccaaacacaacatttgatgattacgaaaattgggcaatgaaaatcattctcgaaaggtacaatggtgatttaaaactactggagcaagatattagaagcaagttcaactcacgtagtggtgctagtaagcgaatgaaaaagtttgaaacggtttatcatgcaatgacatcagcctcaaccagtgaaaaccctattgaaaagatacgtaatctgttgctttga

SEQ ID NO: 1259 - DNA, 264 bp, B.fragilis
atgatgtcagtattattactcccgctgaggtggaggctattgagcgcgaaatcgatgccgccgacgaaattcttccacctttacattcttttattattccgggagggagtcgtggctctgcggtttgccacgtttgccgtaccgtttgccggagggccgaacgccggattcttgcattatccgaaagctgtacaatctcagccgatttactggcctatatcaaccgtttatcggattatttatttgtcttgtcccgtaaaatga

SEQ ID NO: 1260 - DNA, 621 bp, B.fragilis
gaacgatcattggtctttgcaagaattctcattacctttgtccgaaaccactatcaactaagtaatggaaaaaaagacgaagtctggcaggtagtcagcagtaaatatctatttcggcgcccatggttaaccgtacgttgtgacgacatgcttttgcccaacggcaatcatattccggagtattacatccttgagtatcccgactgggtgaacaccatcgccatcaccaaagaaggaaagtttgtattcgtccgccaattccgtccgggaataggtaaacagctatacgaactctgtgccggcgtatgtgagaaagaagacgcttcaccacttgtttcggcgcaacgggagctacttgaagagaccggatacggcaaaggcaactggaaagagtatatggtaatttcggccaatccgagtactcataccaatctgacacactgctttctggctactgatgtggagcaaatcgacacacaacacctggaagacacggaggcgcttacagtacatctgctcagccttgaagaggtaaaagaactactggaaaacggacagatcatgcagtcactgcatgcagccccactttggaaatacatggcagaacataaacagatctaa

SEQ ID NO: 1261 - DNA, 192 bp, B.fragilis
cgggtcatttcatcgtatgaagtcatctcttccaagagggtttctacggtgatcggtgacttcttctgtccaaatgaaccaatgcatagagtggaaaagagcaaggtgatgctcaaccttatcattcctgttgtaaactggggtttcgggaacgatagtaaggggtgttttgattttgtgttcatgccataa

SEQ ID NO: 1262 - DNA, 594 bp, B.fragilis
attatggaattacaggttattcagaataaaatatacgaagtcagaggtcaaaaggtaatgcttgactttgatttagctgaactttatgggagtgaaaccaaacgactgaaagaagcagtaagaagaaacctcaaacgcttccccagcgatttcatgttcgaattaacaaaagaagagtttgaaagtttgaggtcgcaaattgcgtcctcaaacaaaagaggtggtacacgatatatgcctttcgcttttactgagcaaggcgttgctatgctttcatctgtactaaacagcgaatctgccatcgaaataaacatatctatcatgcgtgctttcgttacagtacgtcaatacttgtcttccttaaatagcacaactaaggaaatcgaagaactaaaacaacgcatgaaaatgttggaagaaggcaacgaagacataatagcagcagtcaatgaccttagcgaagatacccgaaaagagcttgacgatatttacttagcattgtcacagttagcagagaaacaaaagcatgttaataaacaaacagaacgtagacctattggatttgctcactataaagaaaacaacaaaaaatag

SEQ ID NO: 1263 - DNA, 2439 bp, B.fragilis
ttatcaccatcgccaaataaagaaaccccgacaatgaaagaagacttatacgacgatctatacgaagagaaagaagaaaaaatagacttccatgccctcctgttccgctacgtcatccggtggccctggtttgtagcctcggtcatcatctgcctggccggagcatggctacacctccggcagaccactccggtctacaacatctcggcctcggtcatcatcaaggacgataagaaagggggcaacagtggcggaaatctcgccgcgctcgagggcctggggctggtcaactcggtatcgaacatcgacaacgagattgaaatactacgttccaaaacgctggtcaagcatgtggtcagcgagctgaacctctacaccacctactccgtcaaaggcagtttcaacgaagtagagctttataaaagttcgccggtactggtggggctcaccccgcaagaagcagacaggctgccgggtccggccgtattcgaactcaccctgtcgcccggcaaccggctcgacgtgaaagccaccgtcggggaaacctcctacaacaaaaaattctccaaactgccgggcctgctcgtcactccggccggaacgttcaccttcacccttgccggcgactccgccggagtaagtgaaccgcagacactcaccgccgttgtaagcaaccccatgcagacggcaaaaaggtatgcggcggcgctcagcgtagagcctacctccaaaaccacctccatcgtcatcgtctcgctcaaaaacaccaacaagcgtcggggcgaggacttcatcaaccggctgatcgaagtctacaaccggaacaccaacaacgacaaaaacgaagtggcggagaaaacggaagagttcatcgccggacgtatccgcatcatcaacgacgaattgttcagtaccgagaaggagctggaaaccttcaaacgggatgccggactgacggaccttgccagcgacgcccaactggctgtgagcgaaaattccgcctacgagaaacaacgggtcgagaacggcacccagctcaacctcgtacgctacctcgccgaatatatctccgccccggacaagatcaacgccgtgctgcccgtcaacgtcggcctgaccgaccagtcactctcctccctgatcgggcaatacaacgaaatggtgcttcagcgcaaccgcctgctacgcaactcctcggaaagcaacccggtgatcgtgaacctggatagcggcatccgtgccatgcgcgaaaacatcctgaccaccatccacagcgttcagaaaggattgctgatcaccaaggccgacctcgaccgtcaggccaacaagttcaaccgccgcatcagcaatgcgcccgcgcaggaacgccagttcgtcagcatctcccggcagcaggagatcaaagccggactctacctgatgctgttgcagaaacgggaagaaaactccatcgcactggccgccactgccaacaacgccaagatcgtagacgaggccatggcggacaacggtcccgtttctcccaagaccaaaacgatctatatgatagccctcgtcatggggatgggcatccccgtagccatcatctacgtcatggggctgctccagttccggatagaaggacgggccgatgtggaaaagctgacctccgcccccatcatcggagacatccccctggccgaagagggtaacgggaaagcgggaggcatcgctgtccgcgaaaacgaaaacagcctgatggcggaaaccttccggggcatccgcaccaacctgcagtttatgctgggcgaagagaataaagtcatcctggtcacctctaccatcagcggcgaaggaaaaacatttgtagccaccaacctcgccatcagcctctcgctgctgggcaaaagagtagtcatcgtagggctcgacatccgcaagccgggactcaacaaggtcttcaacctctcgcagaaagaaaaaggaatcacccagttcctggccggcccgcagaccaccgacctgatgtctatggtgcagccctccgggatatcccgcaccctgagcatcctccccggcggaaccgtaccgcccaacccgaccgaactgctggcacgccaggcattggtggaagccatcgatatcctcaaaaagcacttcgactatatcgtgctcgacaccgctcccatcggaatggtgaccgacacacagatcatcgcacgggtggccgacctctcggtttatgtctgccgcgccgactatacccacaaagccgactataccctgctcgaagatctccgcctgggcaacaagctccccaacctgtgtaccgtaatcaacggcttggacatgaaaaagcggaaatacggctattactatggatacggaaaatacggccgctattacggatacggaaagaagtacggttatggctacggctacggacaaaagcataattag

SEQ ID NO: 1264 - DNA, 306 bp, B.fragilis
gactatgtgtccctctgtggtgaattacacgaggaagtacacacgtgttacaatggggggtacagaaggcagctagcgggtgaccgtatgctaatcccaaaagcctctctcagttcggatcgaagtctgcaacccgacttcgtgaagctggattcgctagtaatcgcgcatcagccacggcgcggtggaatacgttcccgggccttgtacacaccgcccgtcaagccatgggagccgggggtacctgaagtacgtaaccgcaaggatcgtcctagggtaaaactggtgactggggctaagtcgtaa

SEQ ID NO: 1265 - DNA, 1767 bp, B.fragilis
ctacgagcttttataataatgacagatatgacagatataaaaaacgaagaagcaggcgaaaagaaaagcctcaatttcattgaacaggcagtagaaaatgatttgaaagctggaaagaacgggggaaaagtacaaacacgcttcccaccggaaccaaacggttacctgcacatcgggcacgctaaagccatttgtctcgacttcggcatcgctgccgcacacggcggtgtgtgcaaccttcgtttcgacgacactaacccgacgaaagaggatatggaatatgtagaagccatccaggaagatatccggtggctgggattccaatggggcaacgtatattatgcctcagattatttccaacaattatgggactttgccgtcactctgattaaagaaggcaaggcctacgtagacgagcagacttcagaacagatagcgcaacagaaaggcactcccacccaacccggtgtcgagagtccgtaccgcaaccgtccgatcgaagagagccttgccctgttcgaaaagatgaatagcgacgaagccaaggaaggttccatggtgcttcgtgccaaaatagacatggcaagccccaacatgcacttccgcgacccgatcatgtaccgcatcctgcatgtggcacaccaccgcaccggaacccaatggaaagcctacccgatgtatgactttgcacacggtcagagcgactatttcgaaggagtcacccactcactctgtacactcgagttcgtgcctcaccgccctctttacgatctgttcatcgactggctgaaagaaggcaaggacctggacgacaaccgtccccgtcagacggagttcaacaaactgaacctgaactacacgctgatgagtaaacgcaacctgctgatcctggtgaaggaaggactggtgaacgactgggacgatccccgtatgccgactctctgcggattccgccgtcgcggctattctcccgaatccatccgtaagttcatcgataaaataggttacaccacttacgatgcactcaacgacttcgccctgctcgaaagcgccgtacgcgaagacctgaatgcccgtgccacccgtgtatctgccgtactgaacccggtgaaactgatcatcaccaactatcccgaaggacaagttgaggaactggaagccatcaacaaccccgaagatccgacagccggaagccataccatcgaattcagccgcgaactgtggatggaacgcgatgacttcatggaagatgccccgaagaaatatttccgcatgactccgggacaggaagtgcgtctgaagaatgcctacatcgtaaaatgtacaggctgcaagaaagacgagaacggcaccgtgaccgaggtatactgcgaatacgatcccaacaccagaagcggcatgcccgacgccaaccgcaaagtgaaaggcaccctccattggctcagctgcaaccattgcctgccggcagaggtgcgtctgtacgaccgtctctggaaagtggaaaacccgcgcgacgaaatggcagccatccgtgaagccaaaggttgcgacgccctcgaagccatgaaggaaatgatcaatccggattcactgaccgtactgccccattgctatatagagaagtacgtggccgacatgcccgcgctctcttatctgcaattccagcgtatcggttatttcaatatcgacaaagattccacccccggacatctggtattcaaccgtaccgtaggactgaaagatacctggggaaagatcaataaataa

SEQ ID NO: 1266 - DNA, 675 bp, B.fragilis
gccttacagttgtttgatgaaaaagcaatttatgtaacaaatttaatgtttaaaaaaatgaaaaaagatttcaacttaaccaagcttttttattcttttgcgattgctttctcagtggtaaccttgtcttcttgcaacaacgatgacaattctccgcttcctcctccatccaccaacgatgtggcaggcacctataacggaaaagtactgataacccaggtgactcccgccactgtaaaagaaaatgccggagaagctccccagggacaagacgtaaacgctacggtgaaaaatgacacggtgttcttcgacaaattgccggtaaccgaacttattacctccattgtaggcgataaagacaaagcggaagccattgtcaaagccatcggtgacgtaaaatacaaagtaggctacaagccggctctcaatacagagaaggacagcatctaccttgctttcgatccgaaaccgttgacccttcaactgcctgcagctgtagaaggccaggaaggacagactgttaccgtaaccatttcgtctccggacaaaggcagctttgcttacaagaaaaatcagttgaagttgaagctcagcgccgataaagtggaactggcaggcgtagcggtacctgttcctcagaccctgttcaacttcgatatgaccaaaaagaagtga

SEQ ID NO: 1267 - DNA, 519 bp, B.fragilis
aacttagagttatcaattatggcaacaacaaatttcaaaggacaaccggtaaagctgattggcgaatttatacaggttggaaaggtggctcccgatttcgagctggtgaaaagtgatttatcttctttcgcactaaaagatctgaaaggtaagaatattgttctgaatattttcccgagtctggataccggtgtgtgcgccacttcggtgcgtaaattcaataaaatggcagccggaatgaaggataccgtggtattggccatttcgaaagacttgccgtttgcgcagggacgcttctgcacgacagagggtatcgaaaacgtgattccgttgtcggatttccgcttttcggacttcgacgagagctatggcgtgaggatggctgacggaccgctggccggactgctggcgcgtgcggtagtggtgattgggaaagacgggaaagtagcttatacagagcttgtaccggagattactcaggagccggattatgaaaaggcattggctgctgtgaaataa

SEQ ID NO: 1268 - DNA, 1140 bp, B.fragilis
atgattaatacaccacgaaaaaacggctattcattcaaatacgggacacttttttacgttccttttttctcatgccacttgggtatttctgaaactttcattcgtctatacatttatgctattgattttttactaatttccagcatattttccaatctgtcactcaaaatcttttttattataaaccgtgttcttgaacacactaaaaagaacaagaaaatggaaatagaaaaattcattaaatctttagcaagaaaagcgaagttaggcgggcgttacagcacagccaatacctacctctacactttgcacagttttcagaagtttgcgggaaaagcctcactgacttttgaagagatcactcccgagagtatcaaggagtacgagcaatacttaatcctcaacgggaaacggtacaacacgatctcgctctacatgcgcatgttgcgttccatctgcaatcaggcatcggagcagaacatagcttcgctcaacacccgcgagctgtttgagaatgtttttatcggcaacgagcccactgccaagcgggccatctcacccgtcctcatttcccgcctgctcgaagcagatttcagcaagaacagccggctcgattttgcccgcgacctcttcttgctaagcttctacctgaggggaatcccgtttgtcgacctggtacatctccgcaagaccgatgtgcagggaaacatgctcgtttatttccgccagaaaacgggacagcaacttacggtaatcatagaaaactgcgccaaagtgatcttgcgtaagtatgcctcgctttgcaaagaatccgtctatctgctgcccgtcatcagcgcagccggagaggaggggcacaagcagtaccgaagtgcattgagggtatacaacaaacgcctcaaccagatatccggaatactgaaattgaagactccgctgacctcttatgtggcacgccacagttgggcgaccacggccctgcagaaaggggttccggtttcagtgatcagtgcaggaatggggcatgcttcagagaaggtgacatacatttatctggcatcttttgataacaaaacgctcagtaacgcaaataaaaaagtgattgccgccgtgagatttaagaaagaggaggaggagtga

SEQ ID NO: 1269 - DNA, 468 bp, B.fragilis
aaagaaagtacgattatgagtaaagaagttacgtattcggtagtggcgcgcaagaacatgctgaagaaggatgatcccgccaagtattatgcccaggcacaggccagcggcgatgtggggctggacgagatctcgacccgggtggaaaaggcctgtacggtacattcggcggatgtcgtggcggtgctgaaggcgctggaggatgaaatggtggatggcctgtcgaggggagagattgtcaggctggggaatatcggcaccttccaggtgggcctgcgaagcaggggagcggagaaggcggaggatttcaaagcggcgaatatcagcaaggcgagagtgaacttccgtccggggcctgtgctggcggatgcgatgaagacgctcaatttcagtaaggtgagtacgcgggcggcgcagaaaggcgatggcggcggggacggggatattgtggatgacccgacagcataa

SEQ ID NO: 1270 - DNA, 315 bp, B.fragilis
aaacacactgcattccggatatttttccgtacatttacagtatgtaacaatcagataatcaaagccatgaatcaaagaaaagaagaagacacaaccgaagccgatttcatcatccgctcgtacaccaaagccgaacttgcacagctttactgcccgggactcgaccccgtgctcgccctgcagaaactctaccgctggatgcgtaaaaacaccgccctgacacaggcactgtccgaagtcaattacaacaaataccgccacagcttccttaaacgggaagtccggctgatcgtgtattacctgggagaaccttga

SEQ ID NO: 1271 - DNA, 639 bp, B.fragilis
acaatcggtgcaagaactttgttcacgatggacaataatctaaaaaataaaattgatatgaaaactttattcgacgagatggaacacgcagtcaaaaactggtggttatctcttattctgggtattctgtacatcatcgtggctctctgtctgctattcgcaccgggaagcagttacattgccctcagcgtcatcttcagcatttcgatgctgataagtggtatcatcgaaatcatcttctccatcagcaaccggcgaggcatctcgtcctggggatggtacctcgcaggcggtatcatcgatctgatcttaggcatctacctggtagcctatccgctgctcagcatggaagtcataccgttcatagtcgccttctggatgatgttccgcggtttctctgccacaggctattctatggacctgaagcgttatggcacccgtgagtggggatggtacatgggattcggcatcctcgccatcatttgttcgctgatcatcctgtggcagccggccgtaggtgccctctacgttatatatatgctggcattcactttcctgatcatcggattcttccgtgtcatgttgtccttcgaactgaaaagccttcataaacgatcaacggtgatgaacggtaaatga

SEQ ID NO: 1272 - DNA, 1449 bp, B.fragilis
ttgctaattaaattgggcagaaaaaactccccgtccgaaagagagcgggaattacagaaccttatcgcacaatacgaagcggtaaaagccaaaaacgaatcgctatacctggacggtgaccaattggctgatattgccgatctatatgcctccgaacgtaagtttaaggaagcccaggaggtcataacatacggactcggactccatccgggacacaccgaccttatggtcgaacaggcttacctgttcctggatctcaatcaaccccaaaaggccaaagaggtggccgaactcatcaccgacacttactcctccaacgtaaaactactcctggccgaactgctgctgaacgaaggtaaactggatgccgccgaccaaatgctcgacagcatagaagaggaagagaaaaacgacctgggcatcctggtcgatattgtctacctgtacaccgacttaggttatccggagaaaggcgtacaatggctcaaacggggtgcggagatgtacaaagatgacgaagacttcctggcagccaccgccgattgctacggtgcggccggagcagaatacatagagcaagccatcgttgtcttcaacaagctgatcgacaagaatccctataacccggcttattgggtaggcctggccaaatgccagtttgccaccaaagatttcgataaagccatcgagtcctgtgactttgccatcgcagccgacgaagaattcggcgaagcccacatcatcaaggcacacagcctctttcatcttgagaacatcgagggagccatcgttgaataccggaaagccctgaagtataaaacgctctcccccgaatttacatatatgttcatcggactggcctacacccagcaggaaaattgggctgaagccaacgaaagttacagcatggctctccgggcgatcgaagaaaacggtaacggttcttccccgctattgtccgatatctattcaaacaaagcactctgcgcttcccgccagggcgactcggaagaagcccaccggctttgccgactggcaaaagagctcgccccccaggatgcagagccctacctgctcgagggacgcatctatatggaagaggacaatttcgacctggcccgtgcagagtgggcattggctctccgctatgcccccgaagcagatacctggatggaaataggcaactacagcctcgagttccgcatgctcgagaacgcacgcttctgcttcgagcaggtgctggaagaagatcccgagtaccccaagatctgcgaacaactggccgccgtatgcctcgtccttcaggatcatgaaggattcaagaaatacaacgcgatgtccggcgattccatcaatctcgactccctccgggatacgatattggaaatgggtgtcgacggagaacagatgcttcgcgaactggacgattttttaaaagacgaaaaataa

SEQ ID NO: 1273 - DNA, 762 bp, B.fragilis
caccgatgcaaattaaagatgtctttgatgaagagatcaccaactggaaagagttggggggtgaagatctcccgatccggggtgttccgtctggaagacatcacgcactactactcggaagaagaactgggagaagcctacgagaatgcaggggaaaagattatggagctgattcagaaaacacccggtatcgttgcttttattcctcagaagtttgtggtacggccggatgcggtacatttcataaaggataacaccatttctgtgaaggaggtctttgccggagcggaatggtttccgacggctactcccgcacctttgttcggctttctgccgctgataaccggtacgctttgggtgagcctgtttgccatattgattgctttgccgttcggactttcggtatcgatctatatgtcagaggtggccgattcgaaagtacgtagttggctgaagccggtgatagagttgctgagcggtattccttcggtggtatatggctttttcggcttgatcgtgattgtacctttgattcagaaagtatttgatttgccggtgggggagagcggacttgcgggaagcattgtgcttgccatcatggcattgcccaccatcataacggtgactgaagacgccatgcgcaactgtccccgtgccatgcgcgaagccagcctggcactcggagcttcgcagtggcagaccatttataaagtagtgattcgtcttcaccacggggctggaaggatccgacgactggatcta

SEQ ID NO: 1274 - DNA, 1275 bp, B.fragilis
aatcatagagatgcttttctaattatgcttttgtccgtagccgtagccataaccgtacttctttccgtatccgtaatagcggccgtattttccgtatccatagtaatagccgtatttccgctttttcatgtccaagccgttgattacggtacacaggttggggagcttgttgcccaggcggagatcttcgagcagggtatagtcggctttgtgggtatagtcggcgcggcagacataaaccgagaggtcggccacccgtgcgatgatctgtgtgtcggtcaccattccgatgggagcggtgtcgagcacgatatagtcgaagtgctttttgaggatatcgatggcttccaccaatgcctggcgtgccagcagttcggtcgggttgggcggtacggttccgccggggaggatgctcagggtgcgggatatcccggagggctgcaccatagacatcaggtcggtggtctgcgggccggccaggaactgggtgattcctttttctttctgcgagaggttgaagaccttgttgagtcccggcttgcggatgtcgagccctacgatgactactcttttgcccagcagcgagaggctgatggcgaggttggtggctacaaatgtttttccttcgccgctgatggtagaggtgaccaggatgactttattctcttcgcccagcataaactgcaggttggtgcggatgccccggaaggtttccgccatcaggctgttttcgttttcgcggacagcgatgcctcccgctttcccgttaccctcttcggccagggggatgtctccgatgatgggggcggaggtcagcttttccacatcggcccgtccttctatccggaactggagcagccccatgacgtagatgatggctacggggatgcccatccccatgacgagggctatcatatagatcgttttggtcttgggagaaacgggaccgttgtccgccatggcctcgtctacgatcttggcgttgttggcagtggcggccagtgcgatggagttttcttcccgtttctgcaacagcatcaggtagagtccggctttgatctcctgctgccgggagatgctgacgaactggcgttcctgcgcgggcgcattgctgatgcggcggttgaacttgttggcctgacggtcgaggtcggccttggtgatcagcaatcctttctgaacgctgtggatggtggtcaggatgttttcgcgcatggcacggatgccgctatccaggttcacgatcaccgggttgctttccgaggagttgcgtag

SEQ ID NO: 1275 - DNA, 189 bp, B.fragilis
gaaatgcgctggaaggagaaaaagaagcttattaaaataaagaaaatgaataaaagaaattacaccacagaggaacacagagtttcacagagaatttttttcccccatcacacaaaagatgaaaaccctgtgaaactctgtgtactctgtggtgagccaccccatagtaatattctaaaattaagataa

SEQ ID NO: 1276 - DNA, 462 bp, B.fragilis
cggcatccgtgccatgcgcgaaaacatcctgaccaccatccacagcgttcagaaaggattgctgatcaccaaggccgacctcgaccgtcaggccaacaagttcaaccgccgcatcagcaatgcgcccgcgcaggaacgccagttcgtcagcatctcccggcagcaggagatcaaagccggactctacctgatgctgttgcagaaacgggaagaaaactccatcgcactggccgccactgccaacaacgccaagatcgtagacgaggccatggcggacaacggtcccgtttctcccaagaccaaaacgatctatatgatagccctcgtcatggggatgggcatccccgtagccatcatctacgtcatggggctgctccagttccggatagaaggacgggccgatgtggaaaagctgacctccgcccccatcatcggagacatccccctggccgaagagggtaa

SEQ ID NO: 1277 - DNA, 789 bp, B.fragilis
atgacaaaaagactactttttttcacgttaacctgtattttgctggcttcctgccagtcctacaagaaagtaccctacttgcaagacccgggagaggcgcaacgtgccgttgcagaggccaagctctatgatgcccgcatcctgccgaaggatctgctcaccatcgttgtatcgtgcagcgatccggaattggcagaaccgttcaacctgaccgtatccacccctgtcagcaatacacaaaaaagcctgaccagccaaccggcccttcagcaatatctggtcgacaaccggggcaacatcgacttccccgtgttgggcaccctccatatcggcggactgaccaagggcgaagcggaaagtctgatcagggaaaagctgaaaggatacatcaaagaaaacaccattgtgacggttcgcatggccaattataaaatttccgtcatcggcgaagtgaacaggccgggcacgtttaccatcagcaacgaaaaggtcaacctcttcgaagcccttgccatggcaggcgacatgaccgtgtacggactgcgcgacaatgtccgcctgatccgcgaggacgccgacggacaccagcacatcatcacgctgaacatgaaccgggcagacatcatccaatcgccctactactatctgcaacagaacgacatcctctatgtcacccccaataagaccaaggcaaagacagccgacatcagcgccagcaccaccatctggttctccgtggtaggcacgctcgtgtcgcttgccagtttaattatcaccatcgccaaataa

SEQ ID NO: 1278 - DNA, 450 bp, B.fragilis
aaatcaaaaggtatgaagaaggtttttgaaagaattatagaaggaatattgacttgtagcggttttgtaacgagtattacgattctgctgattgtgcttttcctttttaccgaggcattcggcctgttcagcagcaaggttattgaagagggatatgtgctggcgctgaacaaagataataaggtaagcgaactgacaccgatgcaaattaaagatgtctttgatgaagagatcaccaactggaaagagttggggggtgaagatctcccgatccggggtgttccgtctggaagacatcacgcactactactcggaagaagaactgggagaagcctacgagaatgcaggggaaaagattatggagctgattcagaaaacacccggtatcgttgcttttattcctcagaagtttgtggtacggccggatgcggtacatttcataaaggataa

SEQ ID NO: 1279 - DNA, 1413 bp, B.fragilis
aagtacagtatgaaacaggtattgcggttcaataaagtcattaaaaggattgtattcaccggagatctcattctcttgaatggcacctttctgtccttgtacaccctattggggagcaaattttttgcagatccattcattcactcacttccccaagtactggtattgctcaacttatgctacctggttagcaacatgtcttcaggtatcatattgcaccgccgtgtagtacgtcccgagcaaatcgtatggcgtgccttacgcaacagtgcgggacacgccttgtttttttcctgcgcgctcacctttggaaacttcggtatcctttccgcccgctttttcttactgttctacattgcgttcactctgctgttggtttgttaccggttattgttccgcaagatcctgaagtcctatcgtaagcatggaggcaactcccgcagcatcattctggtgggaagcaatagcaatataatcgaactctaccatcaaatgacggacgacgtcacttccggattccgtgtcatcggctactttgacgaccagcccggcagccgcttccccgaaaaggtgaactatctgggaaaacccggtaagattgtagaccgcctgaagcagggaggagtcgagcaggtttattgttgcctgccttcggcccgcagcgaagagattctccccatcatcgactattgcgaaaatcacctgatacgctttttcagtgtccccaacgtgcgcagctatctgaagcggcgcatgtacttcgagctcctgggcaacgtgcccgtactctgcatccgccaggagccgctcagttttgccgaaaaccgattcaggaagcgtgtgttcgacatcgctttctcgctcttgtttctttgcaccctcttccccattatctatgtcattgtcgggctgaccatcaaaatcacctcgccgggtcccatcttcttcaagcaaaagcgcagtggagaagacggacgggaattctggtgctacaagttccgctccatgaaggtgaacacgcagagcgacaccctgcaggccaccttgcacgatccccgcaaaacgcgcttcggcaacttcctgcgtaaaagcagcatcgacgaactcccgcagttcatcaacgtactgatgggcgacatgtcggtagtaggcccccgcccccacatgctgaaacacacggaacaatactcacaactgatcaacaaatacatggtccgccatttcgtgaaaccgggtgtcaccggctgggcgcaagtcaccggcttccgcggagagactcacgaactatggcaaatggaaggacgtgtgcaacgcgacatctggtacatcgagcactggaccttcatgctcgatctatatattatatataaaaccgtaagaaatgcgctggaaggagaaaaagaagcttattaa

SEQ ID NO: 1280 - DNA, 597 bp, B.fragilis
attatggtaatagcttatttgagagtaagtacggaaaaacagtttttggctaatcagaaggaagagattatgcgatttgcagagaagaatgggttgtcgattgacaagtggtacacagagaccgtaagcggaagcgtgagcacaaaagacagaaagttatcagagttattgaagagaatgcatcccggggatacactgattgtaacggagatttcgagattgagccgtacactgctcgagattatgactatcctgaatttttgtattaagaagcaggtagtgctctatagcaccaaagagggctatgtgtttcaggacgacatcaacagcaaggtgctgggattcgcgttcggactgatggcggaaatagaaaggaacctgatttcgatgcgtaccaaagaagctctcgcacgcagaaagcaggaaggaatgactttaggccgaaagaaaggagatacgcctaaaataaaattgctgcgtgccaataagcgcgtacttaccaaagaacttgacaaaggaactacttactcggaattggcggagaagatgggggtatccagaacaaccctgttccggtttatgaaaacgatgtattag

SEQ ID NO: 1281 - DNA, 651 bp, B.fragilis
attaaacaaatggaatctgtagccttcattcagtggtgcttagaccacctcaattactggaccattactttattaatgaccattgaaagttctttcattccttttccatccgaagtagtcgttcctccggcagcctacaaagcggcagtcaacgaagagctgaacatctatctggtagtgctcttcgccaccctgggagccaacctcggtgctattatcaattactatctggcccgctggctgggacgtcccatcgtctacaagttcgccaacagccgtttcggacacatgtgcctgatcgatgaagccaaagtgcagcatgccgaagaatatttcgacaagcacggagcactctccactttcatcggtcgcctgattcccgctgtccgccagttgatctccatccctgcaggacttgcccgcatgaagctgcacacgttcctgatctacaccactctgggtgccggattatggaacactatcctcgctgccatcggttattacctttccaccgtacccggcatcgaaagcgaagagcaactgcttgccaaagtaacagaatacagccatgaactgggctactgcttcatcgtcatcggagtcttcatcgtaggtttccttgtctacaaaggaatgaagaaaaagaaatag

SEQ ID NO: 1282 - DNA, 492 bp, B.fragilis
tgtttctcagtgggaggaatgtcgaaaaatgaagggggaagtatgaggaaaatcgatttgattgtgattcattgctcggcaacgagagaagaccggtgttttacggagttcgatctggatgtctgccatcgcaggcggggattcaacgggccgggataccacttctatatccggaaggacgggcggattgtgtctacccgtccggtggagaagatcggggcgcatgccaaggggcacaatgcgacgagtatcggtatctgttatgaaggcgggctggacgcgaggggccgtcccaaggatacccggacggagtggcaggtacattcgatgcgggtgttggtgaaaacgttattgaaacagtatcccggcagccgtgtgtgtggccaccgggatctgagtccggacctgaacgccaatggggagatcgagcccgaggaatggataaagcagtgtccgtgttttaatgtgattgaagataaaaaattacattaa

SEQ ID NO: 1283 - DNA, 858 bp, B.fragilis
aactctggggtactctgtggtgaatcaaactcaaaacttaatcatatgaaaattagaactatcttattcggccgcctctcactcgcagcattgcatgccaacgctcagcgcatcaaaggcagtgacaccgtactgcccgtagcccagcaaaccgccgaacgcttcatgaaccgtgaacccgacgcccgtgtcacagtcaccggaggcggtacaggggtaggcatctccgccctgatggacaacaccactgacatcgccatggcttcacgccccatcaaattcagcgaaaagatgaaagccaaagccgccaaacgggatatagacgaagtgatcgtcgcttacgatgcactggctgtcgttgtacacccgtccgatccggtgaaaaaactcacccgccggcaactggaagacatcttccgcggaaaaataaccaactggaaacaagtgggaggcgacgaccgcaagatcgtggtttactctcgcgagacctcttccggcacctacgagttcttcaaagagagcgtcctcaagaacaagaattatatgagcagcagtctctccatgcccgccaccggagctattatccaatccgtcagccagaccaaaggggcaatcggctatgtagggctcgcttatgtgtcgccgcgcatcaagactctgtccatctcgtatgatggcgagcactatgccaccccgaccgtagagaacgccaccaacaagacttatcccatcgtccgccccctctactactattatgatgcaaagaacaaaacacaaatcgctcccctgctcgagtttattctctctcccgaaggacaggatattataaaaaagagtggatatatacccgtgaaataa

SEQ ID NO: 1284 - DNA, 444 bp, B.fragilis
cttatgatgtttctaatttttaaatattataccattatgaaaacaatgattatttcaattatcgcagtattagcaagtgtggccgtatccggtcaaagtctgacattaacagttaaagacgtggaacatgtggagggaactctttatgtggctatctattcgtccaaagagaactttatgaagaaacctcttttcggttttcgggtggctgtgaaagaccgtacaatgacaataccttgtaaaggaattcctgccgggacctatgccatctccctctttcaggatgaaaacggaaatggaaagttagacaccggttcattcgggcgccctttagagaaatttggattcagcaatgatgccgagggtatcatgggagctccttcgtatgaaaagtgttgtttcgaatttaaacgagatactacggtggtcattcatttaaaatga

SEQ ID NO: 1285 - DNA, 2046 bp, B.fragilis
ctattgatcacaaaaggatgcagttcgtcacacgtgaggtgctgcttatcacatatccgggctgtccgtcccggatatttttttgctttgtgtcaatcctttatgtttgccgatgaaaacgttagcaaacagatcaccatgaaaggattttatgtaccagccgcattgagcctgatgttactctcgctcccgatcgctgcacaaagtgtagctacggataccattctcctggccactttcaatgatagtatatcgttggacgaggtagtaatcaaagcacataagacgccgagggccaacagtcgttggagcgatctgcaacctgtcgatctggtaacagtaggaggttccaacggagatttgtaccgggctttgcaaacacttccgggggctcaactccaaggtgaaagcggtcgtttactggtacgtggagggaacagcaacgaaacacaaacctatatagacggcatgcatgtgttgaatccctatactactaccgggactgatactcctgcacgcgggcgttattctacatttatgttcagtggtgtcaatctggcttccggaggacagtcgcaggagtatggagaggctttgtctgctgttcttcctttggagaccaaagactatagtacggttaataagttcgggatgaatgtttcgactgtcggaatgggtggaggcggtacacgggctttcaatcggtcctcattgtcattgaatctcgattatcagaatctggctccttatgatcgggtttatccttcgcgtacagattttaaacggccgtatcgcatgttatctggtgcgacccaatttcgctacacaccgaatgaaaagatcctttttaaattttatgcgggatatgaccgtacggatttttcgaattacacagatatcgatcgtcatctttttggcctgggtgaaaacaatatatacctcaatacaacattccgcaaacgtacagcttccgattggaattggtttatcggaactgcctactctttttatgatcggaaagtgaaaggagcagtgaaggaccgggatgtatggaacgaacgccaacaagagttccatctgaaagcaaagttctccaagctgtttacttcgcggttgcgtctggatatgggtgtggagacttttgtgcgttcttatcggaacgactatcagttggaaacattgcgtgatacgcatcaaatgtatcccactatctatgccggatttctttcgtctgctttttatctgtcggagaatcttaaaactgaaatatctctccgccccgaatatacttcgttaaaccggacaatgaactggtctccccgggctgctgtcagttatacgtggaatcatctgctggtgtcggtcgtagcagggcaatatacccaacttccggaaaacgactatctgataaggaatatctctttgccttctaatgtttgcagacaagttctttttagtctccaatatgaacagggaggccggttttacaaagcagagttctattataaaaattataagaaactggaattatcggttccggacggtatcactcctgatggatatggatacagtaaaggtattgatctgtatttttgtgacaatgtcctatggaagaattttgagtaccgtttgtcttactcttataacctctcgaaacgtaaatatcgggaatatacagaacttacggtgccacagtatgctacccgtcatcacgcatcgctggtgttgaaatacagtgttccccgattgcgaaccatctttagcgtgaccgatggggtggcaagcgggcgtccctaccacaatccggaactgtccggactgatgaatgatgaagtaaaatcctatcattctctcgatttgggtattacggttctggcgggcaaaaaagtgattgtacatgcttctgccaccaatctgctgggacgtaagaatgaatacgggcgtatcgacggagaggctgtccgtacttcaagcgaccactttttctatctgggagtgtatatcacattgggtaagaaggtagcttatgatgtttctaatttttaa

SEQ ID NO: 1286 - DNA, 1200 bp, B.fragilis
aatgaacattttaaaataaagacgatagttatgatagatttaggaagctggatgaacaaaatccttatcggttggggggtagaccctaaaattgcaaatacttttgatgaaacgattattgccatcctgatgatttttatagcggtcggactggattatctttgtcaggccatttttgtaggcgggatgaagcgtctggcacggaagacctcttataaatgggatacattgatggtcaaacataaagttattcatcacctgatccatatccttcccggtatcctgatgtatatgcttcttcctatggcgttcgtacatggaaaaacgctgctgctggtttcgcagaagatctgtgttatttacatgatttttgctttgttgctggctctcaacagtagtctgttgatgttgttggatatactcagtgctaaggagaagttgaaagatcggccgatgaagggctttatccaggtattgcaggtacttgttttctttatcggaggcattgtgattgtggctatcattgtcgataagtctcctgctacattatttgcgggattaggtgcatccgctgccatcctgatgttggtttttaaagacagtattctgggcttcgtggcaggtatacagttatcggctaatgatatgatacgtcccggtgactgggtgactatcccttcgactaatgccaatgggattgtagaagaaataaccctaaacacggtgaagatacagaatttcgataataccatttctactgtccctccctattcactggtcaacggttcgtttcagaactggcggggaatgacggaatccggagggcgtcgggtgatgaagagtatctttcttgacctgactacattgaaattctgtactcccgaaatgcttgatacttttcggaaggagatacctttgctggccgattatcagccggaggaaggagtgattcccactaactcgcaggtgttcagggtgtatgtagaacgttatctttgcagcctgcccgtggtcaatcaggatcttgacttgattatcagtcaaaaagaagctacggaatatggagtacctattcaaatttacttcttttcccgcaataaaatctggaaagaatacgaacgtatccagtccgatatctttgatcacttttttgcgatgataccgaagtttgaactaaaggtatatcaatattcggattga

SEQ ID NO: 1287 - DNA, 1863 bp, B.fragilis
aatactaaccaatccatttcaccccaaaaacataacaatacatttatgaagaaattaatcttatcgacggcccttcttgccgctatctgcacagccggacaagcccaggagacgaacgactattatgtgaagcacgtagagtttccacaaggagccactctggaacaaaaggtagacatggcggcacgtcttgtacctactccgcagcaattggaatggcagcagatggagttgactgctttcctgcattttggtatcaatacttttacaggacgtgaatggggagacggcaaagaaaatcccgcactcttcaatcccaccgatttcgatgcggagcagtgggtacgttcgctcaaagaagctggtttcaagatggccatcctgacagccaagcatcatgatggattctgcctgtggccgaccaagacaaccgggcactccgtggcggcctctccctggaaagacgggaaaggggatgtggtacgcgagctgcgcgatgcttgtgataaatacggcatcaagtttggtgtttatctttctccttgggatcggaacgcctcttgctatggagactctccaaaatacaatgaattctttatcgaacaactgaccgaactgttgaccaactatggtgaggtgcacgaagtctggttcgacggtgccaatggtgaaggtcctaatggaaagaagcaggaatatgactggactgccatcctttctaccatccgtcgtctccaaccccgtgccgtgactgccattatgggcgatgatgtacgttgggtaggcaacgaacgtggattaggacgtgaaacggaatggagtgccaccgtgctgactcccggtacgtatgcccgctgtgaagagcagaacaaggcgttgggtgtgaaggcgacttccaaggacttgggcggacgcgacatgttggtcaatgccaaggaactcttctggtatccttccgaagtggatgtatcgatccgtccgggatggttctatcatcagcaggaagacaatcaggtgaagagcctcaaacacctgaccgatatttatttcaaatctgtaggctacaactcagtgttgttgctcaatattcctcctgaccagcgcggacgcatcagtgatgccgatgtcaatcgtctgaaagagtttgccgattatcgtaaagagatttttgccgataaccgtgtcaaaggcggcttgaaagcgtggactgcccggccgggtgatacgcgtgtctaccagttgaagccgaaatcggaaatcaatgtggtgatgctgcgcgaagacatttcgaaaggacaacgcatggaggctttcacagtcgaagcgttgactgccgatggatggaaagagatagcgaaaggaactaccgtcggttataaacgcctgatacgtattccggctgtcgaagcccgtcaattgagggtgaaggtcgatgcttgtcgtctggcggctaatatcagcgaagtggctgcttactatgcccgtccgctcgaagagtcggctgcaaaagaaaactggaatgatctgccccgtactgcatggaaacaggtaactgccgctccgttggtgattgatctcggtaaagctgtggatatgaccggatttgtatatgccccggctaatgcggaagcgaagccgacgatggccttccgttataaattctatatcagcactaatggcagagactggaaagaggtgccgactaccggagaattcagtaacatcatgcacaatcctgtaccgcagactgtctcgttcggtaacaaagtcagtgcacgctacattaaacttgatgctaccactccggatactacgccggcccgggtagatttgaaagaaatagggatccgcttgcagaagtaa

SEQ ID NO: 1288 - DNA, 969 bp, B.fragilis
tctccctgtttatcgtatctgtccgatattttatattactttgcagggaaagcgaataaaatacaatatatgggaagtcattggggtgaaaaaatacgaagatacctgcaaagcctttatccggttgcatatcaaagatggaaggttgtgttgatttcttccctggttgtatttctgatattactggttttacagccatttgggatatccggcattaggcagcataagttctggatacttgtgggctttatgggcgtgacggcagtatctctgagtattccgatgtatgtctttggcaaactgtttccgaagttctataaagaagaaacatggactgtgtggaaacagattgtcaatctgttacagatacttttttttatagctatcggtaactggatttattctactctcgtttttggttggggattacgttgggatgtcttttgtgcctttgcattattcactttggtcatcggactttttcctactgtacttttcattttgttgaatcaaaatagactgttggccattcatctgaaagaggctaccgagatgaatctccatctgcaacgttcggtattgctggccgaatctgtggaaacaacacaagacagcccttttcttttgtttcagggaggcatccgggaatccttggaattggactctaaagacttgttgtatgtagaatccaatggaaactacatccgggtaaattatcagaaagcaggtaaaaacgttcagtgtctgttgcgtgcaaccatgaagcaggcagaagaagtaacagccgtttgtccgttggtgctgaagtgtcaccgggccttcttggtcaacgtccgtaaggtggtgaaagtgaatggaaactcccagggatatcgtttgcttctggagggttgcccggaagagatacctgtatcccgaggctattcgaaacaggttaaagaactgatagaaggtatctctggcgactaa

SEQ ID NO: 1289 - DNA, 276 bp, B.fragilis
tcagtacaaaagtctatatttgcacccacaaaattaatagaaatgctctatacaatactgataactctgttaatagttgctatttgccttggtttattaggcataaaagtcttttttacaaagggtggaaaatttcccaacgggcacgtcagcggcaataaagcgttaagggagagaggcataagttgtgcacagtcccaagaccgggaagcacagaagaaacgacgtttttctattgatgaaattgaaaaagccttaaacgatagtatgaactaa

SEQ ID NO: 1290 - DNA, 630 bp, B.fragilis
ttaattaaaaaactatattttacaagtatgaagagaatgaattacctcattaacggatttgctgctcttgcattcctctttcttttttcacaatgcgctggtaaagctgataatgctgctcctgccgcttccggaaatgcgaacggcacttctggtttgaaaatcgcttatgtagaagtagatactttgttgtctcaatataatttctgcaaagacctgaatgctgacatgatcagcaaagaggagaacagccgcatggtgttgaatcagaaagcaaatgaactgcgtaaatctcaacaggaattccagaagaaatatgaaagtaatgcttttatttctcaggaaagagcacaacaggaatatacacgattagctaaattggaacaggatttgcaggctctgcagaacaaactggctacagagatggcatcggagaatgctaaaaacagtcagattctgcgtgactctattaacgcttttctgaaagaatataataaaacaaaaggttataacctgattatcagcaataccagctttgataatctgctgtatgccgatagcacactgaacattactaaagagatcgtagacggacttaacgcaagatatactcctgtggctaagaaataa

SEQ ID NO: 1291 - DNA, 864 bp, B.fragilis
caaataattgaatccatcttattgatatataaatctttattattcatgatgcgaatccgaattatcattacgttgctgattgctttatttgtggagagtcggcaggaagccttcgggcagactgtcgacacactctccctgtccgataaggtaatccgtaccgcttcatttgcgaccggatttcgtggtgaggtatggaggaatccggcactttattattactatactccgtatacatggacaaggttggacgtaaatggagcttatcatgataaaggaaaagcatctttgaaacaggaaggtgataaggatacccatatcggggtggatgttcactctttcgtcattctttcgggacgtgatcgtgtattcggttcagcaggatacaggagtgagaaacaggagaatgtgctatggaacgaaaatatagactggaaactgattgctccttacgtgaccggtgattctattggaggttttttgaaaggagaaacttactatttcaatggaggttacgccagtgagtcgggttcttggacatggggaatcactggtggttatagggcttcccataattatcgggataaagatccgcgtccgcgtaatacagcttccgatctttcttttgctttgggagcaggatatcgtttgggagcgtatcgtttgggagtttctacagatttccggctttatcagcagaaaagtgagatttcgttccttgcggataaaggctctacttcagtataccatatgttgggattgggtatggattatgtgcgttttgccggaaatcagaccggaacgaagcatcaaggtacgtcttcaccacgggggtggatgggatcagcgctatgtactcttgcc

SEQ ID NO: 1292 - DNA, 1071 bp, B.fragilis
acttcaaccgaacagcatttaaaaggaatccaatctatgctccgtctcttcttcatattacttatttccctctcttccctttttctttctgcacagaatcgacctcctttccgtgtcgtcttttggaataccgaaaactttttcgatacccgacatgattcactgaaaaacgatatggaatttctgccccattcaatgcgtcactggaaccaccgacgatataaaaagaaattagataatgtagcccgaacactcacagccatcggagaatggaattttcccgcattgataggtctctgtgaagtggaaaacgatacagttatgcgtgacctgaccctttattccccactgaaagaagccggttatcggtacgtgatgacccactgctccgatctgcgcggcatcgatgtggcattactgtatcaacgtgaccggttcaaacttctatcctactctgccctctccgtcggaaatttcaaaggtcatcgcccgacaagagatattctgcacgtcagcggattactgctcacaggcgatacgctggacataatggtggcacacctcccttcccgctcaggcggagtacgacagtcggaaccttaccggctttacgctgcacaaaagttaaaggatgcggcagatagtcttatcaatgtacgtccctccgccaaactgatcattatgggggactttaacgattatcctacagataaatcagtagtacaagtgctacaggcactgtctcccgaagtgagtacccatcatgaccgactttaccacctgctggcacgaaaggcaaaagaccgtaacttcggttcctataagtatcagggtgaatggggactactggaccatctcatcgtatcaggaacgctacttgatatttcgggcacactctttaccgaagaaaaaaaggcaaacgtagcacgcttgcccttccttctgacaaaagatgaaaagtacggaggcatgcaacccttccgaacctatgtcggaatgaaataccaggaaggatacagcgatcacttaccggtgtatgtcgattttgaaaccaatcaatccgaatattga

SEQ ID NO: 1293 - DNA, 1227 bp, B.fragilis
aacaaaatagaaatgaaaatgaaaaagaatcaattgacaatggcaatcctttttgcgaccatgctgggatttaccgcatgtagtgatgatgacaaagtaaatatatccactgtaagcattaccactactgtagataccactatcgagggcctgcagctgaccggtggaacctatacttttgaaaatataaatacatcggttaagacagacgttgcctatccgctccaaagcattgaattggcagatggattgtataatgtgacttttataggtaaaggtacttattcacaaaatggaacttccgtggaggtcgatgtacagggagtacagcagaatgtgactgtttccggaggatcatgcaagttggaactgacggttcatgtactcaatacaggcgagcccggttttgtgattgccgagatatttattcccggaacctataatgaagctggaaagcaatataatggcgatcagtatgtacgtatctataacaactcggataaagttttgtatgccgatggattgatctttatggaatcacaattccaaactacccaaaaataccagtcggtagatccggatattatgaatgaagccattgcagtaggttctgttgtagcggtgccgggcagtggaacggatcatccggtacaaccgggagaatcttttattctgtgtgacaatgcgatcaatcataaagaggctaatccgaattcaatagatttaagtaaggccaattttgagtggtacatagagtcaaaacaagatgtggataatccggctgttcccaatctggatatttattattgttattccaaaactatttgggtgttgaataaacagggaaatcgtgcttatgctatcggcagattgccccaaggcatgacaaaagaaaagtatatttcagactatgcatacaattatacgtatatcatgcaaaacgggacagccagcaaaccccaaagcaaatataagttccccaatgaatggataattgatgccgtaaacgtgggggcttccaatgaatggcagtggaatgttacttctaccggattggatatgggacatacttatgtcggtgtgaacaatactattgcagaaaacatcggaaaatgcgtaatgcgtaaagtagcctataaggatggtgagcgtgaagtattgcaggatacaaataattctactgttgattttacacctgcagccactccgagcctatttaacaaataa

SEQ ID NO: 1294 - DNA, 345 bp, B.fragilis
gttattagttttatctttgcaactggaattaatgagaaaatcatgggcaaattaatcactatctgggagttcataggcagacataaatactggattaccgtcgtggcattcggtgtcatcatcggatttctggacgaaaacagtatgatccgccgcatcggctacgcacgcgaaatcagccgcttgcagggagagattgataaatatcgcgcagaatacgaagagaatacggagcgcctcaacgaactgagtaccaatcccgaagctatcgaacagatagcgcgcgaaaaatacctgatgaaaaagcccaacgaagacatttacgtatttgacgaggaagaatga

SEQ ID NO: 1295 - DNA, 2820 bp, B.fragilis
atagatacactgttatacctaatttttggtattgcctctgctgcggatatcttatacttttgcgagctaatagaaagtaagatgattcgtaaaattgcatatacatttttttcttttctaatttgctgcaatgtatctcttgcgtggggacagacatttgcattccgaggtactgtattggatgaacagactcataaggcattggattatgccaccattcagttgtttgtggaaaagcaatttgcttatggaggaataacagatgcaaacggacattttgaacttcttcatatccatcctgggacctatcggattatcatatcttatttaggatatgattctaccgagaaagaaattaaggttgtgggaaatacttctgatatattttatttaaagccctcgaacatggcgctgaacgaagtggtagtgactgcttccgaatcaaagcgtgcgaccagtgcttccatagttgatcgtaccgccatgaaacatcttcaacccagcagtttcagtgatttgatggaattggtgcccggaggaaaatcggctgatcctcagatgggacaggctaatctgatccgtatacgtgaaacgggtaagacggaagatatctcttcattgggagtcggattctatattgatggtatctttcagaatacggatgcgaatctgcaatatatgccgagtagcacttctgccgtaaatgcaacgagtacgatgtcaaaaggggtggacatgcgtactatcccgactgataatattgaaaaggtggagatcattcgtggtattccttcggtagcttacggtaacgtggcaaacggtgcggtgattattcagcgtaaaaccagtgaaagtccgttatccgcacgtttcaaagccgataagaccagtaagctgttttctgtaggtaaaggattccggttggatgggaacggacgttatgttttgaataccgatttgagttatctggattcaaagatagatccccgcaatagtgtgaaaaactatacccgcctcacagcttccgcccgtctggatggaaagtggttatggaatgaacgcaatattcactggaatctcagtaccgattataccggttcgtttgatgatgcaaagagggataaagatgcgacagtaaaggaagactcctataaatcagactttagcagcttcaaaatggcgggaaaatggaatctgaaattttcgaatcattcgtggattcgtgagattcatgcggcaacctctgttagttggcagtgggagaagatgcgtgaaacaaaatccgtctctctgaatcgtccggctgccattgccactcagacagagaccggagaatctgacggtatctatctgccttataattatgtggcacagatggagattgacggtaaacctttatatgtcacggtttccgcacgtacacatttggcttttccactgggtggactgcaaaataggatgaatttgggagtggaatggaactaccagaagaatttggggaaaggccaggtatttgatgtgacacgacctatcagtgaaggtttaagtacgcgtccgcgccgttttaaagatataccgggactgcaaccttttgctttctatgccgaagaggtgttgaatcttcccgtaaaaaggcataaattggcttttacagccggtatccgtttgcagtctttattggggctggaccgcaaatatgagatgcagggtaagatctatccagaccttcgtctggatctgcaatggagtttgcctacatccaacggatggaatattgccttttcgggaggtctgggctggatcagccgtatgccgactaccgcacagctgtatccggacttcaagtatgtggatttgattcaattgaattattatcataaccatccggattatcgccgcatcaatatgatgacgtataaatgggataatactaattatcagttggaaccggcacgtaacatgaaatgggaagtgcgggcggatattggttacaagggaaaccgtttgtcggcgacttatttccgcgaacggatgaataatgcttttgatgacctcacatactataaatcattggcatataagttatatgatccggcaagtatcgatggttcggctttgacagcccctcccgaactttctcagttgacttatgccaatgaatacaacctggatgtgtattccacgcaaggaaatggaatgaaggtgcataaagaaggagtggagtttcagttcgcttccagacgaattgaatcgcttaagactcgcgtcacagtgtatggagcttggataaagacagtttatagttcggattctcccaaatacaaggcctcttctatattgctggacaacaaacagttgaaatatgtgggattgtaccagggggagaacgggacagaaagtcaggcattcaatacgaattttatgtttgatacttatatacagcgtttgggacttactttctccacatcggcacaatgtacttggtataccaacagacggaacttatggaataatggcgttccggtcagctatatcgaccaatccggtgaaacacatctatttcgtgaagaagataaaaacaatattcagttacagcatctggtagagaaatattcggctacctattttgagcgtaccaccgtacctttttatatggatatcaatctgaaggcgagtaagcggatcggtaaatatctgaacctggctttttatgtaaaccggcttttaggtatttatcctgattataccctacggggtgtgttgcagcggagaacctccgagtcgccttatttcggtatggagatgaacctgactttttag

SEQ ID NO: 1296 - DNA, 1701 bp, B.fragilis
cagcacacatggatcgtacacatcgcatgtatgaacgttcgaaaaatcatcctgccatcgttatctggtcattgggcaacgaagcccggaaacggaatcaatttcgagcgtacctacgattggctgaaatcggtagagaaaagccgtcccgtccagtacgaacgtgccgagcagaattacaataccgatatctattgtcgaatgtatcgcagtgtcgacgaaatcaaggcctatctggcccagaaagatatctaccgtccgttcattctttgtgaatatgtgcatgccatgggtaacagtgtaggcggcctgaaagagtactgggatgtattcgagaataatccgatggcacagggtggctgtgtgtgggactgggtagaccagtcgttccgtgagatcgactcaaacggtcgctggtactggtcgtatggtggagactacggaccgaagggaattccgagcttcggtaatttctgctgcaacggtctggtgagtgccgatcgtgtgccccatccgcatttactcgaagtgaaaaaaatctatcagaacatcaaatgcaccttgatcaataagaacaatctgaccgtaagggtgaaaaactggttcgacttctctaacctcaacgaatatatcctccactggcaggtggtgggtgacaatggcaaattgctggccgaaggtaacaaagaggtgaactgtgcgccacacgctacagccgatgtgactttgggaaaagttgccttgcctgccaatgtccgtgagggttatcttaatctgagctggacccgcaaagaagcttcaccgatggttggcaccgattgggaggtggcttacgaccaatttgtgttgcccggaaccaaaggtagtacagcctatctgcctgctaaggccgggcagacagctttcacggtggataaagaaaccggtgctctcaactcattgacactggatggacaagaattgctggcaactcctgttacgctgagtttgttccgtcccgctacggataatgataaccgtgatcgtaatggtgcatacctttggcgtaaagccggactcaatcagttgacccagaaagtggtgtcgctgaaagacggcaagaaagccgctactgcgaaagtggagattctgaatgcgaaagggatgaaagtgggtgatgccgatttcgcctattcactaaactctgccggagccttgaagacgaaagtgactttccggcccgatactgccgtggtgaaatcgatggcacgcctggggcttactttcgagatgaatgatacgtatggcaatgtagcttatctgggtcggggcgacaacgagacttattccgaccgtatgcagtcgggcaagatcgctctgtatcagactacggccgaacgtatgtttcattactacgtcactccgcagtctaccgggaaccgtacggatgtccgctggatgaagctgacggacgaaaccggacagggcatctttgtcgattccaaccgtcctttccagttcagtgtcatcccctttgccgatgatgtattggaaaaagcccgccacatcaacgacctcgaacgtaacggtcatgtcaccgtacatctggatgccgaacaggccggtgtgggaacggcaacctgcgggccgggcgtacagccgcaatatcgggttcctgtgacggaacaaagctttgagttcacgctgcgtacagtgaagtaa

SEQ ID NO: 1297 - DNA, 1926 bp, B.fragilis
aacttatttcgcttccttttttatccttgcacttttttgcgtacatttgcacaaactcaaaaaatagagattatccggaatatggaaaactatatcgtatccgcccgtaaataccgcccttccacttttgagtcggttgtgggacaacgggcactgaccactacactgaaaaatgctatcgccactcagaaactggcgcatgcttacctgttctgcgggccgcgcggagtgggtaaaacgacttgtgcacgtatctttgccaagaccattaactgtatgaaccttacggcagatggcgaagcctgtaatgaatgtgagtcgtgtgtcgctttcaacgagcaacggtcgtacaatattcacgagctggatgcggcgtccaataactcggtagacgatatccgtcagttggtggagcaagtacgcattccgccccagattggcaaatataaagtatatatcattgacgaggtacacatgttgtcagcttcggcattcaatgcttttctgaaaacacttgaagagcctccccgccacgccatatttattcttgcaacaacggagaaacataagattcttcctaccatcttgtcgcgttgtcagatttacgactttaaccgtatcagcgtagatgatactgtgaaccatttgacttacgtagcgtctaaagaaggaatcacggcggagcctgaagccttgaacgtgattgcgctcaaagcggatgggggtatgcgtgacgctctctctatctttgatcaggtggttagtttcaccggaggaaatatcacctacaagagtgtgattgagaatctcaatgtattggattacgagtattacttccgtttgacagactgttttcttgagaataaagtgagcgatgccttgttgctttttaacgatgtgctcaacaagggattcgacggaagtcactttattaccggactttcatctcatttccgcgacttgctggttagtaaagatgccgccacgctccagttgcttgaggtaggtgccggtattcgtcaacgctatcaggaacaagcgcagaagtgtgcgttacctttcttgtaccgggccatgaagctttgcaatgattgtgacatgaattatcgtgccagcaaaaacaagcgtttgctggtggaactgactttgatacaagttgcgcagcttaccgtcgagggggatgatggtagtggtgggcgtggccctaaacaagctataaaacccgttttcacgcaacccgccgctgctcagcagcctcaggtagcacctattgcttcaccatctcagagtatgaatgctgctacacctgttgctccgcaggctgtgtctcaacaggttggtagttccccggctgtcaatgtacgtccgggtggagcaatttctccatcgggtgctatgcccgatgcggtacggatggctcaatttaaagaggaaaagaagattcctgtcatgaaaaagtccagccttggactttccatcaagcatccgcaaaaggaggaagaacagcggggagcgggtgttgtccatactgctcagatgtcgacgcagcagatcgaagaagattttatttttaacgaacgggatctgaattattattggcaggagtatgccggacgtatgccgatcgaacaaaaggcgatagccatgcgtatgcagaatatgcgtttgtcattgctcaacgacacgacttttgaggtagtggtagataatgaaatcgttgcgaaagatttcacggctctgattcccggtatacaagcttacttgcgtggttcgctgaagaatcgtaaggtgacaatgactgtccgcgtcagtgaagcaaccgaaaatgtacgtgctgtcagtcgtgtggaaaagtttcagatgatggctcaaaagaataatgcattgttgcagttgaaggaagaatttgggttggaactctactaa

SEQ ID NO: 1298 - DNA, 1479 bp, B.fragilis
aaagaaaagagaatggaaaaatcagaactgaaaccggccggtgtatttcacttcttcaatgaaatctgccaggtgccccgtccttcaaagaaggaagagaagatgatcgcctatttaaaggcgttcggagaaaaacataatttagaaaccaaagtagacgaagccggcaacgtgcttatcaaaaaaccggcaacaccgggtaaagaaaatctgaagacagtgattctgcaatcgcacgtagacatggtgtgcgaaaagaataatgatacggaccatgacttcctgaccgatcccatcgaaacggagattgacggagagtggatgaaagccaaaggaacaaccttgggagccgacaacggcatcggagtagcgaccgaactggccattctggctgacgacagtattgaacacggtcctatcgaatgtctgttcactgtagatgaagagacaggactgaccggtgctttcgccttgaaagaaggctttatgagcggagaaattctgcttaatctcgactcggaagacgaaggtgaactttacatcggttgtgcgggcggtattgatacagtggccgaatttcaatatgaaaatgaaatgacacccatcagccacctctgcttccgcataaccgttaaaggtctgaaaggcggacactccggaggggatatacatctgggacgcggtaatgccaacaagatactgaaccggtttctctatcagatgatgactacttaccaggaggacttccacctctatgaattcaacggaggtaatctgcgtaacgccattccgcgtgaagcttcggctgtattctccgtgcccgaacattacaaacatgacatacgtacagccttgaacgtattcaccgccgaaatcgaaaacgaacttcatcgggtggaaccggatctgaacattcttcttgaaacagagccgcaccgcgactggtccatcgactcgagtacttcctatcggctgattacttcgctatacggttgcccgcacggagtatatgccatgagtcaagatattccgggactggtagaaacttcaacgaacctggcatctgtaaaaatgaagccggaaaacaccatccgtatcgaaaccagccagcgcagttctatcctttcttctcgcgacgatatagcaacaacggtccgtgccgtattcagactcgccggtgctcaggtcaactggggtgaaggttatccaggatggaaacccaatccggattcggaaatcctaaaagtggcggaagagtcatataaacgcctgttcggtgttgatgccaaagtaaaggcaatccatgcaggactggaatgtggcttgttcctcgacaaatatcctgccctggatatgatttcattcggccccaccttgacaggagttcactctccggacgaacggatgcatattccttcggtagataaattctggaaacatctgctggatgtgttggcacatattccggctaagaactaa

SEQ ID NO: 1299 - DNA, 669 bp, B.fragilis
acactagtaggtatgaaattctttattgatacagctaacctggatcaaatccgggaagcacatgatttgggagttctggacggagtgaccaccaacccttctctgatggcgaaagaaggcattaaaggtgtcgaaaatcagcgaagacattacgtggagatatgcaatattgtacaaggtgatgtcagtgccgaggtgattgcaactgattacgaaggaatggtcagggaaggtaaggaactggcagccctcaatccgcatattgtggtgaaggtaccgtgcattgccgatggcataaaagccatcaagcacttttcggggaaaggcatccgtaccaattgcacattggttttctccactggtcaggctttactggctgctaaagcgggagctacgtatgtttctcctttcgtgggacgtttggatgacatctgtgaggatggagtcggattggttgccaatatcgttcggatgtaccgcttctacaattatcctactcaggtgctggccgcctctatccgtagttccaagcacatcatggaatgtgtggaggccggtgccgatgtagcaacttgtccgttgagtgccattaaaggactgatgaaccacccgttgacagatgccggattgaagaaattcctggaagattataagaaggtaaatgaatga

SEQ ID NO: 1300 - DNA, 999 bp, B.fragilis
tcaaaaaatataatcgatatgaaagcaatttgtaataaagggatttgtgtatttctttttttgtcgttactgatgtcggcaactatggtaaatgcacagagagtgatcacagcgagtggtaagtatataacaaagaatatcaaagtgacccggtttgatcagatttatttgaaaggaagtcccacgattgaatatacgcagtccccgggagcatccgaagtacaaattgcaggatcggataatttggtcgatttggtggagtgccgtgtagaaggaagtacgttgatagtgaatatgaagtcacgtaccaatatttcttatggtaaagagggacgactgaaaatcttggtttccagtccgatgctgaagagcgcttctttgcaaggttctggcgatatccatttaggaagtctgaaagtggaagggctggatgtatcattgatcggttcaggtgatattgttgcggaaaatataacttgcaacggtgatttttctgccctgttgcaaggttcgggtgacattgacgtgaaggggcagcttcgtgctaaaagtgtgaatctgaatttgcaaggctccggtgatttgaaagtagcaggtgttaccggaagcgaaatcagtgcgatgcttcagggatcgggtgacttgaaagtcggaagtactaatatcacatcgactgtaacggcaaagttgagtggctcgggtgatatggatgtattggatattcgtgccaatagcgtatccggacagttggatggctcaggagacatgactttgtcgggttctgcttgtaatgccacgttggttttgaacaggtcgggagaactcagtgcgcgaaaactggatgctgaaaatgtaacggctcatgtcaatggatcaggggaaatctcctgtacagccacgaagacacttgaaaccaatatccaaggtagtggagaaatttcttataaaggaaatccgagtatacggtcgacaggtaagaatcatctgaacagactctaa

SEQ ID NO: 1301 - DNA, 1509 bp, B.fragilis
  unsure (12),(13),(14): Identity of nucleotide sequences at the above locations are unknown.
ttgacggtcttnnnatggagcggctccttccagccccgtggtgaagactatgaacagtcaccctattatctcaacctcaacggtaaatggaaattccattgggtgaaaaatcctgatctccgtccgaaagacttttataaaccctcattctataccggaggctgggcagatatcaacgttccgggaaactgggagcgccagggatacggaactgccatctacgtaaatgagacttatgaatttgatgacaaaatgttcaactttaagaagaatccccctcttgtgccttataaggagaacgaagtaggatcttatcgccgtactttcactgtgcctgccggatggaagggccgccgggtagtactctgctgcgaaggtgtaatttctttttattatgtgtgggtgaacggacattttctcggttacaaccaaggttccaagacagctgccgaatgggatatcaccgatcagttggaagaaggtgagaatacgattgccctcgaagtatatcgctggagttcaggttcctatctggagtgtcaggatatgtggcgtctgagtggtattgagcgtgatgtgtatctgtatagtactcccaaacagtatatagccgattataaggtaaacgcaactcttgaaaaggaacgttataaagatggtattttcggactcgacgttacggtcggagggcctgcagacggtgtggcatccgtatcttatacactgaacgatccactcggacgtcctgtactgtcgggtgagatgcctgtcaagtcgcgcggactgagtaacttcatcacattcggagaacagcgcctgaaggatgtgaaacgttggaatgccgagcatcccaatctctacaccctcgtgttggagttgaaaaatgcaggaggacaggtgaccgaagtcaccggttgtgaagtcggtttccgtacttcggagatcaaagacgggcgtttctgcatcaacggtgtgcctgtattggtcaaaggaaccaatcgtcatgaacattcgcagttggggcgtaccgtcagcaaagagctcatggagcaagatatacgtctgatgaaactgtataatatcaatactgtgcgcaactcacattatcccactgatccgtattggtatcggctgtgcgatcgttacggactttatatgatcgatgaagcgaatatcgagtcacacggtatgggatatggacccgcttcgcttgccaaagacagcacttggctgacagcacacatggatcgtacacatcgcatgtatgaacgttcgaaaaatcatcctgccatcgttatctggtcattgggcaacgaagcccggaaacggaatcaatttcgagcgtacctacgattggctgaaatcggtagagaaaagccgtcccgtccagtacgaacgtgccgagcagaattacaataccgatatctattgtcgaatgtatcgcagtgtcgacgaaatcaaggcctatctggcccagaaagatatctaccgtccgttcattctttgtga

SEQ ID NO: 1302 - DNA, 354 bp, B.fragilis
cgaggaagaatgaaacaactgatacccgcacttttcgccgtaggcgcagtaatggccctcataggggccgctgtctttatcaccggatgggtctatgcaccttatatatataccatcggggcaggttttgtcgcattggctcaggtgaatactccgcttcgggctaaaagcaagacgctccgccgactgcgtatccagcagatcttcggtgcattagcactgatattgacaggagcttttatgttcaccacacgtggcaatgaatggattgcctgccttactatcgcagccatactggaattatacacggcattccgtattccgcaggaagaagaaaaagaactttccaaatag

SEQ ID NO: 1303 - DNA, 1068 bp, B.fragilis
  unsure (231): Identity of nucleotide sequences at the above locations are unknown.
gccttcaggacctggtggccatttatacgaatgaagcgggagagcgtattgtttcaggcagcccgcaaacaccacttaaacttactttttccattgtttcgggcaaataccagtgcaagttatccggtaagcaggtttatatcgaggcctatcacagtcctttctaaaggatttgcaaaaggtttcttttgcattaaaaaagaaaccgtggataagattcagcaatttttnttcgataagtgggccattgaggaaaggagataccaccagctcctttccattctgttgcccggtctgaaaaacggcaacctagcgtcggtggaacaatatctgggggccaagcatatagaggcctatgccgccgtcccctatgtagccgaccgatgggaactggatgacgcctccctccctcaaggagcggtagtggtgcttacctgtgaaggcgtgctgtatagctgggagacctaccggctggagagatatatttccgccgcgatagccaacgaccgcatatcgggtgtcgttctgtttgtgaacgggcccggaggtatgattacgcgtgtggatgtcctggaaaagcttatacggcagtcccccaaacccatagtggcctatatcacgggcgtatgcgcttcggcgcatttctggttcgtttccgcatgcgcacgcagattcgtctcctcgcccatggatgaaatcggctcctgcggggtggtctacactttccagagcttcaaggagtattacgcgcaaatggggattgagatcgaggacatttaccccgacagtgcggacctgaagaaccgcgcctatcgcgacaaggaagaaaagcaggatgacaccttaattaaagagaacctgtcgttttaccaccatctttttgcacagaccatcgcccgaaatctgggagtgaagtatgacgcgcaggatcccctgttcagagggcagactttctttgccgatacggcactggccaaggggtatgtggatgcctacggaagcctggaggatgccatcctgtgggtatccgcccagaaaaccgtaaagcgggctaacaagatgatttaa

SEQ ID NO: 1304 - DNA, 474 bp, B.fragilis
cggaaaaatgcggagtatttgaaaatcaataagttatacaatatgaaaacaataaaaagaccctatacccccgtttgtgatctggagttggttccggtggagtgtatcagtgattttgcagtcatcctgccgcgcgcttttattgccgtgcgggatggttcttatcgcattcctgttattccgggatcattcactcccggagtcgaatccgagcaggcggattcaggaactatatattataatgtagggcatacgttcgaggttgccttgacaggaccggacagccaggagttgttatctgccatgagccttcaggacctggtggccatttatacgaatgaagcgggagagcgtattgtttcaggcagcccgcaaacaccacttaaacttactttttccattgtttcgggcaaataccagtgcaagttatccggtaagcaggtttatatcgaggcctatcacagtcctttctaa

SEQ ID NO: 1305 - DNA, 825 bp, B.fragilis
  unsure (752): Identity of nucleotide sequences at the above locations are unknown.
caagatgatttaatactcactataaaagtaaatttgtttatgaaaaattatttcgcatcattcattccggccgtaaaggccattctgggtatcgaggcctggagtaaggacgccgacaagaaagacgcgttactggaagagcaaaagcagaaacttaaggcattgaatttcaatgacacctttatcaatggtttttgtgaggccctgaaggatggattcccggaggattcttcccgcaaggacggggagtcgggcacgaaaggcagtggtcctgaccccaatacctccaacgcagtaatacaaggattactggctgatatgactgccaagctggttacggcccaggaggaaatcgctgtgcttaccaaagagaaaggggaactttcacaggaggtatccgccaaacaaacagaaatcaccggtttgcagaccaagattcagaccctttccggccttgcggagcaagacggggggaaaggcttccagcatgcacgtctggaaccggacgctaaagacattgtcatgaattgggatgacgaaaaacaactgggcggcctctcgggggagatgttcgcaatgggaccgccttataaccagcgcctgcgcgcaaagatgctttaccgcaaggggttgacccgtcaggtgcccactgccagttcgatcgattactcccgcctgaaagaagacctgggagccttctaccgcatcccctggcaggagcgtttacagtctttcctgaccctgcttccttncatcgagagtattttccccgctgaattcgggatatcaggacctgggcgtgcttacaaacatttgggttggtga

SEQ ID NO: 1306 - DNA, 507 bp, B.fragilis
aaaaaacatcaacttatgataaccacgaaaataacagtagagccgcacctggctcaatattgctacgccaaatattcttccgatccggaaggcagcatgcccgtccgctttgcggaccatctggatgtataccatctggtttataacctgctggaaaaacgcccggttaactgtccccgggataatggcaatcttgagatcgtcttgccggaccgcaggcagggtgacgtccccggtggcaaatccccggagcgtttcaactatctgggccagcgcagccagggtatcatcaataagaagctaaagctgatgatgcgcgccgagctccatgactttattgacgagaacaagcaccggttcggtatcgaccagcttcagtcagtccactgctttatgaagaagtactgcattgacagcttaagcgaggatgctcttctgaaagactaccaacgttggcgtgaccgggtaagacgttccagccttaagcggccctacaagaaaaagtag

SEQ ID NO: 1307 - DNA, 618 bp, B.fragilis
aaaaagatggaagtagaactagtaaaaaccaccctgcatgcggttctgagcccgtctcagttacagaaaccctgtgtccgaaagaaggagctgacgcctctccagatctcgttaaaaactggatcgacggcctctcaattggtggatgaatggggcgggacaattgcccaactgaacatgggcgccccactttacgatgtcgccgcaaacggagaaatccctacattggctgatgtgggtgtggtcttcggtaattcgacatccgttcggattatcacaagccatctggaatccgttctgaagtacgccggcgttgaattgagccgcgagcagatggcggaaaccgcgctggcgatactttcaggatactggttcctgaacctggccgagctctgcattttctttacccgccttaagaacggaagttgtgggcagcttgtctggggaaagagcctaaacaatcaggcggtcatggtcgccctatcggatttctgcaaggaacgccgtgaagtgatcattcgcaaagagacagagcggatgggcccggggctgtggaaaaaggcttttccagaacggaggattttgccgccggtattgtgttgggcgtacagggtatag

SEQ ID NO: 1308 - DNA, 882 bp, B.fragilis
aagtcccgtagaaatcttccaaggctttgcgtccggcttcgaactccatacctaatttgcctgctgtgtaatatctatcgagataaagggtattacatcgagtgggatgaagatttgccttttgtggtggctgacaccattggtaccaccgagggcgcagtagaggaagtagtaaagaaagccgtgcaagtgggattcttcgacaagtcattgttcgaccaatacaggatccttacctcaaacggtattcaaaaccgcttcaaaagcgccgtttccagacgtgaaggatttgagtatattcccgaatatctggtttctgtatgcaataaccccattcaatcgaatttctgtatacagaaaccctcctcaaccgagtttctgtatgcagaaacccagcccaaccgagtttctgcatgcaaaagtacacaaagtaaagtaaaggaaagaatatctccccctcctcacgcgcgtgaaggaggcatttccggaatcagacttttttcagacaagtctttaaccgagtgttacggggagctgaaagcgaatatcccctggatggagcaattctgcatgaacatccgtctggattatccggattttaccccggagctgttttatggctttctggacaggttcttccgtaaactccagaatgaaggggaaatagtcaagtcacccaaggacgccatgtcgcattttgcaaactggttgaatattgaacttgaaaaattaaaaaaagatggaagtagaactagtaaaaaccaccctgcatgcggttctgagcccgtctcagttacagaaaccctgtgtccgaaagaaggagctgacgcctctccagatctcgttaaaaactggatcgacggcctctcaattggtggatga

SEQ ID NO: 1309 - DNA, 807 bp, B.fragilis
aaaaacaatataccaatgatagtagcatggttttcttgcggtgtaacatccgcagtcgcttgtaagattgcacttagtctatacgatgacgtgcagctctattatattgaaactggctccgggcatccggacaacgctcgttttctatctgattgtgaaagatggtacgatcagcctattcacattatccgaagcgacaaatacacttgcgtagctgatgtcctacggaaaggttttatcaatggtgcgcatggtgctgcttgcactcttgaacttaaaaagaaagtccggtacaagttggaaaaggaacttggttcttgggacggtcaagtttggggattcgattatgaaccaaaagagattaaccgagctatccgattaaagcagcagtacccagacacaaagccactgttcccgcttattgaaaagcagattacgaagccggatgccatggggatactttggaaagcagggattgaaatccctgctatgtacaagatgggctacaataacaacaactgcatcggttgcgtgaaaggtggtatgggatactggaataaaatccggaaggatttcccggaagtgtttgctcaaatggcgcagattgagcgtgatgttggagctacctgtctgaaagataaagatgggcgtatcttcttggatgaactaccgacatggcggggcgatccagtggaagagattataccggattgctcgcttatctgccaaattgaatttcaagagatcatcgacaggcaggtaaaacgagttttgaaaggagaaattagtattaacgatgtagcttga

SEQ ID NO: 1310 - DNA, 189 bp, B.fragilis
accatgaaagtcgtcatctattggcagaagaaatccaccgtccaccatcgccgccggatccgtgacagattcaggcttcccgatggtatgaccattaacggtgaaactcccgccgatgtgaggccggaggatatgaaggaactacagaccctggaagaaatgggttatattaaattaagaaacaagtaa

SEQ ID NO: 1311 - DNA, 348 bp, B.fragilis
agtgatcattcgcaaagagacagagcggatgggcccggggctgtggaaaaaggcttttccagaacggaggattttgccgccggtattgtgttgggcgtacagggtatagccgtgaaacgtgaacgggccaaggccgactttaatgcttttttggagtttttcccctgtctgccatcaggatatgacccgatagccttatggaaggcctggggcggtgatccggatgccatcaacttactcttcggcaacaatcctcccggagtggaagcggcggcggaatctgtcggcagatacctgtgtgattacaatgtctatcaggcccgtgtaaaggccaaagcctccttgtaa

SEQ ID NO: 1312 - DNA, 192 bp, B.fragilis
gaaacgagttcacatttcaacactttttcaggagattcgaccgtacgtccacatccccagaacaataacacccaaaccggacaaaataacaacaagcctttcagtctcttcctgtctaataaattaaaagaagcgctcataatcaacattctgttcttttaccatcacattccacccaccgagtctctgtaa

SEQ ID NO: 1313 - DNA, 243 bp, B.fragilis
ataaaacaatcaattaaagtattttatcaccaagcaaccacttatttaaataaaatcacagactgtaataacagctttccagcttattttccttgtatatctccattatttcacatacctttgtctaaaattaaggtattaaaacatccggatgttatatatcaaaacacccggatgttttatatcagaacatccggatgttatctattaaaacatccggatgttttcagacataacttatag

SEQ ID NO: 1314 - DNA, 195 bp, B.fragilis
cagtttttaccctgtttaaagcttaattttcccccgtcactgtctaaaaaatgccgtaaacttgcatcatcgaaaaacaacgaatattcacaatttaaaaagcaacgttatgaaaagtttaagcttcagaaaagatttaattggagttcaggaagagctacttcgctttgcatacaaactaacaaccgaccgtga

SEQ ID NO: 1315 - DNA, 1467 bp, B.fragilis
gtctataatacgaaagggaataaaataggattttatatggcaacaacagattttatcgccgctattgaactgggttcatcgaagatagccggtatagccggaaagaagaatagtgatggaagtatacaggtattagcttatgccagggaggattcgtcttctttcatccggaaaggagtgatctataatctggataaaacggcacaaagcctgacttcaatcatcaataaactggagggggctctcaataactcaattgccaagatctatgtgggtatcggcggacaatcgctccgtacggtgcgcaatgtggtaagtcgtgatcttgaagaagaaaccattatttctcaggaactggtcgactcaatctgtgatgagaacctcgagataccactgatcgatatggatatactggacgttgctccacaagaatacaaaataggaaacaatcttcaagccgaccctgtcggtgtagccggaagccacattgaagggcgttttctgaatattgtagcacgtgcttcgctcaagaaaaatctggaacgctgcttcgaacaggctaaaatagaaatagcagacctattgatctcacctctggttactgccgatgcagtactgacggaaagtgaaagacgctccggctgcgcactgatcgactttggtgccgacacatctaccatttccatttataagaataatatcctccgcttcctcactgtgctgccgttaggaggaaacagtattacccatgacctcgtctctcttcagatggaagaagaagaggccgaacgcctgaaaatcagatatggcaatgctttctacgaagaggaagaaggcgaagaacctgctacttgccaattggaagacggaaatagaacgatagagttaggtaaactgaataatatcatcgaggcacgtaccgaagagattatcgcgaacgtatggaatcagattcaactttcgggatatgacgacaaacttctggccggactcatcatcaccggaggggccgccaacctgaaagacctggacgaggttctacgtaaacggagtaaaatagagaaggtgagaaacgcacgtttcgtacgcaataccatccatgcagacgaagacgttgtgaagaaagacggtacacaaaacaccttattcggactgcttattgcgggcaacgaaaactgttgtttattggaaacacccgctccacagccgcatatacaacctcagccccagcccgaaccggtgaacatgtttgaagaagacgaaagtctgaaggaacaggaagccgctgcccgcgctgccaagaagaagaaagaagaagaagagaaaaagcggaaagaagaagaaaagcaacgcaagctggaagagaagaaaagaagggaagaagagagaagaaataaacctaactggtttaaatcgactttcgacaagctctctaatgaaattttttctgacgaagatatgaaataa

SEQ ID NO: 1316 - DNA, 1470 bp, B.fragilis
aaacattgcacacctggctttaccggattctgctgtcgttattgcaaaagaagttataaaattagcgcaacaatcatgaatatagaaacgattcaatctgtatattttgtcggggcaggcggtatcggaatgagtgccctcgtccgctattttctttctaaaggaaaagtagtggcaggctatgaccgtactcccagtgaactgactcaacatcttatagaagaaggagcacagatccattacgaagagaatatcgatctcataccggaggcttgcaaagacaaagctaccacattggtagtcctgacccctgccgtacctcaggaacatgccgaattaacttacttccgtgataatggattcgaaatacagaaacgtgcacaagtactgggcaccattacccgttccagcaaaggactttgtgtagccggcacacatggtaaaaccactacctcaacgatgacagcccacttgtttcatcaatcacatgtaggttgtactgcttttctgggaggtatttccaaaaattacggaacgaatctactactctcttcaaccagcccttatacggtgattgaagcagacgaatttgaccgttcattccattggttgtctccttatatgtctgtcattaccgcaaccgatccggatcatctggatatttatggcaccgaacaggcttatctggaaagctttgaacactacaccacactgattcagcccggaggagcactgattatccgcaaaggcatttccctacagccgaaagtgaaagaaggagtgaagatgtatacttactcacgtgacgagggagactttcatgctgagaacattcgcatcggaaacggagaaatcttcattgacttcgtagggcctgacattcgtatcgacaacattcagctaggagtaccggtaagtataaatatagagaatggtgtcgctgcgatggcacttgcccaccttaacggagtcacacctgaagagatcaaacagggaatggccagtttccggggtgtggaccgccggttcgactttaaaatcaagaataaccggattgtattcctgagtgactacgcacatcatccatccgagattaaacaaagcgtgatgtccatgcgtgagttgtaccgggacaaaaagatcactgcggtttttcagccacacctctatacccgtacccgcgacttctacaaagattttgccgacagtctgtctttactcgatgaagtgatactggtagatatctatccggcgcgcgagcaacctattccgggagtaagcagccggctgatatatgacaacctacgtccgggtattgaaaaaagcatgtgcaagaaagaagaaatactcgatgtactgaaagcaaaacatatcgaagtattaattacattgggagcaggagacatagacaactatgttccgggtatttgtgacttattgtcccgaagaatggttccttcggacaattaa

SEQ ID NO: 1317 - DNA, 765 bp, B.fragilis
atcgtcaaaacaataaatttccttatgataaaaagaattcttctgaccatcgtcatgttacttctcatagcctaccttgtagcagctgtgacagtgttcaacgacaaacctgcccatcaggtatgccgtgacatggaattagtgatcaaggatacactcaatgccggtttcgttaccaagaacgaggtggctgccatcctgcagaagaaaggcatttatcccgttggaaagaaaatggaccgggtacacaccaaaacattagaaaaagagttggataaacatccactcatcaatgaagctcaatgctataaaacgccaaacggcaaaatttgtgtggaagtaacccaacgcgtaccgattctccacatcatgagcagcaacggtgaaaactactatttggataacaaaggaaaaatgatgccgcccgatgcaaaatgcgtagcacaccgggcaattgtcaccggaaatgtagaaaagtcgtttgcaatgaaggatttatataagtttggtgtatttttgcaaaacaatccgttttgggaagcccagattgtacagattaacgtgctgcccggaaaagaaatcgaattggttccccgggtaggcaatcatattatctatttgggtaaactggaacattttgaggataaactgaaacgcttgaagaccttttacgaaaaagggctcaaccaggtgggatggaataaatattcgcgtatcagcctggaatttggaaatcagattatctgcacaaaaaagaaacaataa

SEQ ID NO: 1318 - DNA, 2010 bp, B.fragilis
ctcagatattttcactatatttgctctgttattataattaggaatcaaattatgagcgaagaacagaatcccaccaataacgggtcttattcagcagatagtatccaagtattggaaggacttgaagcagttagaaaacgccctgcgatgtacattggtgacatcagcgtaaagggacttcatcacttggtatatgaaattgtcgacaactctatcgacgaagcattggccggttattgcgaccatatcgaagtaactatcaacgaagacaactctatcaccgtacaggataatggacgtggtattccggtagatttccacgaaaaagagcagaaatctgccctcgaagttgccatgaccgtactgcatgccggaggtaagttcgataaaggttcgtacaaagtatccggaggtcttcacggtgtaggtatgtcctgtgtgaatgcattgtctacacacatgactacccaggtattccgcaacggtaaaatctatcagcaggaatatgaaatcggtaaaccgctttatcccgttaaagaagtaggaatagcggaccacacaggaaccaaacagcaattctggcccgatgacagtatctttaccgaaaccatttatgattataagattctggcttcacgtttacgtgaattggcttatctgaatgccggtctgcgcatctcgctgacagatcgtcgcgtagtgaatgaggacggcagtttcaaacacgaaactttctattcggaagagggtttaagagaatttgtacgcttcatcgaatcgtcacgcgaacacttgattaacgatgtgatttatctaaacacagagaaacaaaacatccccatcgaggtggctatcatgtacaataccggattttcagaaaatatccattcgtacgtcaataacattaatactatagaaggtggtacgcatctggcaggtttccgccgcgccctgacccgtacactgaagaaatatgcagaagacagcaaaatgctggagaaagttaaagtagaaatctccggcgatgacttccgtgaaggtctgacagctgtgatctctgtaaaagtagctgaaccccaatttgaaggacagactaaaactaagttgggaaacaacgaagtaatgggtgctgtcgatcaagcggtaggcgaagtactaaactattatctggaagaacacccgaaagaggctaaagcaattgtagacaaagtgattttggctgctactgcacgccacgccgcccgcaaagcgcgtgagatggtacagcgtaaatctcctatgtcaggtggcggtcttccgggtaaactggccgactgctcggacaaagacccgcagaagtgtgagttattcctcgtcgagggagactctgccggcggtacagctaagcaaggtcgtaaccgtgcatttcaggctattcttccactacgcggtaagattctgaacgtagagaaagccatgtatcacaaagcgcttgaaagcgaagaaatacgcaatatatacacggcactgggtgtcactatcggaacggaagaagacagcaaagctgccaatattgataagctgcgctatcataaaatcattatcatgaccgatgccgacgtcgatggatcacacatcgacacactgatcatgacttttttcttccgctatatgccacagatcatccagaatggctatctgtacattgccactcccccgctctacctttgcaaaaaaggaaaaatagaagagtattgctggacagatgcgcaacgccagaagtttatcgacacttatggtggcggttcggaaaatgcaatccatacacagcgctacaaaggtttgggtgagatgaatgcccagcagttgtgggaaacgactatggatccggaaaaccgtatgctgaaacaggttaatatcgacaacgcagcagaagccgactatatcttctccatgttgatgggtgaagacgtaggtccacgccgcgagttcattgaagagaatgcaacgtatgcaaatatcgatgcataa

SEQ ID NO: 1319 - DNA, 1308 bp, B.fragilis
aaacttaaagcagtggatctattaaagaatatattcaaaggtgataaggtaatctggattattttcctttgcctctgcctcatctctatcatagaggtgtttagtgctgccagtacgctgacttataaaagtggcgaccactggggacccatcacacaacattccatcatcctgatggtaggtgcggtcgtagtggtcctgatgcacaacatcccttataagtggtttcaggtgtttccggttttcctctaccctatttcggtagtattgctggctttcgtaactttgatgggagtcatcacaggtgaccgtgtgaacggagccgcccgctggatgagttttatggggttacagttccagccttcagaactggccaagatggcagtaatcatcgcggtttctttcattctatccaaaaagcaggatgatgaaggggccaatccgaaagcttttaagtatatcatgatactgaccggactggtatgtatgcttatcgctcctgaaaacctttcgacagctatgctgttgttcggagtagtagtattgatgatgttcatcggacgtgttgcattcaagaagttagccatgttattgggcggtctggcattggttggctgtctgggagcagtatttttgctggccataccgaaggataccgacatcccgttcctccaccggtttgacacttggaaaagtcgtattaccaactttacggagaaagaagaagttccggcagccaaattcgatattgacaaagatgcccagatagctcatgcacgcattgccatcgctaccagtaacgtgataggtaaggcaccgggaaattccattcagcgtgacttcctgagccaggcattctccgatttcatctttgccattatcattgaagagttggggctggtaggaggcgcctttgtagtcatactctacatctggctattggtccggacaggccgaatcgcccaaaagtgcgaacgtacattcccggcattcctcgtcatgggtattgccttgatgttggtatcacaagccatattgaacatgatggtagccgtcggactgtttcctgtaacaggacaacctttaccgctaatcagtaaaggaggtacaagtacactgatcaactgtgcctacatcggcatgatactgagtgtcagccgctataccgcttatctggaagagaaaaaagaaaatcctgctcctctgctcacccagagtgaaggaaatgaggcgattgcaagcgaggcacagactgcggccgaacctacagcagaggttttaaacagtgatgctaaatttgaagagtaa

SEQ ID NO: 1320 - DNA, 408 bp, B.fragilis
aaaaggttggcacgcgtacgtggcattgattttatccatgactccaaagcacccaatgtaaactcttgctggtatgccttgcagagtatgactactaaaacggtattgattctcggaggaaaagacaagggaaacgattatacggaaatagaagaactggtacgggagaaatgctcggcactggtctacctgggattgcacaacgaaaagcttcatgagtttttcgaccgtctcggactccctgtagccgaagtacagaccggcatgaaggatgccgtagaagcagcttacaagctggcgaaaaagggagaaacagtattgttgagtccatgttgcgcctcctttgaccttttcaagagctatgaagaccgtggcgaacagtttaagaagtatgtaagagaattataa

SEQ ID NO: 1321 - DNA, 201 bp, B.fragilis
gttggccatttacatcaacaagcttgcttaagaaataagatatataacagactctatataatattagaagccggacttttcagttcggctttttatgctttcaattacccggtcgggtttatttttaattcttcttttttcactcttcattcttctctaactcagatattttcactatatttgctctgttattataattag

SEQ ID NO: 1322 - DNA, 546 bp, B.fragilis
cagtggagttatcacattttaattaaagtaaaatatcgaatcattaacccggatttaccaattgtaaaccgtaaatcgttaaatcataataacatcatggatttattcgaaagagtcagcgaagacattaaaaacgcaatgaaagcgaaagataaagtagctctcgaaactctcagaaatgtaaaaaagttctttttggaagctaaaacagctccgggagctaatgacacccttacagatgcagatgcactgaaaatcgtgcaaaaactggtaaaacaaggtaaggatgccgcagaaatatatataggacaaggtcgtcaggacttagctgatgcagaattggctcaggtgcaagttatggaaacttatctgcctaagcagatgagtgccgaagaattggaagccgcactgaaagaaattattgctgaagtaggtgctaccagcggcaaagacatgggaaaagtaatgggagtcgcttctaaaaaactggcaggattggccgaaggacgcgcgatctcagctaaagtaaaagagttattgggataa

SEQ ID NO: 1323 - DNA, 204 bp, B.fragilis
cgaacgtcctacacaagatacttcaaggctatgtgtcagtcggttgtgaacaaaaatactgcccggaaggggaaaaacttgggttttgttctgaagccttctgaaaggggcggagaagacaaggcggtcatagtcccgctgaaactccgaacggttttcctgacgctcttcgtgaaactcttccatgccgaaacgcttagctga

SEQ ID NO: 1324 - DNA, 1032 bp, B.fragilis
gatagaaatctgggcgaaagaacgtgcggagaaactctttatggaacccgaagcattcggagcagccttggaagagattatgaaagaagaacggagaacaacgaacaacgagctaaaatgaaagaagaagaaacaacatatcacgtaccggtactgctaaaagaaagtgtagatgccatgaacatatctcccgacgggacttacgtagatgtcacctttggcggtggcggacattcccgcgagatactttcacggctcggagacggaggacgcctgctaggattcgaccaggacgaagatgccgagcgcaacattgtaaatgatccgcattttacttttgtacgaagcaactttcgttacctgcacaattttctacgttatcacgatatcggagaggtagacgctatattggctgatctcggcgtctcttcccaccactttgacgacagcgaacggggattctctttccgctttgacgggaaactggacatgcgcatgaacaaacgtgcaggcattacggctgccgatgtggtaaatacatatgaggaggaacgccttgccgacattttctacttgtatggcgaactgaagaacagccgcaaactggcatccgtcattgtgaaggcacgtaccggacagaaaatagaaacgatcggtgagtttcttgaaatcataaagcctctcttcggccgcgaaagagagaaaaaagagttagctaaagtttttcaggcactccgcattgaagtgaaccaggagatggaagccctgaaagagatgctgatggccgcgacagaagcattaaagcccggaggacgactggtggtaatcacttaccactcactggaagaccgcatggtgaaaaacatcatgaaaaccggcaatgtagaaggcaaggccacacaggacttttttggcaatttacagacacctttccgcctggtaaacaataaagtgatcgtacccgacgaggatgagataacacgcaatccccggtcgcgcagtgccaagttgagaatagccgagaagaagtaa

SEQ ID NO: 1325 - DNA, 543 bp, B.fragilis
agccagaatcttataatcataaatggtttcggtaaagatactgtcatcgggccagaattgctgtttggttcctgtgtggtccgctattcctacttctttaacgggataaagcggtttaccgatttcatattcctgctgatagattttaccgttgcggaatacctgggtagtcatgtgtgtagacaatgcattcacacaggacatacctacaccgtgaagacctccggatactttgtacgaacctttatcgaacttacctccggcatgcagtacggtcatggcaacttcgagggcagatttctgctctttttcgtggaaatctaccggaataccacgtccattatcctgtacggtgatagagttgtcttcgttgatagttacttcgatatggtcgcaataaccggccaatgcttcgtcgatagagttgtcgacaatttcatataccaagtgatgaagtccctttacgctgatgtcaccaatgtacatcgcagggcgttttctaactgcttcaagtccttccaatacttggatactatctgctga

SEQ ID NO: 1326 - DNA, 1329 bp, B.fragilis
ttcataatacaatataatatggacgagatagtacaattcgatttccctacagattcaccgaaaatcatcaaagtgattggtgtaggaggtggtggaggtaacgccgtcaaccacatgtaccgggaaggcatacacgacgtaacattcgttctctgcaataccgacaaccaagcattggctgagtctcccgtaccggtcaaactgcaactgggacgttccatcacacaaggactcggtgccggaaaccgtccggagcgtgcacgtgatgctgccgaagagagcatcgaagacatcaaaactctgctgaacgatggtaccaaaatggtgtttatcactgccggaatgggtggaggaaccggaaccggagccgctcccgtcatcgcccgtatcgctaaagagatggacatcctgactgtcggaatcgttaccatccctttcatttttgaaggcgaaaagaaaattattcaggctctggacggtgtagaacgcatcgcacaacacgtagatgctttgctggtaatcaacaacgaacgcctgcgtgaaatctactccgacctgacttttatgaatgcattcggcaaggcagatgatacgctatcaatcgcagccaagagcatagccgaaattatcaccatgcgaggtacggtcaacctggactttgcagatgtgaaaacgattctcaaggacggcggtgtagccatcatgagtaccggattcggcgaaggagaaaaccgtgtgaccaaagcaatagacgatgcactgcattcacctctgctcaataataatgatattttcaacgccaagaaggtaatgctgaacgtctccttctgtcctgcttccgaattgatgatggaagaaatgaacgaagtacacgagttcatgagcaaattccgcgaaggtgtggaagtgatctggggtgtagctatggacaactcactggatacgaaagtaaagatcaccgtattggctaccggtttcggtgtagaagacgtaccgggcatggacgacctgcacgaaaaacgcagtcaggaagaagaagagcgacagttgcaactggaagaagagaaggagaagaacaaagagcgcatccgcaaagcatacggtgaaagtgccagtggaatcggaacacgcaatctgcgtaaacgccggcatatctatctcttcaatgcagaagacctggataacgatgacatcatcgccatggtagaggactctcctacttacttacgcgacaaaacaactttgggtaaaatcaaagcaaaagccgcactggaagaagagatagcaacagaagaggctatagatgacagtggagttatcacattttaa

SEQ ID NO: 1327 - DNA, 516 bp, B.fragilis
aagtttattaaaatgaaaacaaaaaattatttgtcaataatcagtatcttatttttttcttttctgttcgtgtcatgctctaaagaagacgaaggtgatacgataaaacccgtcattgatctgctggaacctgaagaaggcgctatattaaggatcggaagttctcatggagtacattttgagatgaatcttcacgataatgaagcgattgcttcctataagattaatattcacaacaactttgacggtcattcgcataccagggcatcggaagcgggagtaaccaagccttttacatttgaaaggacctatacggataaggccggacagaaagatgcacacgtacataaccatgatattaaaataccggctgacgccactccgggaaactatcacctgatggtttactgtttagatcagtcgggcaatgaaacttatgtagtacgtaatattgtgttaagcgtggaaggaggtgaagagggagaacatcaccatgatgaacatcatcatgattaa

SEQ ID NO: 1328 - DNA, 987 bp, B.fragilis
  unsure (928),(942): Identity of nucleotide sequences at the above locations are unknown.
agattagataacagaagtgacgagcaacaggctatgagctacaagtgcctgccgctaatcacaaagtatgaacctaaaacttgtagcataaagaaaaagatctatcgacggatcgacaaattccggttgataaatcgaaacctaaaaatcatgaaaagaattgtagtattaggagccggtgaaagcggtgcgggagcagccgttctggccaaagtaaaaggattcgatactttcgtatcggatatgtctgctatcaaggataagtataaaactctccttgacggccatggcattgcctgggaagaaggccgacacacagaagaacagattttgaatgctgacgaagttgtgaaaagccccggaattcctaatgacgccccactgattctgaaattgagagaacagggcacacctatcatctcggaaatagaatttgccggcagatacaccgatgccaaaatgatctgtatcaccggctcgaacggaaagacgaccacaacctcgcttatctatcacatttttaaaagcgcaggactaaatgtgggacttgccggaaacatcggtaaaagcctggcattgcaagtggccgaagagaaacatgattattatgtaatcgaattgagttcattccagttggataacatgtataacttccgtgccgatatcgctgtattgatgaacattacgccggaccatctggaccggtacgaccattgtatgcagaactatattaatgcaaagtttcgtattacgcagaatcagacttcggaagacgcgtttatcttctggaacgatgaccctatcatcaaacgtgaactggacaaacatggcattcgtgcccacctgtatccattcctcggcatcaaagaagaaagatctatcgcctatgtggaagaccatgaagtagtaattaccgacccgatcgctntcaatatggaacangaacaagtggccctgaccggccaacacaatcttattactctttag

SEQ ID NO: 1329 - DNA, 1359 bp, B.fragilis
ataatgtgcaaataccaaattgtaaagatcatgatggactggaaaagattgatttcagctaagcgtttcggcatggaagagtttcacgaagagcgtcaggaaaaccgttcggagtttcagcgggactatgaccgccttgtcttctccgcccctttcagaaggcttcagaacaaaacccaagtttttccccttccgggcagtatttttgttcacaaccgactgacacatagccttgaagtatcttgtgtaggacgttcgttaggcaacgatgtatcgaaagcgatcctcgcccgacagcccgaactgcaagactctttcctgcccgagatcggttccatcgtctctgccgcctgtctggcgcacgacctgggtaaccctcctttcggtcactccggtgaaaaggccatttctaccttcttttcagaaggaaaaggagttcagctccaagagaagctctcaccgatggaatggaatgatttgacacattttgaggggaacgcaaatgcattccgattgttgacacaccaattcgaaggacgtcggaaaggtggatttgtcctgacttattcaaccttggcctctatcgtaaaatatcctttttcatcaagcctcgcaggaaataagtccaaattcggattcttcaccaccgaagaagagggatttcgccgtatcgcaacggaactgggtcttattcagctcagcgaccgccctttaaaatacgcacgccacccgttggtctatctggtagaagctgccgatgacatctgttaccagatgatggatatcgaggatgcccataaattgaaaatcctcactacagaagaaaccaaagaactgttgttagcttatttcgcagatgaacgccagacacatatccgaaaaacgttcgatattgtcaaagacacgaacgaacagatcgcttacctccgctcatcagttatcgggttgttgataaaggagtgcactcaggtatttttaaataacgaaaccgaaatactttcaggaacttttgaaggggctctgatcaagcatatatcagaacgtccgggaaaagcatacaagcattgttcggaggtatctttcagcaagatttaccgttcacgggatgtattggacattgagctggcggggttcagggttatcaatacactccttgaattgatgatcgatgccgtcacttcgccggagaaggcttactcacagctgctcattaaccgcgtatcgggacaatataatataaaagcgcctgcactctacgagagagtacaggcggtgctcgattatatttcgggcatgaccgatgtctttgccctggatctttatcgcaaaatcaacgggaacagtcttcctgcggtgtaa

SEQ ID NO: 1330 - DNA, 186 bp, B.fragilis
tttcaaaaaaagccctacctttgcactcgcaatcgggaaacaacgatacagaacgaaagcaaagtgaaacaaaaagagcagaaatgctcaaaacaggatggcccgttcgtctatcggttaggacgcaagattttcattcttgaaaggggggttcgattcccccacgggctacaattaaaaaaataa

SEQ ID NO: 1331 - DNA, 627 bp, B.fragilis
atgaaaaaaaagtaccttgtaattgttttattgttcttggtggctaatacttgctatatttatcatcagcatgtaggcttaaagaaagtgcattcgtttctttctgaactgagacaagatacaggagaacggttgggcatattagaaatgcaaaaagaggatagagtgtatgaaatacagttcaatggtcaattaattgataaagaactgactgttattgatactgatggcaaacagaaaaaaataggtgatttaataatagacaatcccaaattagtatttaggttttccgaacttaattgtgataaatgtattgatgctcaaatacgtaatttgaatgagtatgttgattcaatagaacttcaaaatattattttattaacagatttccaaagtcttgaatatatgcgtagctttcagaaatcaaataaagtgaaatttgctatttataacatggaggcggagatcgattctgttttggtgaatattgatttaccttatttttttgttttgactcctcaagaagaacggattcaatgtatgtatattcctcataaagaaataccttttttgacagaggtatacttatcttctgtcaagaggaagttttttactgatttggaataa

SEQ ID NO: 1332 - DNA, 423 bp, B.fragilis
ggttggtgtttatattacgaattatgcatcgatatttgcatacgttgcattctcttcaatgaactcgcggcgtggacctacgtcttcacccatcaacatggagaagatatagtcggcttctgctgcgttgtcgatattaacctgtttcagcatacggttttccggatccatagtcgtttcccacaactgctgggcattcatctcacccaaacctttgtagcgctgtgtatggattgcattttccgaaccgccaccataagtgtcgataaacttctggcgttgcgcatctgtccagcaatactcttctatttttccttttttgcaaaggtagagcgggggagtggcaatgtacagatagccattctggatgatctgtggcatatagcggaagaaaaaagtcatgatcagtgtgtcgatgtgtga

SEQ ID NO: 1333 - DNA, 342 bp, B.fragilis
atgggtgtgaagagaaatactagacataggatttggcttgcatggatgttactgatgacatttatgcccttgtctgtcgtgaaggtttttcataatcattccgaagaaacttcgataacctgtacagacgcacattccggaaagtcccatcacacatgtgagacttgtcccatctgtcagtttatgctttctccatttattgagaccccttctactcttctgacttatacgcccctttacgtaaaatgggagagtggaacttttcaggataaaaagctttctatcgctttctatccgcattatcttcgcggacctcctcctgttttttatcatatcgtttaa

SEQ ID NO: 1334 - DNA, 2643 bp, B.fragilis
cacaccgtcgatccttccagccccgtggtgaagactcacaatctttcgttggaagaggtagctgtatatgcctaccggaataaagccgggaaagccaattgggaggtaacccgtgcgtcggccgatacgataccggccgatactgcatcgaccgattttaatagtgagattgatatccggaatatagaactcaaacatgccaatcttgttttcgatgatcggaatacggatatttactcacgcatcgatgatgccaatctgaagttgaggctttcgctgacaaagggtatttctactttagggttgaaatttgacaacaagaatattcttttctggcagcagggagaactgttggtcaataagatagctacttctttacggacagatattatggtggacaggcagaccgccgtctggaaactgaaggatacggaactcgatgtgaatggtatccggttggatgtaaacggagctttccggcgggataccgtggcgaagacaatcggtatggatctggaatatggtttgcatgccccttcgatggagacggtgttgcggatgattccgaaatcgtatgtgaaggacactaaagtctcggctaaaggtgaagttaccgttagcggtagggtgaggggtgtgtatggtgacaaaaagttgcctgccgtttcactcaagatcggtatcaaagaggcttcggcacaatataagggtttaccatacggtattgatgaggtaacggcagattttgatgcgtatgtcgacttgatgcgtcatcagccttcgtatctaaacctgaaaatattccattttaaaggggcgcatactgaagttttggccgatgcgaaggtagacgatttgctggatgatccgttgattactttccataccaagtcgactgtcgacctggatgcactggctaaaacctttccattgcaggaaagcgtgacaatcacgggaaaactggatgcggatatggggatgaagtgccgcctttctgctttgaagaagcaggatatcgggcgcatgaagttgggaggcaaacttgaattgaaagattttgaattgaaggatactgccaaggatttcgattttctaggtaatgctactttccgtttccgtgataacgaaaccttgcaggcgcagatggatgtccgtaaactggtgttgagaagccgttttctctcttctgacatcgaacggttggttgccaatgtttcttcgactaatccgcaggataccaaccgcattgtctctttgcagtgcgatatggaggtcagtaagctccgtgcttcgatgggcgattctataaagttatacagtgcccgtgcaaaagcacaagctgcactggggcctcagggggtggatgtaacgaagccggcgattgatttttcacttcgtgccgattcgcttttcttcagtgcggcaggaactcgcatggctatgaatgtggcgggcatcaagatgaaggctgataagctgaatgactccctgtggatgcctaaagggattgttgggttcaatcgcttacgcttccgtacgccggaattcggcttgcctattcgcatgtcaaaaacagcggtgacggtggatggcccgaagattactttaaagaatgcttctgtccgtatcggacgctccaatatgacggctacaggcgatatgatgggtgtttacagggcaatgacgaaaggagagaagttgacggcacatttgtctcttacgtctgatctgatcgattgtaatcagttgattaattctctttctttccccgaggatactacggaagtgcttaccgacagcgtaccttcggagatgaaattgtttgtgattccccgaaatatagattttgaattgcaaacagatctgaagaaggtcatttttgagaaaatgctgtttgagaatgtacatggagcggtagatattaagaatcaggccatacatctggaagatctttcaatgcgtgccctcgatgccgatatgaaggctgtgatggtctataaggccggtagtccccgcggcggatatgccggttttgattttaagatccgaaacatcaatattgcgaagctggtcgactttgttcctgcactcgatacgatagtgcctatgcttcgttctttcaagggccgggttatgtttgatgttgctgccgatgcccgtttggattcggcaatgaatatccgtatccccactttgcgttcggccattcacatcaaaggagacagcctggtcctgatggatggtgaaacctttgctgagatctcaaagatgttgatgtttaagaataaaaaagagaatgtattcgatagtatctctgtcaatgtgacggtacacgacggtaatgtgaccgtctatcctttcctggtagagatagaccgttataaagctgctgttggaggtgagcaaggattagatatgaactttaactatcacatctccatcttgaagtctccgttgccgtttaaagcgggagtgaatatttcgggcaatctggacaaaatgaagttccgtataggtaaggccaaatataaggatgcggttacccctgctgcggtacatcgggtggatagtacccgcatgaatatgggcaatgagattgttaatcgtttccgacgagtagtattgggacgacaacctcgataa

SEQ ID NO: 1335 - DNA, 654 bp, B.fragilis
aaacagagcctgaattacaattggacgttatttatgcgcttccaggtgagatctatacttctttttgtgttactcctgattatatttttgcaacaaactatagcaatgaacgtattgagaaattggctttacctgtttccgattagtcttttaatgatacttctgtttagctgtaatcagataaaagagtatgatgccaaagagcgaacgagcagaaacacaagagttcaacatttgattgaaaaagatattacgtggctggtaggaaagaaattaaatagtgtcgattctattttgcctaatgaattattgcatgaaaaagttttgttcttgtttaattatcatgactgcggtacttgtattaagacgggatttgctgttgtcaatagtatagacaggcagaagggtaaggaatatgtaaaggtgattggttcgatgatttcagatttaacatctgtgcagcgtttcaatgagtatcatggatatatttatgtagacacaaaggatttaataagaagagaactcaaatatgctcccactccaatgctattgcgtgtagatactgataatcggattcttgaagcattgattccaactaccgaaatggataatcagactatcaaaatgtttattgcatcctgtctgaaaagatag

SEQ ID NO: 1336 - DNA, 1044 bp, B.fragilis
cagattaaggaacaactactaacaaagtatatggaagaagttattgaaccggtaagcaaggagctgattatagctgagttgactgaagacaagcggttgcgtatgaccaataagagtaataatcagatatacattattacttatcaggactctcctaatattatgcgggagatcgggcgtctgcgtgagattgcctttcgggctgcaggaggtggtacggggctgtcaatggatatcgatgagtatgatacgatggagaatccgtataaacaattgattgtatggaatcctgaggcagaagaaattttaggaggctatcggtatattctggggacggatgtgcgttttgacgagcatggtgctccggttcttgctacttcgcacatgttcaatttttcggatagatttgtgaaggaattcctgcctaccactattgaactcgggcgttcgttcgttacattggaatatcagtcaacccgtgccgggagcaaggggctatttgctttggataatctgtgggacggattgggggcattgacggttgtgatgccaaatgtaaaatatttctttggtaaagtaacgatgtatcccagttaccaccgtcagggaagagacatgatcctttacttcctgaagaagcattttggagataaagacggacttatcactccgatgaaaccgctggaaatggagacggatgaggctgaactggcaaggattttctgcaaagattcatttaaggatgactaccggatacttaacggtgagatccgtaaactcggttttaatattccaccgttagtgaatgcttatatgagtctcagtccgaccatgcgtatgtttggtacggctatcaattacggttttggagatgtagaagagaccggtatcctgattgccgttgacgaaatccttgaagagaaacggatgcgtcatatcgaatcgttcgtgaaaaacgatccggaagattgccagataacttccggggtgaataaggttttcacaccgaaagtcgttacaccgcaggaagactgttcccgttga

SEQ ID NO: 1337 - DNA, 1461 bp, B.fragilis
ggtatgaaactaaaagagattctaacatctatccaaccggtgaaaattaccggaaatcaggatatcgagataaccggggttgacatcgactccagacaggtagagtccggtcatctgtttatggccatgcgcggcacacagaccgacggacatgcctacattccggcagcggttgaaaaaggtgccacggccattctttgtgaagagttacctgcagaacttgtagaaggagttacctacattcaggttgccgacagcgaagatgccgtaggaaaagcagctacgactttctacggaaatccgagctcaaaattggaactggtaggcgttaccggaacaaacggaaagacaacgattgccaccttattatataatacgttccgatacttcggctataaagtgggattaatctccacggtatgcaattatatagatgatgaagccattcctaccgaacataccactcccgacccgatcacattgaatcgtttattgggacgcatggcggacgaaggttgcaaatatgttttcatggaggtcagttcacactccatcgcacaaaaaagaatcagcggactgaaatttgccggcggcatcttcaccaacctgacacgcgatcatctggactatcataaaacagtagagaactacctgaaagcaaagaagaagttcttcgacgatatgcctaagaactctttcagtctgaccaacctggacgataaaaacggactggtgatgacacagaacaccaagtcgaaagtatatacttactctctccgcagtctgagcgacttcaaaggaagagtactggaatctcatttcgaggggatgcttctcgactttaacaaccatgaactcgcagttcagtttatcggaaaatttaatgcatcaaacttactggctgtatttggtgctgccgtattgctgggcaagaaagaagaggacgtgctggttgctctcagtacgctgcatccggttgccggacgcttcgatgccatccgttctccacaaggatatacagccattgtagactatgcacacacaccggatgccctggtcaatgtcttgaacgccatacatggagtactcgaaggaaaaggcaaggtaattaccgtagtaggtgcaggcggtaaccgcgataaagggaaacgccctatcatggcaaaagaagcagcccgggcaagcgaccgggtcatcataacttcggataatccccgtttcgaagagccgcaggatatcatcaacgacatgctggcaggactggataccgaggataagaaaaaaacgctaagcatcgcagaccgtaaagaagctattcgcacggcttgtatgcttgcagaaaaaggagatgtgattctggttgccggaaaagggcacgagaattatcaggacatcaaaggagtgaagcatcactttgatgataaagaagttttaaaagagattttttcattgactgtttaa

SEQ ID NO: 1338 - DNA, 249 bp, B.fragilis
aaaccgtcatgcaattggcatcacttctattataaagccggaaaaagaaagggtgtaaaacaacgcctctttaagcgggccccgatacacgaccatttccgtacttcgatgagtctggtagagccgggatgcagcgtaaagtttacgaagcccgatcagttgttccacgaatcaaaaatcacagtccgcttctggattgtaaccatcgtgctggcagctattacgattataacgctgaagattagataa

SEQ ID NO: 1339 - DNA, 1788 bp, B.fragilis
atgttcggtcgaatcaataattgtagtaaaatgaaaataaataaattgcttttcggaatgctgctgcttctgttggcttcctgcggttcatcccgcaaggtggagaaacaatcggagcaagttgccgttcaggaaataaatctcactccggagcagcaacgtaaatatgactatttctttcttgaagcatcgcgcctgaaagtgaaaaaggagtatacggctgctttcgacctgttgcagcattgcctggccatcaatccgaccggttcggcagctctatacgagattgcccagtattatcttttccttaaacaagtgccgcaaggacaagaggcattggagaaagcagtcgcttatgcccctgataattattggtatagtcaggcattggccggtctgtaccaacagcaggatcagaaagaaaaagcgataggaatactcgaaaagatggcaacgcgttttcccgctaaacaagatccgttgttcaacctgctcgatttatataatcagaaggaagactatggtaaagttatttctaccctaaaccgtatagaggaaaaaacgggaaagaatgagcagatcaccatggagaagtttcgtatctatctgcaaatgaaggacaacaaaaaggcttttgaagaaatagagagcctggtcaatgagtatccgatggactaccgctatcaggtgattctgggagatgtctatatgcagaatggcaagaagcaggaagcttatgatacttataagaaagtacttgccgcagaaccggacaatccgatggcattgttttcattggcttcgtattacgagcagaccggacagaaagaactgtttgaacaacagatggatactttgctactgaaccggaaagttccttcggatacaaaggtgaatgtgatgaggcagtttatcgtccagagcgaacaggagggaaaagacagtacacaggttatcggactctttgaccggatgatgcagatggatatggatgatgtgcaaattccgatgctttatgcacagtatctgctatccaaaggaatggaggcacagtctattccggtattggagcaagtagtacagatagatcctaccaataaagcagcacgcatgactttattaggttccgccatccggaagaatgattatgagcaggtgattaagatctgtgagccggggattgaggcaactccggatgccttggagttttatttttatctggttattgcatataatcaggccgaacattgggacgatgtactggaagtcagccggaaagcactagaacatgtcactccggagagtgacaagcaaatggtctccgatttctatacaattataggtgatgtatatcataccaagaagttgatgaaggaggcatatgtagcgtatgattcagctttggtttacaacccgtccaatataggtgcactaaataattatgcttattatttatcggtagagcgcagagatctcgataaggcagaggagatgagctataaaaccgtaaaagccgcaccgaacaatgctacttatctggatacttatgcctggattctttttgagaagggaaactatgctgaggcccgtatctatattgacgatgccatcaagaataccaaaccggaagaagagagcagcgtggtgtttgaacattgcggggatatctattttatgaccggtgacgtagaaggtgctttgaaatattggaagaaagcactggaactgggcactgaatcgaaaacacttaaacagaaaatagaaaaaaagaaatacattgcagaatga

SEQ ID NO: 1340 - DNA, 1170 bp, B.fragilis
acagtgatgctaaatttgaagagtaatatgaataaagaaaataataaagaaggacagggtgatgccttaagagtcatcatcagcggtggtggtaccggagggcatatctttccggccgtatccattgcaaacgccataaaagagttacgtcccgatgcacaaatcctgtttgtaggagccgaaggcagaatggaaatgcaacgagtaccggatgcaggctatcagattatcggattgcctgtagcaggattcgatcgtaaacatctgtggaaaaatgtcgccgtattattaaaattggtacgcagccaatggaaagcacgaaatattatccggcaattccgccctcaggtagcagtaggagtaggcggatatgcaagcggtcctactttaaaaatggcgggaatgatgggagtacctactttaatacaagagcagaattcatacgccggagtcaccaataaactattggcacagaaagcacgaagaatttgtgtggcgtatgacggaatggagaaattctttcctgccaataaaatcattatgacaggtaacccggtacgtcagaatctgctggcggaaaaaccggaacgtgaacaggcaattcgttctttcgggctgaatccggaaaagaagaccattctgattttgggtggaagcctgggggcacgcaccatcaataacacattgattgcgggactgcaactgattcgccggactacagacgtgcagttcatctggcaaacgggaaaaatttatcatcaacaagtgacagaagctgtaaaagcagcgggagagatactcaatctgtttgtaacggacttcatcaaagatatggctgccgcttatgctgctgccgacctggttatttcacgtgccggtgcagggtctatttccgagttctgcctgctgaataagcccgttatcctggttccgtctcctaatgtggcagaagaccatcagaccaaaaatgctttggctttggtaaataaacaagcagccatctacgtaaaggatgcggaagcagaaaacaaactattaccggtagcactggaaacgatcgccaatgccgagaagctgagcgaactcagtgaaaacattgcacacctggctttaccggattctgctgtcgttattgcaaaagaagttataaaattagcgcaacaatcatga

SEQ ID NO: 1341 - DNA, 621 bp, B.fragilis
acagaaaatagaaaaaaagaaatacattgcagaatgaaaggaagtaagttgaaacaaactgtcattaaacagtcgtacctgctgcctttgctacttatggtagttctgcttgcaggttgtaaaacatcaaaggtggtcaagactacaccggtagaaccggcttatctgtcatctaaactgcaactgacagtgcccaacaaaaacggcagtatgaccgtaagcggcagcatgaagatgaaaagcggtgaacggatccagttatctgtcctgatgccggtattccgctcggaagtaatgcgtatggaagttaccccggatgaggtgttactgattgaccgtatgaataaacgttatgtgcgggcaacccgtgatgagctaaagggaatactgcccgagaatgctgattttgaccggttggagaaacttttgttcaaagcttcacttccgggtgagaaaaaggagctcacaggacgtgaattgggaattccatctctggaaaaggcaaaggtgagactatctgatttctcgactgccgaattcgaattaatacctactgaggtatcgtccagatacactcaagtagcattggaggatctgctaaaaatgctgatccaactatga

SEQ ID NO: 1342 - DNA, 453 bp, B.fragilis
atagtaaacagactgaatatgaacatacaagtaatcaataaatcgaagcacccgcttcccgcatacgcgaccgaactttctgcaggaatggatatccgcgctaatatttccgaacctatctctttggctcccatgcaacgatgcctggttcctacaggactgttcatagctctgccacagggatttgaagcgcaaattcgtcctcggagcggactggctttgaagaaagggattactgtactgaattctcccggtaccatcgatgcagattaccgtggtgagatttgcatcatcctggtaaatctttcggccgagacgtttgtcatagaagatggggagcgtattgcacagatggtcattgcgcgccacgaacaagctgtatggaaagaagttgaggtactggacgaaacggaacgcggcgcgggtggtttcggacataccggaagaggatag

SEQ ID NO: 1343 - DNA, 2172 bp, B.fragilis
gacgatttaagtatgcgtatcggatttttttcgggtatgctgggagggttatgtttaatctctaccttgcatgctcaagagcccgattcactgaaagccgtgtccttatctgaagtggtggtgacggagagttatcagcatctgaagaataagaactccacatggcgtatggaggtggtagggaaagagtttctgcgtgaacacttcacagggaacttgatacaaactcttggaacacttccgggagtacattccatggatatcggttcgggcttttctaaacctatgattcgcggaatgggattcaaccggatttcggttgtagaaaatgggattaagcaggagggacaacaatggggagccgatcatggactcgagctggatgcatttaatgccggtcaggtaagtattcgcaaaggtcctgcttccttattgtatggtagtgatgcaatgggaggggctattgaacttgttccattaccattgcctgcgggtaaccggttattcggtgaagcgagcttgttggggaaatccgtcaacggtacattgggaggttcactgatgcttgggatcaaaaaagatgcctggtatacctgggcaaggtattcggaacaacactttggggattatcgtattccgacggatactattgtctacctcacccaacgtatgcctgtttatcaccgaaggcttaaaaatacagccggttttgagagagatgtcagttgggctgccggatttagaaaagaacggtatgtctcttcttattgggtgagtaatgtttttcagaaaacagggttctttcccggtgcacatggcattcccgatgtgtcgcgtttgcaggatgacggggacagccgtaacatagaacttccgtacagccaggtgaatcacttgaaagtttctacccggcagagccttttgtacgataaatgggcgctgacgtgggatattggctttcagaagaatcatcgcgaggagtggagccggtttcatactcattatgatgctcagcctgtaccggacaaagatccggataaggaactggcttttacgttgaacacttatagttctgctgttaagctgaagttgtttgcttctgccgtatggcaacacacggcaggatgggatgtacaatatcagaggaatacgattgccggttattcatttcttttgcctgcttaccggagatttaccacaggggctttctggatgaccacttatcgtccgggacccactctgtccttcagtggaggacttcgctatgattacggaaagatagatgcatccgcttatactgatccttacttggcaatatatctgcgggagcagggttatggtgatgaatttatccggaagtatgaatggcgtagttaccccgttcgtcgccattttggcgattattccggttcactggggttggtatggagtccttccggaggtcatcttcttcaggtaaatgtcggccatagcttccggttgccgggagccaatgaattggcatcgaacggagttcatcacggcactttccggcatgaacagggagatgcagcgcttgcttccgaacgcggttggcagtttgatgcttcatatacctatgaaaatgggccgttgtcggtaagtttgtcaccatttgtcagctggttcagcaattatatttttcttcggcctaccggagaatggtcgatactgccccatgccggacagatttaccggtacaccggtgcggaagccctgtttgcgggcggtgaggctgcagtgggcattgacttcctccgacactttaactatcgtgtcagtggagaatatgtctatacttataattgcgatgaacatattcctctaagtttctcgcctcctgcttcactccgcaatacactgacgtggcgatataaagagttcagcatctatggtgaggtacagcatattgccgcacaacaccgggtggcacgaaatgaagatcccactcccggagcgcagttgttgaatgccggagtatctgccaacctccggatagggggtatatgggccgaggtgactttatcagcccggaatttatccggtgccaaatactttaatcatcttagtttttaccggaaagtagaaatccccgaaccgggacggaactttcagattttaattaaagtaccatttaaaagtttattaaaatga

SEQ ID NO: 1344 - DNA, 357 bp, B.fragilis
aacaagagaagtgaaatggaagataaagaagcaaaaaagaagaaaagcaactccctgaaaagtattctgggaggtgatattctggctaccgacttttttcgccgccagactaaattgctggtactgattatggtgctcatcattttctacattcataatcgctacgcaagccagcaacagcaaatcgaaatagataagttgaaaaaagaactgatcgacataaaatatgatgcactgacacgaagttcggaattgatggaaaaaagccgtcagtcgcggatagaggattatatatcgaccaaagaaagtgacttgcagacatcaacccatccaccttatttaatcagtacgaaatag

SEQ ID NO: 1345 - DNA, 597 bp, B.fragilis
agcttaattttcccccgtcactgtctaaaaaatgccgtaaacttgcatcatcgaaaaacaacgaatattcacaatttaaaaagcaacgttatgaaaagtttaagcttcagaaaagatttaattggagttcaggaagagctacttcgctttgcatacaaactaacaaccgaccgtgaagaagcaaacgatttgttgcaggaaacctctcttaaagcgttagataacgaagataaatatactcccgacactaactttaaaggatggatgtacaccatcatgcgcaacatcttcatcaataattatcgcaaagtagtacgcgatcagacttttgtagatcagaccgataatctttatcatctgagccttccgcaagaatcaggactcgacagtaccgaaagtcgttacgacttaaaagagatgcaccgcatcgtcaattcattacccaaagaatataaagtgcctttctctatgcacgtttccggattcaaataccgtgaaatagctgagaaactggacttgccgctcgggacagtaaagagccgtatctttttcacccgccagcgtttacaggaagaactgaaagactttagacaatag

SEQ ID NO: 1346 - DNA, 507 bp, B.fragilis
ataattttcttttcgccttcaaaaatgaaagggatggtaacgattccgacagtcaggatgtccatctctttagcgatacgggcgatgacgggagcggctccggttccggttcctccacccattccggcagtgataaacaccattttggtaccatcgttcagcagagttttgatgtcttcgatgctctcttcggcagcatcacgtgcacgctccggacggtttccggcaccgagtccttgtgtgatggaacgtcccagttgcagtttgaccggtacgggagactcagccaatgcttggttgtcggtattgcagagaacgaatgttacgtcgtgtatgccttcccggtacatgtggttgacggcgttacctccaccacctcctacaccaatcactttgatgattttcggtgaatctgtagggaaatcgaattgtactatctcgtccatattatattgtattatgaattatcactttatttcatatcttcgtcagaaaaaatttcattag

SEQ ID NO: 1347 - DNA, 369 bp, B.fragilis
tataaatctataagtctttttattatgaaacggaaaatctttagtttgattgtggtgctcgttgttacgatttcttttatcaatgtttggatttcagttggttcaactaatgcaaaagtgaagttgcgtttggctgcgatagacgcaatggcaatgattgaagcagaaacacctggagatactgaactttcgctttcaggatcatgtaagattacttttacttgttatgatagctggacgggagcggcggatggtagtattacttgctggggagctgaatattgcaaacgaggaattaaaaaggaaggtatagttattattacagagactcggtgggtggaatgtgatggtaaaagaacagaatgttga

SEQ ID NO: 1348 - DNA, 1245 bp, B.fragilis
ggcaatcatatgacaaaggctattgactttaggtatgagtgtaagataattgtaataaatgaaaaacaaattatgaaaatagtgaatatctttgtagccttattctgtctcacggcatgttcgttgtctaatgatttgaaggacaggctgattttgaaacctcaatccatattgattgatccggacaaagtgaaagactttattgatttgacccctttgttgagagattcggttgagattattcctttggagactaaagatgagtgtttgttatccgaaattgaacggattgaattctataaagatcgtatatttgtacttgatagaactcgcaaaggagtttacatgtttgatcaatccgggcgatttatcggtaagattggttgtcaaggaagtggtccgggagaatttacctctgttggattcttttgtgttacaggagattctgttttaatttcagatcagcatcaatctaaatgggtagtttataatcttcaagataagagaaccacggaattttcttgtggtgagtttacttatttgaatgggttcttgatggggaggaatttatatttagtctccaattataacaagtcccaatcagatcgttttaatctttataagtttgatgtatctactcgtaagatagaagaggctttaattccatttgaagaaaagatggataagtatagtactaccgcatttactatttatgctagtcaatatcaagatacagcttttctgatttatccctttaacgatactatttatgaggtaagttctaaaggagctcaacctttttatacgattgattttactcaacggaatcttcctgatgatatagagccgataaataatagctttcgtctggctgttgcaaaaggaaattttgtgaaagggttgagttatatgcagatgtctgggaattacatattaggacgttatgcagataagggatactttcgctatctctctgttgaccggagtacgcttaagtctacagtaggcaacagttttgttgtgagggatttaggatatcttcctgttacttctttctataccatcggtgatgctttggtctctgtgtactctgcaagcgcactgatgcagatgcttgatgttatattgtctccggattctcctataaaagaaaaatatagaactaaatttgagtctttgaaacagataactaattgcgaaggtaatcctgtattattgaaatttcaatttgagagtgctgaatga

SEQ ID NO: 1349 - DNA, 798 bp, B.fragilis
gatagtagtattcgattgtctatttcctctttttttgtagctttgttaccggaaagaaaagttagagctatgttgcaaaaaacggttggaatcgttcttcatgtattaaagtataacgatacatcgaatatcgtagagatgtatactgagttgtcagggcgtgcgtcctttttggtcaccgtgcctcgttctaagaaggctactgtcaaatcggtgttgtttcaaccattggctttaatcgaatttgaggcggattacagaccgaatacttcactttttagaattaaggaggccaaatctttcagtccctttacttctattccctatgatccttttaaatcggctatcgctctttttctcgctgaatttctttatcgtgccattcgtgaggaggctgagaaccgtccgttgtttgcctatttacaacattctatattatggttggatacctgtaagattagttttgctaatttccatctggtatttctgatgcgtctttcacgctttttggggctgtaccccaacctggacgattatcatgcgggtgactattttgatatgttgaatgctacttttacgtccgttcgtcctcaactgcattcttcttatatacagcccgatgaagccggacggttgttgcagttgatgcgtatgaattatgaaaccatgcatctttttggaatgaaccgtacggaaagagcccgttgtctggctattattaatgaatattaccggctgcatcttcccgattttcctatactgaagtcactggatgtattgaaggaactgtttgattag

SEQ ID NO: 1350 - DNA, 516 bp, B.fragilis
aaacctaaaatactaatgtccatcaattacgcagttaccaagaaagtagacaagagcaaaggtatcgccaaagaacgatattatgccactacacgcgctttacagaaaaaacccgtaaacagtgtacaaattgctaatcaactcgcagaaagaagctctcttcaaaacggagacgtactctctgcacttactcaattatcggatattattgccgctcacctgaaggaagggcgtactgtttccatcgatggattgggcaatttctaccccagtatcaccagtgaagcagtggacaaaccggaagaatgcaccgccaacaaagtatgggtatcccgtatttgctttaaggccgcacccgctttcctgaacaatgtgcggaaaaccgattttgtcagcctgcaacttaaatacggacgcaagtctacaaagtcacaaaacggttccgacaaggagacaaccgatgttatcccccaccagcaaagcatctctgaagattcttcattatcagacgaataa

SEQ ID NO: 1351 - DNA, 1059 bp, B.fragilis
aagaacagaatgttgattatgagcgcttcttttaatttattagacaggaagagactgaaaggcttgttgttattttgtccggtttgggtgttattgttctggggatgtggacgtacggtcgaatctcctgaaaaagtgttgaaatgtgaactcgtttcttacataaagagttatcctgattcttcatttttctctcaggtgggtacaatgcaatatcaggatggtaagatttatttgttggatgaggctcggagagatgtggctgttatggatttggagttttctgattttagtttgatcggtaaacctggagatggacctggagagttggttcgccctgtaggattttatgttgagaaggatacagtctatatattggatggaggaaccgtgaacgtaaaaagatattttgattcggaatttatatcttctttttcagttcctgctgcgaacgattatcgtttctttatgaataaagatactattttcttatcagcagttactgactccactttttatacgaagagtgctgaaagttggcaaagaggggatttgtttacacttgttttggcagggaacgtccatgattttggtaatgctaggaggaatatggtgcttaatcagaggcatttagtaaaagacagtacttctctatatggtattacaagcagttcttctttattaggaaaatatgatttgtcatctaataaacaagtagctacttttgatttatcttctgtttccttgataaaagataacctgacttacgaaggaagtcaaccatatgatcctaagagttattatacttttatttcggatgcttatgcgatgaatggctatttgtatttgctttgttcagaactgaaggatcgggataagggaggctttcgggtaaataagatattgtgtctgaaaacagagcctgaattacaattggacgttatttatgcgcttccaggtgagatctatacttctttttgtgttactcctgattatatttttgcaacaaactatagcaatgaacgtattgagaaattggctttacctgtttccgattag

SEQ ID NO: 1352 - DNA, 483 bp, B.fragilis
ggtgaaatgatacgttttttaggcaatattgaagcaaaggcggacgcgaaaggaagagtttttatccccgcccaattcagacggcaactacagtccggctctgaagacaagctcatcatgcgcaaagacgtatttcaagactgcctggtgctctatccggaagaggtctggaatgaagaactggacgaacttcggcagcgactgaataaatggaacgccaaccaccaacttatcttccgccagttcgtcagtgacgtcgaaatcatcacgatggacggcaacggacgtatactgataccgaaacgctatctgcaaatcaccggtatacaaagcgacgtacgctttatcggggtagacaataagatagaaatctgggcgaaagaacgtgcggagaaactctttatggaacccgaagcattcggagcagccttggaagagattatgaaagaagaacggagaacaacgaacaacgagctaaaatga

SEQ ID NO: 1353 - DNA, 2127 bp, B.fragilis
aagatggctgtaaacaagaaaaatataatgacccgctacttcttcgtcatcctgttgatgggactgataggagtagccattgttgtcaaagcaggcatcacgatgtttgccgaacgacaatactggcaggatgtggccgaccgtttcgtcaaggagaatgtaacggtgaaacccaaccgcggaaacatcatttcgtccgacggcaaactgatggccagttcgctgccggaataccgtatatatatggacttcaaagccggtggagtaaaaaaagacaccatgctgatgaatcatctggacgagatatgcgaaggacttcataaaatattccctgataaaagcgcttcggaatttaagactcaccttaagaaagggcgcaaacagggaagccgtaactatctgatttatccgaagcgtatttcatatattcaatataaagaagctaaacgccttccggtgtttaacctcaacaaatacaaaggcggattccatgaattggcttataaccaaagaaagaaaccttttggttcacttgccgcccgtacgttgggtgacttatatgccgatacggcccagggagctaaaaatggtatcgagttggcttttgattctatcctcaaaggacatgacggaattactcaccggcaaaaggtgatgaataaatacctgaacattgtggatattcctccggtagacggttgtgacctgctttctaccatcgacgtaggcatgcaggatatctgcgagaaggcattgaccgataaactaaaagagctgaatgccagcgtaggtgtggccgtattgatggaagtggcaaccggcgaagtaaaagccattgtcaacatgacgaaagccggagatggcaattattacgaaatgaggaataacgctatcagcgatatgctcgagccgggatcaacatttaaaacagcttctatcatggtggcccttgaagatggcaagatcactccggaagacggtatagatacgggaaacggtatcaagatgatgcacggtcggcccatgaaagactggaactggtataaaggaggatatggctacctgacggttacgcaaattctggaagtatcttccaatataggaacttcgagcattatcgaaaaatattatggaagtaatccgcaaaagtttgtcgacggactgaaacgaatgagtatcgaccagcccctccaactgcaaatagcaggagaaggcaaacccaacataaaaggtcctaaagagcgctattttgcaaagaccactctgccatggatgagtatcggctatgaaactcaggtacctcccatgaatatactgacattctataacgccattgccaacaacggagttatggtacggccgaagtttgtgaaagcagccattaagaacggagaaatagtgaaagagtatcctacggaaatcatcaatccgaaaatctgttcggagcggaccttgaagcagattcaggaaattctttataaggtagtacacgaaggtctggctgctccggcaggttccaagcaatttgccgtttcgggtaaaactggtacggcacagatctcacaaggtgccgccggatataaatcgggacgggtgaactatctggtcagcttctgcggatatttcccttcggaagctccgaaatacagctgcatcgtttctatacagaaaccgggacttcccgcttcgggaggtttaatggcaggtagcgtattcagcaaaatagccgaaagagtgtatgccaaagatttacgcttggacatcaggaatgcaatcgataccaatacggtagtgattcccgatgtaaaagcaggcgaaatgatagaagcaagacaagtattggaaggcctaaacatccagacacaggctgaatttaaggctaaaaagaacaaagaggtgtggggacatgcacaggcagcccccaaagcagttatcctgcagggaaaagaacaattacgcaactttgtgcccagcgtaataggtatgggtgccaaagacgctgtatacctgctggaaagtaaaggattgaaagtaaccctgtcgggagtcggcaaagtaaagagccagtcgttgccccagggaactaccatcaagaagggacaaaccatcagtatccatctgaattga

SEQ ID NO: 1354 - DNA, 1131 bp, B.fragilis
gcaccggatgttattcaatcgaaaagcgtaaatcgtctaaccgtaaataaagttatgttatactatctgtttgaatggctacacaaactcaactttccgggtgccggaatgtttgggtacacctcgttccgtgcattgatggctatcatcctggcactgcttatttccagtatctggggagataagttcatcaatctgctgaaacggaaacagatcaccgagacgcagcgtgacgccaaaatcgatccgttcggcgtcaataaagtaggagtgcccagcatggggggtgtcatcattatcgtagcaatcctgatcccctgtctgttattgggaaaactgcataatatctatatgatactgatgctgatcaccaccgtctggctgggatctttaggatttgcagacgattatataaagatattcaaaaaggataaagaagggctccacggtaaattcaaaattatcggtcaggtgggtctcggcttaattgtcggactgactctatatctgagtccggacgtagtgattcgtgaaaacatagaagttcagaaatcggaaaacgaaatcgaagtaatacatggcactcacgatctgaaatctacccagaccacgattcctgtcttcaaaagtaacaacctggagtatgccgaccttgtaggctttatgggagaacacgctcaaacagccggatggattttgtttgtcattatcaccatctttgtcgtgacagccgtgtcaaacggagccaacctgaatgatggtatggatggtatggcagcaggcaattccgccatcatcggactaacgctgggcatattggcttatgtatcgagccacatcgagtttgcgggttacctgaatatcatgtatattcccggaagtgaggaactggtaatctttatatgcgcctttatcggagcattgatcggtttcttatggtacaatgcctatccggcccaggtattcatgggggatacgggcagtctgaccattggaggtatcattgcggtatttgccattattattcacaaagaattgctaatcccgattctctgcggtatatttctggttgaaaaccgtcatgcaattggcatcacttctattataaagccggaaaaagaaagggtgtaa

SEQ ID NO: 1355 - DNA, 270 bp, B.fragilis
aacagattagtcgagatggcaaatcataaatcatcaatcaagagaatcagacaagaagaaacaagaagacttcgtaacagatattatggtaaaaccatgagaaatgctgttagaaaacttcgttcaactactgacaaagcagaagcaactgctatgtatccgggcatcgttaagatggtagacaagttagctaagacaaacgttattcataagaataaagctaacaatctgaaatctaagttggccatttacatcaacaagcttgcttaa

SEQ ID NO: 1356 - DNA, 861 bp, B.fragilis
aaaagaacagttaattttgcgcaatcatttcatctaaaaagaatggctgacgactctttatttttaatagatattgataagatacttcagacgaaagctccgaagcactacaagtacataccaaagtttgtcgtctcctatctgaagagaattgtacatcaggaagaattaaatgtttttctgcgcgattcgaaagataaagtgggagtcgattttctgggggcttgtcttgagtttctggatgcaaagttggaggtgaaaggtctggaaaatattccgaaagacggtttatatacgttcgtgtccaatcatccgctgggaggacaggacggtgtttctctcggatatattttgggacgtcatttcgatgggaaggtgaagtatctggtgaatgatttgctgatgaaccttcatggcttggcaccattgtgcattcctattaataaaacaggcaaacaggcaaaagattttcctaagatggtagaagccggattcaagtcggacgatcaactgataatgtttcccgctggactttgttcccggcggcagaacggagtgattcgcgatcttgactggaagaaaacatttatcgtaaaaagtgttcagtttcagcgtgatgtgattcctgtccattttgaagggcgtaactctgatttcttttataatttggctaatttatgcaaggcactggggattaagtttaatattgctatgctttacctggcggacgagatgctgaaaaatcgccataaaacattcaccgtcactttcggaaaacccattccgtggcaaacattcgataagtcgaaaactccggcagagtgggcacaatatgtgaaagatatcgtgtataaactgtaa

SEQ ID NO: 1357 - DNA, 216 bp, B.fragilis
tgttttcactcttccggaccagtattcgtcctccggttattttccgtacttctggttcctctgccggtacgggtaacattcccaggagtcactctgttgttatcccgtgaagctgagctttctctttgggacactcctcttctcacctcatctctccgtcccgaattggaacgtatggttaccgatccgaaatcggaacggcgatgcgtgttataa

SEQ ID NO: 1358 - DNA, 348 bp, B.fragilis
ggcagcggctccttcagccccgtggtgaagaccgccgaactggatagtactactgtggtacggttcaatcaaatgcagtttcacccttacctgaaagccgaaaagaaaaaacagcaatggcatttcacagcagccgtagacaaaccctggtttccggcagaccaattgttcggttcacttcccaaaggattattcagtaacctggaaggtataaagacaagtggcgaactggcctatcatttttttctggatgcaaattttgccctgttgaacagtcttaaaatggaaatcgaacctgaaggaaaggaatttccgcatggaaaactacggggtcacaaatctggttaa

SEQ ID NO: 1359 - DNA, 846 bp, B.fragilis
agagtgaaatcaccggttcctctattgaatccgggtgggtatcaaacaaatcgtgtaggactcttgttccttctgcataataaaataacctataaaatatcagcgcttatgaaaatggctctttctgattttgctttgcggaagaaagggatttacggcattttacatgtcatcatcctgctgctttccctgtttctggtcatcagcatctcgatagatacgtttaagggtatccctttttatacccaatcggtttatatgaaagttcagctatggatttgtgtcttatttctgttcgatttcattctcgagttgtttctttcgaaaaataagtggcactatcttagtacgcatttcatctttttgttggtggcgataccttaccagaatattatatcctatatgggatggactttttcacccgaagtgacttatatgattcgttttgttcctttggttcgaggcggctatgcgatggctattgtggtggggtggcttacttataataaggcttccggactgtttgtttcctatctgactatgttgcttgctactgtttacttttcaagcctggctttttttgtactcgaacacaaggtcaatcccctggtgaccggttacggagatgcgctttggtgggcgtttatggatgtgactacggtaggttccaatattattgctgtcaccgtgacgggacgtgtactttcggtgttgctggcggcactgggtatgatgatgttcccgatctttacggtttatgtcaccagcctgattcaaaaaaagaacaaagagaaagaggagtattataaacaattggaggcagctgacgaaagtaagccaaaataa

SEQ ID NO: 1360 - DNA, 978 bp, B.fragilis
cagctcctaccattggattgggagatacgttgcaaagaccgttttttgccagttggatgcaacgcctcatgtatttttcttctttcatcttttaggctgatagctatattatttgtacttttgcaccccaaaataaggagaatgaaccacgtcaccacttatatccgccaggctttacacgatatttatccaccgggagaactcaggagtctcacaaaaatcatttgttgtgatctgctgggtcaggatgctattgattattatctgggcaaagatataacattatctgcaaacgagcagtgtgatttagaaagcattgtcgaacgattgaagaaaaacgagccgatccaatatattcagggcgaaacctgtttttatgggtctatgtttcgggtagctccgggtgtgttgattcctcgtcctgaaactgaggagctggttgatctggtagtgaaagaagctgcaaccggtacccgtttgctggatataggaaccggtagcgggtgtattgccatcagtctggctaaacatattccgcaggctgtggtcaccgcatgggacgtatcggaagaggctcttgccattgccggggagaataatcgggaattgaaggccggagtgcattttgagaaaatggatgttctgtctgcagaacctgttggtgatgatcaatatgatatgattgtcagtaatcctccttatgttacagagagcgaaaaaaacgaaatggaacccaatgtgttagattgggagcccagactggccctttttgtgccggacaatgatccgttgcgcttttatcggcgtatcgcatctttaggaagaaaaatgttacgcctgcacggcaggctctattttgagatcaatcgggcttatggtgaagaggttctccaaatgcttcacgaacaagggtacgaagaactccgtttgataaaagatatatcgggtaatgatcgaattgtaaccgccaaacgatga

SEQ ID NO: 1361 - DNA, 576 bp, B.fragilis
tcactaaacactaaaattgatatggacgaccaaattaaacaaatagcagaacgtctgcgcggattacgtgacgtactcgaactgacggccgaagacatcgcccgtgattgcgagatttcagcggaagaatatcgcctcgcagaaacgggagattacgacatttcagtgagtatgctgcaaaaaatcgcacgtaaatacggaatcgctctcgacgctctgatgtttggcgaagagcccaagatgagtagttacttcctgacccgtgcaggaaaaggaaccagtattgagcgcacaaaggcttataaataccagtcactggcagcaggttttatgaaccggaatgccgacccgttcattgtaactgtcgaacccaaacccgacatcgagccgatacactataacagtcatagcggacaggaattcaacctggtacttgaaggccgcatgatgatcagtatagatggaaaagacttgatattaaacgaaggggacagcctgtacttcaattcaaaactacctcatggaatgaaagcactcgacgggaaaacagtacgtttcctggcagtaatcatgtaa

SEQ ID NO: 1362 - DNA, 185 bp, B.fragilis
  unsure (166),(167),(168),(170),(172): Identity of nucleotide sequences at the above locations are unknown.
tatggagtaacggtggtgccaacgaagtatggcgcggacgactcaataaatttggttttgaaagacagaacaacaactaacgaaatgtcctataaagaacaaatagatttaaaccggatacctaagcatgtagtcgtcaccgccgagtgcaatgcatgctccattnnncncnggcctgcctcccc

SEQ ID NO: 1363 - DNA, 927 bp, B.fragilis
caagcagatgcggcaatatgtttttcggcggctaatcattcttacgtctgttttttatttatctttgcagtaaacagaatgaagattatgagcattgaattaggaaaattcaaccagcttgaggtagtcaagcaggtcgatttcggtatgtatctggatgggggagaagagggagaaatcctgttgcccacccgctatgtacccgaagattgtaagttgggagactggttgaacgtcttcctttatctggataatgaagaacggttaatagctactacattgacacctttggtacaagtaggggagtttgcctgcctggaagtatcgtgggtcaaccagttcggagcttttcttaactggggattgatgaaggatctgtttgtccctttcagcgagcagaagatgaagatgcaggtagggaataaatacgttatccatgcccatattgatgatgaaagtttccggatcgtagcttcggccaaagtagaccgttacttatctaaagagaaagcttcttatcagcctggtgaagaagtgaacatccttatatggcagaagacagacctcgggtttaaggctattattgagaatatgtatagcggcttgctgtatgatagtgaaatatttcagactttacataccggcgatgtactgaaagcatacgtcaagcaggtacgcgaagatggcaagatagatctgattctccagaagccgggctttgaaaagatagatgatttttcaaagacacttcatcgctacatcacagagcatgggggatggattggacttacagataagagtcctgccgaggagatttatgacacgttcggtgtcagtaagaagacattcaagaaggccgttggcgatttgtacaagaagcgtctgattcttcttcatgaagacggcatcgagttggtacgtccctaa

SEQ ID NO: 1364 - DNA, 213 bp, B.fragilis
agttgtccggccgccgattacccgcatcgctgccgtgtaatattcacatggaacggaaagcaatatgctgcctatacctttgtctttcatagccacttcgatagatgcggctttcaggaggcttttgacacttgctacttcccatggactgcccgcgaacacttcaatctgagaaatctttctgcttactatcatttgctcttaattgtttaa

SEQ ID NO: 1365 - DNA, 1374 bp, B.fragilis
tatgttatctatgatacaatattaatagctatggcacagaaactttgggaaaaatcagttgaggtaaataaggatatagagcgatttaccgttggacgtgaccgtgagatggatctttatcttgcaaagcatgatgtacttggttcgatggctcatatcacgatgctcgaaagtatcggattgctcacaaaggaggaattagctcagttgctgaccgaactgaaagatatatatgcttctgcggagagaggcgagtttgtaatagaagaaggagttgaagacgtgcactcgcaggtagaactgatgcttacgcgtcgtttgggtgatgtcggtaagaagattcatagcgggcgttctcgtaatgatcaggtgttgcttgatctgaaacttttcactcgtactcagatcagagaagtagcagaggctgtagagcaattgtttcatgttctgattcgtcaaagtgagcgttacaagaatgttctgatgccgggttatactcatttgcaaattgcgatgccttcttcgttcgggctttggtttggagcgtatgctgagagtttggtagatgatatgcttttcttgcaggctgcttttaagatgtgcaataagaatcctttgggctccgctgccggatatggctcttcattcccgctgaaccgcacgatgactacggaattgctgggattcgattctttaaactataatgtagtgtatgcccagatgggacgtggaaagatggaacgcaatgtcgcttttgccttggctacgcttgcaggaacgatttctaaattggcttttgatgcttgtatgttcaatagccagaattttggtttcgtgaagttgccggatgaatgtacaaccggatcaagcattatgccacataaaaagaatccggatgtgttcgaactgacacgtgccaaatgtaataagttacaatcgctgccgcagcagattatgatgattgccaataatctgccttccggatatttccgtgatttacagattataaaggaagtctttttaccggcttttcaggagttgaaagattgtctgcagatgactacctatatcatgaatgaaattaaggtgaacgagcatatcctcgatgatgataaatacctttttatttttagtgtagaagaggtgaatcgcctggcacgtgaaggtatgccattccgggatgcttataagaaagtagggctggatattgaagccggtcacttttcgcatgacaagcaagtacatcacacccatgaaggaagtattggcaatttgtgtaatgatgagatttccgcattgatgcaacgtaccatcgagggtttcaactttcaaggtatggaacaggcggagaagaccttgttggggcgtaaatga

SEQ ID NO: 1366 - DNA, 486 bp, B.fragilis
tcgaattgtaaccgccaaacgatgaatacaataacagaagaagaagcgttaaatcgcatggctgcctattgttccgcagccgaacattgtaaagccgaagtgaatgaaaaactccagaaatggggcttaccttatgaagtgattaaccgaatcatcgatcgtcttgttgtcgagaagtttattgatgaagaacgttattgtagagcgtttgtcaacgataagttccgttttgccaaatggggtaaaatgaagattacacaagctctgtatatgaaaaaaattcctcgtgaggtaacttacaggtatctgaatgacattgaccgggaagaatatcttgcgattttaggagatctgatagcagcaaaacgtaaaagtatacatgccaaagatgaattcgagctgaatgggaaattgattcgttttgccatgagtagaggatttgaaatggacgatatccgtcgctgtgtgcaggtagaagaagagtaa

SEQ ID NO: 1367 - DNA, 1248 bp, B.fragilis
aaaaagaacaagaaagaaataacatttaaaatatacagcactatggaacagaaaaagaaagtagtggttgcattcagcggaggcctcgatacctctttcactgtaatgtacctggccaaggaaaaaggatatgaagtgtatgcagcgtgtgccaacacaggtggcttcagcgaagaacaactgaaacagaatgaagagaatgcctacaaactgggtgctgtgaaatatgtcacactcgacgtcactcaggaatattacgaaaaaagtttgaaatatatgatattcggtaacgtactacgtaacggtacctatcctatttctgtcagctccgaacgtattttccaggcattggccatcgcacgctatgcgaaagagattggtgcggaagccattgcacacggttcgacaggagccggtaacgaccagattcgtttcgacatgacattccttgtcatgactccgggcgtagaaattattacgctgacccgcgatatggcactcagccgtcaggaagaaatcgactacttgaacaaaaatggcttcgaagcagactttacaaaactaaaatactcttataatgtcggactatggggtacttcaatctgcggcggagaaattctagacagtgcacaaggattgcccgaaacggcctacctgaagcaagtaacgaaagagggaagtgaacttctgcgccttgaatttaagaatggtgaacttcacgccgtgaatggagaagtgttcgaagataaaattgccgccatccaaaaagtggaagagataggtgctgcttacggtattggccgtgatatgcatgtaggtgatactatcatcggtatcaaaggacgtgtaggattcgaagccgccgctccaatgttgatcatcggtgcacaccgtttccttgagaaatacacattgagcaaatggcaacaatattggaaagatcaggtagctaactggtatggtatgttccttcatgaaagccaatacctggaaccggtgatgcgtgatatcgaagcaatgcttcaagaatcacaacgtaatgtgaacggtacagccatccttgagctccgtccgttgtcattctctactgtcggtgtagaatcacaagacgacctggtaaagaccaagtttggtgaatatggagaaatgcaaaagggttggacggccgaagatgcaaaaggcttcatcaaggtgacttctaccccactacgtgtttactatgctaaccataaggacgaagaggtatga

SEQ ID NO: 1368 - DNA, 501 bp, B.fragilis
ggtttctcaaaagggatttaccaatacgatgaacgaattgggattgagtgcttttgtgatggggcccgtatcagatttgctcccgatctcttattggaaaatatgaagactttgataaaaacggccggaactaattttctgattatcgacgggcatcattgtactgagaaaactgctgttatagagacggtaaactcaatgatgctccaaacggtggagggtgtcatctatctttttccatgttggacacaaacaccggctgcgtttacgaggcttagagcaaaaggagcctttctcgtttctgccgattatgacggaacgtcagtgggcggtctgaaaatctttagtgagaaaggaggtatatgcagactgagcaatccttggaggggaagaaaacttcgggtcaccgagaatggaaaacccgtctccgtgaaagaacaaaacaatgtctgttcatttattacccgaaaaggaagcacttatacgatagtaggtctttaa

SEQ ID NO: 1369 - DNA, 1602 bp, B.fragilis
cttatggcaaatattaaacaagcagtgaaactaggggtattcaccctggcgatcatgaacgtaacggcagtagtatccctacgcggacttcctgccgaggccgtatatggaatgagttcggccttctattatcttttcgcagctatcgtattccttattccgacatcactcgttgcggcggaattggctgccatgttccaggacaaacagggtggtgtgttccgttgggtaggcgaagcgtacggaaagaaattgggattccttgccatctgggtacaatggattgaaagtacgatctggtatccgactgtattgacattcggtgctgtatctatcgctttcatcggaatgaatgatacacacgacatgacactggccagcaacaaatactatacactggccgttgtgcttatcatttattggctggctaccttcatctcactgaaaggaatgggatgggtaggtaaagtagctaaaattggcggtatggtgggaaccatcatccccgctgccctgctgattatcctgggtattgtttacttggcatccggagggcattccaaccttgacttccatagcagcttcttccccgacctcacgaatttcgataacgtggtattagcggcaagtatcttcctcttttatgccggtatggaaatgggcggtatccacgtaaaggatatgcaaaacccttcaaagaactatccgaaagcagtatttatcggtgcacttattactgtaatcatcttcgtcttgggtacattctcactaggtatcattatcccggccaaagatatcagcctgacacagagtttacttgttggcttcgacaactattttagatatatccatgcatcctggttatcaccgatcatcgccattgctcttgcattcggtgtgttggcaggtgtattgacatgggttgccggtccgtccaaaggtatctttgccgtaggtaaggccggttatatgcctccgttcttccagaaaaccaataaattgggtgtacagaaaaatatcctgttcgttcagggtggtgctgttaccgtattgagccttctgtttgtggttatgccttccgtacagagcttctatcagatcttgtcacagctgacagttattctttatctggtgatgtacttacttatgttctccggtgccatctacctgcgctataacatgaagaaagctaaccgtccgttccgtatcggtaaaaaaggtaacggcttgatgtggattgtcggcggcctcggcttcctcggttcattactggcgtttatcctcagctttatcccgcccagccagatttctacaggtagcaacacggtatggttctctgtattgattatcggtgctttggttgttgtgattgctccgtttatcatttatgcagctaaaaagccatcatgggctgacccgaatagtactttcgaaccgttccactgggaaacacaagctaaaccacaagttgctccggcaacaacaactaccgccggtccggcaacaagcagcgctaccactatcggtagtacaacttctgccccatcgacaggttccggctctgtttcatccgataaggacaccccacagaaacaaagttaa

SEQ ID NO: 1370 - DNA, 567 bp, B.fragilis
atgcaaagtgaagacggagctttctacttccaccggggattccttcctgaagccatgcgcaaagcgttgtatcaagatctgaaagtgaaacgttttgcccgcggagggagtaccatcaccatgcagttggtgaaaagcgtatttctgagtcgaaacaaaaacatagcccgcaaactggaagaagctctgattgtctggctgatagaaacagaacgccttacctccaaagaacgaatgtacgaagtatatctgaatatagtagaatggggaccgctcgtttatggagtgcaggaagcagcaacctattattttaaaaagcgcccatctcaactgacagccgaagaatctatttttctggcttccattattccaaagccgaagcatttccggaattcgtttaacaatgatatgcaactgaaggagagcctggaaggctattaccgtttaataaccgaacgattagtgaaaaaaggaatcatcagtgaagtggcagccgacagcatccgcccggaaattaatgtaaccggcgaggcaaagaaagatctgcaaagagacagcatacaatag

SEQ ID NO: 1371 - DNA, 666 bp, B.fragilis
aaactaaacgacatgcgaaaagtaatcataactctttgtttcttgtttgttgcatttgttgcacaagccggaagaatcagtggaataaatatccaaagctcaggtgaggcgattcttgtctttgtggatggcgagcaaatctgcactccgacggagacttgtttcattgctaactattcgggcaggcaccggatagaagtatatgcagtacgttatataccacgtaccggacaaagtgtgaaaggcgacttgctgtttcaggaatgggtctcaaatcccggtatgaatatcagggatattcgggtgggctataatgatcgtcctgatttctgtcccgatcgtccggtgcgtcccggctatgatgtagtgatgaaccgtacagagttcgaccgttttctgagaagtgtgaaagacaaacatttcgactcagaccgtaacaagctgattgaaactacacttgtttcgacaggcttcacttccgaccaatgtctccaattagtaaatctgttcagtttcgatagtgaaaagataaaactgatgcaggctatgtatccacggattgttgataaacccaatttctatctggtcatcgaaagcctcacttttcagtcggataaaaacaagatgaacgaatttgtgagaaaataccataatcaacgtaactaa

SEQ ID NO: 1372 - DNA, 1044 bp, B.fragilis
aagatgaaagaagaaaaatacatgaggcgttgcatccaactggcaaaaaacggtctttgcaacgtatctcccaatccaatggtaggagctgtcatcgtatgtgaaggacaaataatcggtgaaggctatcacatccgttgcggagaagcacatgccgaagtcaatgcgatccgctctgtaaaggatctgtctttactgaaacacagtactatatatgtaagtctcgagccttgctcccaccatggaaaaactcccccatgcgctgatttaatcatagagaaacaaattcctaggattgtaatcggatgccaagacccattttccaaagtagcaggcaaaggaatccaaaagttacgggatgccggatgcgaagtcattgtcggagttctggaaacggaatgtcgcgaacttatacggaaatttatcactttccatacccttcaccgcccttacatcgttttgaaatgggcagaatcagccgatggtttcatcgacctggaacgtacggaaggacaacctgtcatattatcgactcctctcacttccatgctggtacacaaaaaaagagcagagtcggacgctatcatggtcggtacgcgaaccgcactactggacaatccggcactcacggtacgcaactggcacggacacaatccggtgcgaatagtgatggaccgtaatcattcactccctcaaacctcccatttgtcggataacagcgtatctacgctcgtttttacggaacatccccgtgccggaaaagaaaacctggaatacatcacactcaattaccagacagatattctgccacaaatattgtctgccctctatcaacgcaacctacagtcgctgatgatagaaggaggaaggattcttctggagtcatttatccgttccggaatatgggatgaagtcatcatagaaaagagcgataaactgctttattccggtgttaaagcacctgaaataagcgataaaattagttattcggaagaaaaacatttctgtacgaccttcaggcattacttgaagagaaatacctaa

SEQ ID NO: 1373 - DNA, 759 bp, B.fragilis
gatatgaaacgaatattgatattctttttggtcataggaatcactgctataagcagtgtgagtatggcagccatgagcaatagccgcattcgcaaggagactcgtttcctgaccgataagatggcctatgaactgaacctgagcacagggcaatataatgatgtatacgaaatcaattacgattttatttactccattcgttatctgatggacgatgtgataaggggagaagagtgggcactcgataaatactatcgtaccctggacattcgtaatgatgatttgcgttgggtgctgactgcttcacagtatcgccgttttataggggtcgattatttttatcgaccggtttatgccagtggtggcagttggagttttcgtatctatattcggtatacaaaccataatcatttctactttggcaaaccgtaccactataacagctattgcggtggacactatcgtactcattatcataacagctattatcgcggacgctatcgacatgatttctattcgggttcgcacagtataagagatcatcgaaattataacacgcatcgccgttccgatttcggatcggtaaccatacgttccaattcgggacggagagatgaggtgagaagaggagtgtcccaaagagaaagctcagcttcacgggataacaacagagtgactcctgggaatgttacccgtaccggcagaggaaccagaagtacggaaaataaccggaggacgaatactggtccggaagagtga

SEQ ID NO: 1374 - DNA, 492 bp, B.fragilis
ttaaaatatagaaagaagagccattcggacagaatctgttcggattgttcttcttttttctttataagtaagataaataagatgactaaatttgaaagtagtgtcaaggtgataccttatagccaggaacgtgtgtacgagaaacttgccgatcttagtaacctggaagctattaaagatcgtttgcccgaagacaaagtgaaaaatatgagtttcgatactgatacacttagtttcaatgtggatcctgtaggacaactgaccctgagaattattgaacgggaacccagtaaatgtattaagtttgagactaccaattcgcctctaccttttaatatgtggattcagcttgtggctgtatccgaagaagaatgtaaactaaaggtaactattgggctggaaatcaatccgtttatgaaagcgatggtacagaaacctttgaatgaaggattggaaaagatggctgatatgttatctatgatacaatattaa

SEQ ID NO: 1375 - DNA, 981 bp, B.fragilis
ggacgaagaggtatgataaaagcaggaatcattggtggagcaggatatacagcaggcgaacttatccgcctgcttatcaatcatcccgagactgaaatcgtatttatcaacagtaccagtaacgccggaaacaaaattactgatgtacacgagggactttacggagagtgtgacctggcttttacagacgaacttccgttggaagacatcgatgtactgttcttctgtacagcccatggggatacgaagaaatttatggaaagccataatatcccggaggaactgaaaattatagacctttcaatggattatcgcatagcttcaccggatcatgacttcatatacggtctgccggaactaaatcgtcgtgcaacctgcacagcaaagcatgtggctaatccgggatgtttcgcaacttgcatccagctgggactgctcccactggcaaaacacctgatgctaaatgaggacgtaatggtaaacgccattacaggaagcacgggagcgggagtaaaacccggtgcaaccagtcatttcagctggcgtaacaacaatatgagtgtatacaaagctttcgaacaccagcacgttcctgaaatcaagcaatcgctgaaacaactccagaacagttttgatgcggaaattgattttatcccttatcgcggcgatttcccccgcggcatctttgccactttggtagtgaaaacaaaagtagcattggaagagatcgtacgcatgtatgaggaatattatgccaaagattcgtttgtccacatcgttgataaaaacatagatctcaaacaggtagtaaataccaataaatgtctgattcacctggaaaaacacggcgataaattactgatcatttcttgcatcgacaatttattgaaaggtgcatccggacaggctgtccacaacatgaacctgatgtttaacctggaggaaacggtaggcctgcgcctcaagccctctgcattctaa

SEQ ID NO: 1376 - DNA, 687 bp, B.fragilis
ctaaaacctataagaattatgaaaaaaatacatgtttcggcgatattaatcttgcttgttgttatgagtagttgtgcaggcttgatcttaaacttcaaaaacagtcagctaatgagtatccagaaaggaatgacacaacaggaagtgaaggcgattcttggaaagcccaattacagacgctttgatggagcaatggaagagtgggaatatcgcgggtatctttccaaagcagggcattcagtgatttgtgttaactttatcgacaaccgtgttgttgggttggattcgtttagagacggtgcaccgactgctcctcctgccccttccttttctttaggcataggtggtacagtcactgcttcggacatagctcccgcttgtgactatagagccatgagaaacgatgagtttgcccgctttttaaatgatgtaaagagtaaaacttttgattcggaccggacagatttcattgagaaagcaacccgctctaccggatttacatcagagcaatgctgcagattgataaaactttatagctttgatgatgatcggactaaggtactgaagatactttatccgagcgtagtggataaagataatttttccgcagcaatagacggattggattttctgtcgaatcaggatacggtgaagaactttgtgaggaactataatagaattaaatag

SEQ ID NO: 1377 - DNA, 783 bp, B.fragilis
ttatataatatgaaagtagctatcattggtgcaggaaatatggggggctccattgcctgcggactggcaaaaggtaagctgattccggcttccgatataatagtatccaaccccagcattggaaagctggaagcactaaagaaagaatttccttctattgctatcactcgcaataatgctgaagctgctactggtgctgatatcgtgattctagctgtgaaaccttggctgatcagaggtgtactccgagaaatgaaactaagaagcaaacagattctggtctctgttgccgccggtatcagtttcgaacaattggctcatgatgtagtagaacctgaaatgccaatgttccgtattgtccccaacacagctatcagtgaattacagagcatgacactgattgcttcgcgaaatgccggccaagaattagaaacactgatggtcaatctattcagcgagatgggtatggcaatgattttgcctgaagacaaattggaagcggctaccgccctgacttcctgcggtatcgcttacgtgctgaaatatattcaggctgccatgcaagcgggcatcgaaatgggaatccgaccatcggatgccatggatatgattgcccaatctgtaaaaggtgccgccgaactgatactgaacaatgacacccatccaagcgttgagatcgacaaagtgactacacccggcggaattaccattaaaggcatcaacgaactggagcataatggattcacctctgccatcattaaagcaatgaaagcatcaagatag

SEQ ID NO: 1378 - DNA, 693 bp, B.fragilis
tctcgttccatttccgtatttttgcatcctgtaattatcatagttagtttagttatgaaaaatttagagagattattcgccgagaagttgttgaagattaaagctattaagcttcaaccggcaaatccgtttacatgggcttccggatggaaatcaccgttttactgcgacaatcgtaaaaccctttcttatccttctcttcgtagttttgttaagttcgagattacacgtttggttctggaacgtttcggacaggtagatgctattgccggagttgcgacgggggctatccctcaaggggctttagtggctgatgcattgaatcttccgttcgtgtatgttcgctctaccccgaaagaccatggtctggaaaatcttatcgaaggcgaacttcgtccgggaatgaaagtcgttgttgtggaagatttaatctctaccggtggaagcagtttaaaagctgtagaagctattcgtcgggatggttgcgaagttattggtatggtagctgcttatacttacggatttcctgttgccgaacaggcctttaaagatgctaaagtgcctttggtaacattgactaattatgaagctgtgttagatgttgcacttcgtaccggttatattgaagaagaagacattgcaacgttaaacgaatggcgcaaggatccggctcattgggaaaccggaaaataa

SEQ ID NO: 1379 - DNA, 1377 bp, B.fragilis
ataaacacaatctttcaaatgagaataaagtttttatcagtaattgtaagtttcttccttgtatcgtttgccgttacttcgtgccttgacacagaagaaattgaatatagcccggatgctaccatacacgcatttgcacttgacaccatacatggggtaaactataaatttacaattgaccaacttggtcccgatggagtaggacttatttataaccaggattcactacctgtaggctccgatacaattattgaccgtattcttatcaagacactgaccacaacttccggaataatcactgccaaaaacgcagagggtcaggatactctgttcaactattccgattctatcgacttcagaggcactatgcaaaaaccgatgagaataaaagtgtgggctgccgacatgcaatataccaaagagtatactatttcggtacgtgtacatcaacaggacccggattccatgaactggaccaaaatgacagataacttcgcaaactatagcggatatcagaaatcagttaccctgaatgaagatctgttgatctatacatcgaatacgactgcataccaatcatccggagatgttatcagtaaaggaagaagctggacaccagtatccataacagggcttccggacaacatcaagctttcctccattatttctttcggcggaaaactatatgccacaaacggtgaaagtgcatacgtttcatctgatggagcattatggaatgttgcaaccgatttgaataaaaacggtaaagtagagatgctgatcgcccctttcccgaaaaatgaaggtaatctgttgggtatctccggaattgccggtattattaataatggtgatcaatctacatttgccataactaatcctgaagcaacagcgtggaacattggttccgaaacagtaggtgcggacttccccttggagaatttgtctgcaacttcttacctgacagcaacaggaatccagacaatagccgtaatgggtaacaatcgtaatgcaaacgatacgacttccatcgcatggacctcacaagacggtttgctttggatacctttaaaaacttcctcgagtaccgcctattgtccgaaactggacaatccgtctttcttctattatgataatgcttttctggcattcggaggaaattttgaaacgatctatacatcggaagcaggtattgcctggtataaagccaacaagaaaatcttcctgccggccgaattcaaagacagaggaaacaattactcaactgtagtagacaaaaataactttatctgggtaatatggagtaacggtggtgccaacgaagtatggcgcggacgactcaataaatttggttttgaaagacagaacaacaactaa

SEQ ID NO: 1380 - DNA, 612 bp, B.fragilis
ctaacaacaattatactctatactaaatcaacaatggacactcaacaaatagatgttatggtagccgacgcctcgcatgaggtttacgttgacactattttggagacaatcagaaacgcagcaaaagtacgcggaaccggaatagcagaacgtacacacgagtacgtagccaccaaaatgaaagaaggaaaagcaatcatagctctttgcggagatgtatttgccggatttacctacattgaatcatggggaaacaagcaatacgttgctacttcaggattgatcgtacaccctgacttccggggattaggactggccaaacgtatcaaacaagcctctttccaattggctcgtttacgatggcccagagctaaaatattcagtctgaccagcggcgcagccgtgatgaaaatgaatacggaattgggatatgtaccggtcacttttaacgagctgaccgacgacgaagccttttggaaaggatgtgaagggtgcataaaccatgaaatactgatggcgaaggaccgtaaattctgcatctgcaccgctatgctatatgatccgacagatccgcataacataaaaaaagaacaagaaagaaataacatttaa

SEQ ID NO: 1381 - DNA, 1134 bp, B.fragilis
gaagaaacaatgaacttatttgatgtatatccacttttcgatataaacataataaaaggaaagggttgtcacgtctgggacgagaatggaaccgaatacctggatctttatggaggccatgccgttatctctatcggacatgctcatccccattatgttgacatgattagcaagcaggtggcaaccctgggcttctattcaaactccgtaatcaacaagctgcaacaacaggtagccgaacgtctcggaaaaatatccgggtatgaagattattccctattcctgataaacagtggtgccgaagcaaatgaaaacgcgttgaaactggcttcgttccataacggacgtaccaaagtgatctcttttgggaaagcttttcacggacgcacttcactagcagtcgaggccacagataatcctaaaattatagctccgatcaatgccaacggacacatcacctaccttccgctaaatgacatagaggctgcgaaaaccgaattggcaaaagaagatatttgtgctgtcatcattgaaggtatacagggagttggcggtatcaaaataccgactcccgaattcctgcaagagctccgcaaagcctgtacagaacacggaacaatcctgattctggatgaaatacaaagcggttacggacgtagtggcaaattcttcgctcaccaatatgccggaatcaaaccggatattattacagttgccaaaggaatcggaaacggattcccgatggccggagtactgatcagtcctatgtttacacccgtatatggcatgcttggaacaactttcgggggcaatcatctggcttgctcggctgcattggcagtaatggatgtcatcgaacaggagaatttagtagaaaatgcagccaacatcggctcctatctgctggaagaactgaaaaaattcaaggaaatcaaagaagtgcgcggatgcggattaatgatcggaatggaatttgaccaaccggtaaaggaaatccggagccgcctgatccacgaacaaaaagtatttaccggtgccagcggtacgaacgtaatccgattgttgcctcctctctgcctcagcaaagaggaagccgatgaattcctcgcccggctaagaaaagtactcggttaa

SEQ ID NO: 1382 - DNA, 1242 bp, B.fragilis
aagtatatgatgatctacattatctttagcgtctttataatcattattctttttatttgtgccagatattggtatttgtggagaaagataagtgtgcaaaagaacgaatgggtggctcaaaccaaggaatcagatacgattttacgtagtatgaacgcttgctttatcttgataaatagtgacttggtggtgataaggaccaattattatgatttgagtggaatctcagaagagcctgagtcctccggtagagtcggtgatctactgaattgtaaaaacgctgttcgtagtggcggaggatgcggggcacataaaaattgcgaaaattgcatgattcgccatactattgagaatgcattctgccataaaaagggttttcataaattagaagcatccatgaggctgctcagttcggatcatcaacagattattccttgtgatgtttctgtctcgggtacttacttgaataatgaaggtcacgaacagatgttactgactgtctatgatattactgaattgaagaatatgcagcggttgctgaatattgaaaaagagaacgctgtttctgccgaaaagttgaaatctgcttttatagctaatatgagtcatgaaattcgtaccccactgaatgcgattgtcggtttttccggtttgttggcttctgcggatgatgatacggaaaaaaagatgtatctggatattgtagcggaaaacaatgatcgtttattgcagatagtgacggatgtactcgacctttcaaaaatagagtcgggtagtctggatttccattattccgaatttgatgtaaacgatttattatgtgctctgcatggcattttaaacatacgtctgaaagacaagcccgaaattaaactgatttgtaaggcaggaacagatgaatggatcatttattccgagcaacatcgtatcgtacagataatcacaaatctggtacataatgcgatgaagtttacccacagtggggagatttgtttcggatgtcgtccccaaggagaggacgagatttacttttatgtttctgatacaggtattggcattcctgccggagaacaggataaaatattcgaccgatttaccaaattggaccatgaagtacccggaacagggctgggactgactctttcacaaactatcgtacagaatctggggggagaaatgggagtcgaatcggaagtgacaaaaggatctaccttctggtttacccttcctttgaaatcctga

SEQ ID NO: 1383 - DNA, 1980 bp, B.fragilis
ttatcagtgatttgtattactgagaagtataatcgactgttaaacacacacgcattaaatatgaagttaaagtttctctttctgtttctaagctatagcttatcgatacattcgcaaaataacttattgtatgctgattcgtcaaaggattcgctcttctttgaacaaaaaaaggcactgcttacggcaacatggcataaacctttcagttatagcagtattcagagcaatcatgctcctttaggcccctatatggggaatggagatgtaggggtagtggcatttacatcggacaatagtcagacattaaagatatcgaaagtggattttgttacggatggctggacagactgggcaggcagtggtccggctgctttgcccattggcggggtgaatatcactgtaaactctccggtatattccggctttgtcacagtcaaccgggcggacccttccggatttagttatcagatggaccagttaaatagtgagttacgaatgactactgctactgctcagcaggttaaaatggtcacttggatgggagtgaatgaaaatatgataataactgagttgaccacctcttcaaaaactccggttcctatttcggtagatacttatgctgataatcaatctgcttcttatacaactacagcacaggtgaatggacaaatagctcaagtcactcggcaaacgaagactgatgcggtgagatggatttcttgtgccggtatatccactaaaatagtgggagttatgtctaaaccggaatgcctgtccgagtcgatggtccgatcaaattttcagctgacagcttccgatacgcttctcgttgtggtatatgtttcgggaggtggaaaaggaaatgatccgcaactgccaacggcctataacaaactgttgactttaaataaagcggatgtgactcaattgaaaatggcgaaaaaagcatggtggaaagatatgtggacccgttcgtatgtggaaacgaatgacgagttgttgaatcgtcactacttgtcgtccatttatttactagcttctgcctataacgaacattcaccggtatccggtggcatgtatggagtctggaatatggatgacaaaatgatgtaccatggtgatattcacctgaactataacagtcaagcgggattctatagtgctttttcatccaatcgtccggaaatagccttgcctttctataaaacgatagagttgctgatacccgaaggaaaacggcgggcaaaggaagaaatgggaattatgcatccatcatgggaaggaaagtcttgcaggggaatactatttcctgtgggggccttgggtatcggggtgttttataattattattggcaacaaaccatgaatgctccgttcaatgttcctctgttcagttggtattatgaatacaccggtgatttgaactttttacggtatcgggcgtatccttatattcgtctttgtggcgatttttatgaagactatatgcagaaggagacatacggcaaatcatatcgttataccataacgacaggaggacacgaggattcgtgggatctgaaccctccttccgatttagcttttgtgaaacagacgttcggtttgttagtgaggtacagtaagctgttgggagtagatcaaaaacgacggaagaaatgggacgacattttgtctcatcttccggagtataaggtgataatgccgaccaaaacacctaatcaaggcttgcctgtctatgcgaagaacgaggccggatgggatttgccaagccatgccatacagttgcatgctgcctatccctgtgaaatactgaatttacattcggactctacagccttgcagatagcccgaaacacattgtattattatgaggtttctcaaaagggatttaccaatacgatgaacgaattgggattgagtgcttttgtgatggggcccgtatcagatttgctcccgatctcttattggaaaatatga

SEQ ID NO: 1384 - DNA, 483 bp, B.fragilis
ttatacaagatgaagaagaaagcaaatcggttagacgccatcaaaatgattatctccagtaaggaagtaggttcacaggaagaactcttgcaagaattaggtcaggaaggatttgaactgacacaagctactctttcacgtgacctgaaacaactgaaagtggccaaagccgccagcatgaacggaagatatgtatacgtattacccaacgacatcatgtacaaacgtgtcggcgaccagagtgccagtgaaatgttgatgaacaatggcttcatttcccttcagttttccggaaatatcgcagtaatcaaaactcgccccggctatgccagcagcatggcttacgacatcgacaaccgtgaatctgacaccattttgggaacaattgccggagacgataccattatgttggtactacgtgaaggggcaacgcccactgccgtacgacatttcctgtctctcattattccgaatatcaactaa

SEQ ID NO: 1385 - DNA, 1665 bp, B.fragilis
ataaacaagatgatagatagatttttatctcaaacttccttcaattcacaggaagactttgtgaaaaacttaaagatacacgttccggacaacttcaacttcggatatgacatagtggatgcctgggctgccgaacaaccagacaaaccggccttattatggactaatgacaaaggtgaacaccaccagttctcttttgcggatatgaaacaatatactgaccggacagcctcttattttcagagcctgggtatcggacatggtgatatggtcatgctgatattgaaacgacgctatgaattctggttcagcatcattgccctgcacaaactgggggcagtcgttattccggctacacacctgctaaccaagaaagacattgtataccgttgcaatgcagccgacataaaaatgattgtggctgccggagaagaagtggtcaccaaacacataatagatgctatgccggactctcctactgtaaagcatttagttagcgtagggcccgaaatacccgaaggatttgatgacttccatcagggcatcgagcatgcggcgcctttcgtaaagccggaacatccgaacaccaacgatgacatttcactgatgtacttcaccagcggaacaaccggagagcctaagatggttgcacacgacttcacttatccattggggcatatcgtaaccggtagtttctggcacaatctgaaagaaaacagcctccatctcaccattgccgacaccggctggggaaaagcagtgtggggaaagctctacggacaatggattgccggagcaaatgtattcgtgtatgatcatgaaaagttcactcctgccgatatattggaaaagatacaaaattaccatgtcacttcactctgtgcccctcccaccattttccgtttcctcatccacgaagacctgacgaaatatgacctttcgtcattggaatattgcaccattgcaggtgaggccttgaatccggctgttttcgacacattcaaaaagttaacaggtatcaaactgatggaaggcttcggacagaccgagactacactgacagtagccactttcccatggatggaacccaaaccgggaagtatgggggtgcccaatccacaatacaatgttgatctgatcgattacgaaggacggtcggtagaagccggagagcaaggacagatcgtaatccggactgacaaaggaaagccactgggactgttcaaagaatactatcgggacgcctcgcgtacacacgaagcatggcacgacggaatatactacactggcgacgtagcctggaaagatgaagacggttatctatggttcgtgggacgcgccgatgacgtaatcaaaagttccggttaccgtatcggtccgttcgaagtggaaagtgcattgatgacacatcccgccgtagtagaatgtgccataaccggcgttcccgacgaaatacgcggacaggtagtgaaagctaccatcgttctggccaaagagtatcgtgaacgcaaaggggaagacctggtaaaagagctccagaatcatgtgaagaaagtcacagctccttataaatatccacgcgtcatcgaatttgtcgacgaattgcctaagaccattagcggtaaaatccgacgagtggaaattcggaagaatgacgagaaataa

SEQ ID NO: 1386 - DNA, 1005 bp, B.fragilis
attatggaattcttaaccaacgaaaaacttacgattgtaggagctgccggaatgattggctctaacatggcacagactgccttaatgatgaaactgactccgaacatctgcctgtacgacccctatgcacccgctttggaaggcgtggctgaagagttgtatcactgtgcgttcgagggagtaaacctgacctacacttcagacatcaaagaagctttgtcgggagccaaatacattgtgtcctccggtggtgctgcccgtaaagcaggcatgacccgtgaagatttactgaaaggtaatgcagaaatcgccgcccagtttggtaaagatatccgccaatattgcccggacgtaaaacatgtggttgtcgtattcaatcctgccgatatcaccggattgattgtcttactctatgccggactgaaaccgtcacaagtatcaacattagcagctttggacagtacacgtctgcaaaacgaactagtgaaataccttcatattcccgcatctgaaatagtgaattgccgtacgtatggcggacacggagaacagatggccgtattcgcttctaccaccaaagtacaaggtgaagcgcttactaaaattatagatactccacgtatgcctatgcaggattgggaagacctgaaagtacgcgtcatccaaggtggaaagcatatcatcgacctgcgcgggcgctcttcattccaaagtccggcctatctgtctatcgaaatgattgcagcagccatgggcggacaacctttccgctggccggcaggaacgtacgtatccgacaaaaagttcgatcatatcctgatggcaatggagacttctatcacgaaagaaggtgtgagctataaggaaatacagggaactcccgaagagcaaaaagaaatggaagagagctacgctcacttatgcaaattacgtgatgaagtgatcgctatgggtatccttccggaaatcaataaatggcatgaactgaacaagcatattaactga

SEQ ID NO: 1387 - DNA, 2283 bp, B.fragilis
atgaataactcgaaaattatcaatgtgagattgatgaaaaaggtgttagtgcttgttctatcttttttgtctgttactgcttttgcgcagaatataacagtgaaaggaattgtaaaagatggaaccggtgaaccgattatcggagggagtgtacttgttaaaggttcatcgatcggtacagtgacagatgttgatggcaattacactttatctaatgttcctgcagacggagttctggagttttcttacatcggcatgaagaaacaggatgtaaaagtaagcggtaaaactgttattaatgttgtgcttcaagaagatacccagatactggacgaagtagtggtgacagccttagggttgaagcgtgaacagaaagctttggggtatgcagtgaccgaggtcaaaggcgatgacctgaaagctgccaatacgatttctccggtagccgccttacaaggaaaagtagcgggtgtcgagatccgtcagtcagacggaggtatgttcggagcgacgaagattcagattcgcggtgcttctactttgaaaggaaacaatcagccgatttatgtgatcgacggagttattctcgataactcgacttcgggaaataccacgatggactgggatgccggaaacaataatgccaatgactatggtaatgaactgaagaacctcaatccggatgactttgagacagtttcggtcctgaaaggtgctgctgcgactgccctttacggttcacgtggtctgaacggagctgtggtgattaccaccaaatcgggaaaaggcttcaaaggcttcggagtttctgtatcacaaacatttggtatcgatcatgcgtaccggacaccggatatccagactgaatatggggtggggttgatgcctggctggaaagacacggacaacaatggttctgtatgggatccttttcagttcaaactcgatgataaaggagaccggacactaataggcgcaggcagttatggatggggacctaaatacgatggtcagccgatccgcaactatgatggtacctggaccaattattcgccccataaaaacaacatgctggatttgtatcaattggggctgaactccaatacgaatgtggctattcgcggtggcaatgataaaacatcgtattacacttctctttcttataagaaagcaagatctaccagcgaaaagaatacatttgagcgttattcgtttttattgaagggttcgcataaaatcagtgatcgggtggaagtttcggctgctatgagtttcaccaactcaaatccgaagaattctccgcgaacagtaggagagcgtttcgtcaatccgaacggaaccattatgactccgatgctggatgtgaattatttccgcgataaatatctgggtgagcatggtggactggcatctacaagttatggtgacaagtatggttcagttccgggacgtgatttgttttttatgatcgataaatacgattattcccagaaagagactgtggttcgtccccaaatggaagtgaatgtgcagattctggattggctgagatttaaagccgatgccaatatgaattactattacactaagtttgaagaaaaacaactgggtagtggatatgcaaatgaaggcggtaagtatacaatggggcaaaccacaaaagagcaggctacctttggcggaacatttactgtcaataagcagatacaagatttcagtgtaggtggtttcgcgcgatatgaatactatacaagtcgttcggaagcatataaagtatatacagatggcggtatggtagtaccaggacaatggtttgtcgacaactcaaagaaccctaaaaagtcggaagcgagcatttcaaatacaaagagaatgatgtctgctgtctttgctttgaatctgggatggaaaaatcaggtttatttagatgtaacaggacgtaatgactggtcgtcttctttggtatatcaaaacgggatgggtacatattcttacttctacccgtcagtatccggttcatggctgctcaatgaaacattcgatttgccgcattggattacatttgctaaagtacgcggatcgtgggcacaggtcggtaacgataccgatccctattatgtgaactcggtatatggctttgaaactaaagaaatgtatgatggcaatatctatgtgaacactctcgataagacaatgaagagtttgaagctgaaaccggagcgtaagaatgcctgggaagttggtttggatttacgtttgtttgacagcagtttgacactttga

SEQ ID NO: 1388 - DNA, 345 bp, B.fragilis
atatgtatatcagtaccacaattaattgcatgttgcggattagattgcgaaaattgcgatgcccgtatagccactgtccgagatgataatgaattaagagagaaaaccgcccaaaagtggagcataatgaacaatgcaccggaaattacaccggcaaccataaattgtatggggtgtcgcacggacggagcgaaatttgcgtattgcaatgactattgtccaattcgaaaatgtgtaaatgagaagggatataatacctgtggtgattgtaaggaactggatgattgtcagatagtaggtgctatttttcagcatgcccctgatgcgaaagaaaatcttctatga

SEQ ID NO: 1389 - DNA, 966 bp, B.fragilis
attgtaacatcattaaaattggaggacagacttatgaaagacccgttcaaacttaatgttaaatcaatcatggctctttacgaactattccctacggaagaagcctgtatcaaacatcttgaggccattaattggcatgacaaacctgtttcaccatttgacaagacctccagagtttataaattgaaaagcggcaaatatcgctgtaagaatacaggtaagaactttaccgttcgcacaggtacgatgtttgaaaagacaaagataagtttgcgtaaatggtttatcgctatttggcttgttaccaatcacaaaataggtctttcttcctaccaactcgcaaatgatatagaagtcacgcaaaagacagcatggtatatgttgcataaaatacgtcatgcaatgcgtcttgctaatgaaaacatcttggaagaggcagtagaaatagatgaaacggttgtcggaggtaaaaatgggaatcgtcataaggataagaaagtccctcactcgcaaggacgttcacacaaggataaatttccagtcgtgggaatgatacagcgagaaaatctaatgaatgcccgagcaacccctgatacgaaatctgacactctgtccgcattcattaaggaatacatacatccggatgcaatcatttatacggatgagtacaatgcttacgaccaaatagggttcagttatactcgtttctatgtcgaccacagcaagaagttatatagttatgaccacataacgacaaacagaatagagggtgcttggacgcatttcaaacgtatggttaaaggtacatacagaactctgcttaaaaagtatttgcagaaatacgttgacgagttcgtgtataggtataatctgagggacatcagcaattccgacagacttaactgtttcctttgttgcgctgacacacgttatacatacaagcaaatcagaaaatcagcggcttaa

SEQ ID NO: 1390 - DNA, 183 bp, B.fragilis
agaacacaatcttttaaaaaaacaaaacgcacgaatcatgctattgcaaaatccatgcgtttttattctattccaatctttcaggccggaaaaaatcgtttctccgcattttcaaaatacaaaatgacaaatcgattacttatccgttattccactcatgattttcaatgctgcattcaataa

SEQ ID NO: 1391 - DNA, 417 bp, B.fragilis
ccaacaagatcacacacaatgaaactccggaaaccctttcgcattctgcgcaatctgatcctttttttctttatctcctcgatcggtgccgtcattttctatcgattcgtgccggtatatgtcactccacttatgattatccgctctgtccagcaactcgtttcgggagaaaaagtggtatgcaagcatacgtgggtaccatttgataaaatctctcccagcctgcccatggcggtgattgcttcggaggataaccgctttgcctctcacaacggattcgacatgatagaaatcaaaaaagcgatgaaggaaaacgaaacccggaaaaaagaaacggggtgccagtaccatcagccagcagacagcgaaaaacgtctttctttggccacaatcttcgtggatacgaaaaggatttga

SEQ ID NO: 1392 - DNA, 1002 bp, B.fragilis
gagtccccgtcaacaccctgcagttgcttatcaagaagatcaacgaggaatatgtattgtaaaccgcataggccgggaaacactccgcaggtaccagataacaagggaaaatgcacccggctggtagactacctgagtaaggagtcccaggtcgagcgtccctattatgacaattttttctcacagcaaaaagattatgttatacccctgactgtcaagaatcatatagacaacaaccacaggaccctgaaaagcaacgatgacaaattctatatgctttccatcaatcccagcggtgacgaacagagacatctgatagaaagggtgaccggacggaaggtcggggagttctcggaactgactcccggggagcaggagagtgtgctggcacagatgaagaaattcacccgcgaatgtatggatgaatatgcccgtaacttctaccgtgagaaaataaaatcaggggatgacctggtctggtacggccgcgtggaaacggaacgccactataagaatgatgatccggaggttaaggccggcagggcaaaggcgggagataagaagcccgggctccagcttcatgtgcatgtgatcgtttcccgcatggacaggacgcagaccgtatcactctccccgctatcaaaaagcaggggaaaccgacaggtacttgaaggcagggaagtcgtggtaggttttgaccgttcccaatggtcctcccggtgcgcttcacgcttcaatcagttgtatgattatttccctaattactattccagggatgaaagtttgaggaagtactccgagaactggcaggccaaaaacgaactgaagaacgaggcggtatcaaagctcaaacaggaagttctcaaaggggagctgaaggaagaaaggcggctgtatgcaaacaccttccggatttaccggtttgtggtaaatcccaggaaggcaattattcaggaacttaaaaggctggggacggatcttctttccggaagggatctgtag

SEQ ID NO: 1393 - DNA, 969 bp, B.fragilis
acggccactccgtacaaaaataaagactggcagtgggatgtcgcaatgacatatacaaagaataaaaatactattatctcattacatgaaaatgtagcagactacatcgcattgagcggctatgctaatgattacgattaccatatcggttcggttgccaaagtaggtggcgactacggattattgatgtccgacattcttccggctaaaaatgaaaaaggagaaacattgttggagtgggacgacagttggcggggagcttacgaagcacgtagcggaaaagtacaggaagtgggtaaaatgactcccgactttttaggctctttatctactactctgtcttggaaaaatttgagcctgcatattgctactgacatgcgttttggaggattggtagcttcttactctaacttgtatggtacacaggccggatggatcaagagttctttaaaatggcgtgatcccgaacatggtggtttgtcttggaccagccagtacggtgacagtaaaggaatctcttatggcgatggtgttatccccgacggagtatttaagaatggtacgttcgcaacacttgtagacggaacgaaaatggatgtaagcggtatgtcctacaaacagttggtggcagaagggaaactggaacccacacatgccggaacttatcatgtaaaccgtgcggcctggggacagaatacgatattcgacacttgggtacacgagttgaactatattgctttgcgcgagatcaccttatcgtatcgcttcccgaaatcagtggcaagtaagtttggtgctcagggattgggattgagcttctctgcacgtaatctgggatatctgtataactcgttgcctaaccatctgaatcctgagagtgttcgtggtaatacggcttctgagttccgtatccgtggctatgaaccttacacagctaattatatgatgactattaatgtagatttctaa

SEQ ID NO: 1394 - DNA, 867 bp, B.fragilis
gaattatatccagatatcatgaatcgaatcgaaaaaaacaagacccaaaccgatcaggcgtggaacaaattacacaatcgcctggagacagacggactgttaccaacggtgacagaacgtcgttttgccacacgtccgaccgtatggatcggcatagcagccattgcagctattataagcctatgtgtttacctgcctacggtgttacggaccgaccgccatctttccggcggtgaactattggtcaaagcaaacaaagaagagagcatactggtcaccacgcttgaggatggttccgttgtctatctgtcagagcagacttcactggaatatcccaaacatttttctaaaaaaagaagagaagtgagtttgaaaggaaacgccctttttgacatagcgggcaatcgtgcacgtcctttcttcatcgaaaccggaaaagtacagatcgaggtgataggtaccgcctttcatgtgagaaacagtggcaactctccatttgaattagcagttcagagaggtgaggtaaaagttactcaaaagcagaatggccaggaaatacatgtcaaggccggagagaccgctactttattgggcgatgaatggcagttgactgtgaccgagaattccgaacagtttacccgatacatgcaaaatatgcgtttcaaagacgaacagttggatcacatcctgcatgccatcaaccttcgccagacggaaatacatctgcaaagttccccggaactggggaaacatgtactgacggtttcgttctcagaggattctcctgagaaaatggccgagctaatcggccttgcactgaacctgaagtgcacacgcaatcaaaacataatcaccctctccgagtaa

SEQ ID NO: 1395 - DNA, 447 bp, B.fragilis
gcacttttcccattagcaccatctttaccgttagcgccgtcttttccagcagccccgtccttaccgttaataccatcttttccgttggcaccatcctttccattggcaccatccttaccgttaatgccatccttaccattggcaccatctttaccatatgcacgaataccggtatctttcccattaatataccagttcccattggtaccgattattacctctggcgatcttccatctttacctatcgcagcctttccggtatcttttccattgattacccaatttccattttctccaattgtaacagtaggtgttgttcctgcaactccttcttcacctctggaaggttttcctgtatctactccatcaatcaaccaattaccattatccccgatcgtaactaccggtggaacagcatcttctccattctgtccatccctaccctga

SEQ ID NO: 1396 - DNA, 291 bp, B.fragilis
tatggcccgtttgagggtcttctccgtcccggtgaacaccgtgcggaatggtttccggtcttcggtcagctcctgttcgacgccacggttgtaaacagcacggagtatgcgcatgtaaaaggatatggagttcggcacaatccctgttgcagtcaggtacgcctgataatcttccatgagtatatggtctatcgagccaatgtaaatgtccctgttatcccggaattgtttgaaactgccaagcgcagcattatagttcttggcggtgccggagtggttcaattgccgtag

SEQ ID NO: 1397 - DNA, 1401 bp, B.fragilis
ggattgcagccggaagaaagtcgtatctttgccactcatttcttattaaataatatcatgcaaggaatcaagaatctgactcaaggtcctatcaataaacaattgtttaacctggcgatgcccattatggccacctcgtttatccaaatggcatatagcctgacagatatggcttgggtagggcgtttggggagtgaagccgtcgccgccgtcggttcggtaggcatcctgacttggatgtcgggttccatttccttactgaacaaagtaggttccgaggtcagtgtaggtcagtccatcggagcacaaaatcatgaagatgcccgtaatttcgcctcacacaacattactatcgcccttattatttcactttgctggggtggactgcttttcctgcttgcacgtcccatcatcggtatctacgaactggaagcacatatcaccgaaaatgcaatcgcttatctgcgcataatctctaccggattacctttcatttttctttcggcagcctttaccggtatttataatgccgccggaagaagtaagataccattctacatcagtggtaccggattggtattgaatatcctcctcgatccccttttcatcttcggtttcgggctgggtaccaacggagcagcctatgctacttggatttcgcaagcagcagtattcggcatttttatctatcaattacgttgcagagacgctttactgggacgattctatttctttacccggttaaagaaaaaatatacccatcgtatccttaaattaggtttaccggtagctacccttaacaccttgtttgctttcgtcaatatgttcctttgccgtacagcatccgaacaaggagggcacatcggattgatgacctttaccaccggagggcaaattgaggctatcacctggaatacatcacaaggattctctactgccttaagcgcattcattgcccagaactatgcagccggacgaacagaccgtgtgatcaaatcgtggcatatgactttgttgatgacttcaattttcggtacgctctgcaccctgctttttgtatttttcggaaacgaaatctttgctctctttgtacccgaacaggccgcttatgaagcaggaggcgtgtttctccgcatcgacggttattcacaactctttatgatgctcgagatcacgacacaaggtgtattctacggtatcggacgcaccattccacctgccattatcagcatcacctgcaactacatgcgtattccgctcgccattctgtttgtccgcatgggcatgggagtagaaggtatctggtgggctgtttgcgtcactactgttgccaaagggcttattctggccggttggtttgcattgattaaacggaaagtgttgtcgcgcccgatactctga

SEQ ID NO: 1398 - DNA, 237 bp, B.fragilis
ttaccttctactacgcatgatatagatacgcacatgatcaccgccacaatggaaggtaatgctgcagcacaggactttctctcacatctccctctgaaagcgacattaccctttataccccgtggagtagcgttgcaattttctgctttccttactcctacgcatctatcttccgaaaagttcgttgcagtcgtactcatgaccaattcctttgttacggtctgcgaatggcagtaa

SEQ ID NO: 1399 - DNA, 1206 bp, B.fragilis
agtatggctacagtaaaagcaaaattccgcccctcgacggtcaaagaccgtccgggcactatcgtctatgttgtaattcaccgacgtaccgtcagacagatcacgaccggttacaaggtgttcccccatgaatgggacgaagaacgctccaagccggttctggccgacaatgtcaggcggacgaccgtcatgcagtcgataactcggaagctgcaatcggatatgaaacggctgtacaaaatcatagagcgttttgacaagcagtgccgcagttattcatcggatgatgtggtggcggagttccggcattccgaagagggggacagctttttcaatttcatggagggtgtcatcgaacggctacggcaattgaaccactccggcaccgccaagaactataatgctgcgcttggcagtttcaaacaattccgggataacagggacatttacattggctcgatagaccatatactcatggaagattatcaggcgtacctgactgcaacagggattgtgccgaactccatatccttttacatgcgcatactccgtgctgtttacaaccgtggcgtcgaacaggagctgaccgaagaccggaaaccattccgcacggtgttcaccgggacggagaagaccctcaaacgggccatatcaatcaatgacatcaggcggatcagaaaccttgacctctcgctaaaaccaggccttgaatttgcccgtgacctcttcctttttcttttcctctgcagggggatgtcattcatagacgcggcgttcctgaagaaggccgacatccagaacggcgtgctgacctaccgccgccacaagaccggccagctgctgcacataaaggtcatcaaacagatagaggaaatagttgaccgccactcggacaaggaatcgccgtacctgtttccggtcataacccgccccggagagaacgagcgcaagcagtatgagacggcgttgcaccacgtaaacaaatcccttaaaatcatagccggaatgataaagctgcccgttgcgctcacaacgtacactacccgccatgcttgggcgaccatcgccaagtcgaagaacgtaccggtcaatgtcatctcggacgcgctcgggcatgattccattaccaccacgcagatatatctcgcttcgattgacgtttccgttatcgacaaggcgaatgaactgattattaaagatctgtag

SEQ ID NO: 1400 - DNA, 582 bp, B.fragilis
cgaactctaactcccgatatatcccccaatatgctgaacgacgtatttatacttactcaaataaaagaaggcaatataaaggcgtttgaaacattattccgccaatattatactccgcttcgcctatacgccgccagcataacgggtgaaccggacgtagccgaagaaatcgtcgaagaattgttctatgtattctggaaggatcgggaaaaacttgagatttttcattctgtcaagaactatctctatcggtctgtacgtaaccgctctatccagtattgcgaacatcaggatgtcagaaggcgctatcaggatgcgattttatccgttccggtaaatatagcttcacccgatccgcaagagcagattgagtacaaagaactgcaacaaattataaaccgaactcttgagaaactaccggagcgccgtttgcatatcttccgactacaccacacagaaggaaaaaagtattcggaaatagcctctctcctctcactatcggtaaaaacagtagagaaagaaatgacccgggcactccggactttacgaaaagaaattgagaattatatccagatatcatga

SEQ ID NO: 1401 - DNA, 282 bp, B.fragilis
agaaaggcaacgccatatactattgacacggacggcgggagccgctgccttttcatttccgaaaaggtcatggaagtgtttgacgacgggttcgattaccgggaggtggcgaaccataaagagctgacagatcttaccgtggccttgtttgcagggatgatatctgcacagcctccccggacggcggcgatggaagttccagtggcctgccttagggaagacgcgaggacggggacgaacgggaatgggcacgccgttgcacccgtgaagcggaaagggtga

SEQ ID NO: 1402 - DNA, 891 bp, B.fragilis
atagcagaaacaatggaaatattttctttaaaggagcatgtctcctgctacaattatgcaaaatgcatccgggaagggttttcatattacgaaagttctaaaacagaaacggacgaaggacctcatgaaaccgattgtattttgtttgtaatggaaggagaactggaactgtcctgtaacggggaaagaataaaactcccggccggtaatatgatttgttgcagtagggaaagcatgtacagggtattctcacaaggaaaaatgagtattgtgattgcacaatttgataatgccgtgcaaagttgtgaaaaggtttcattttcacaacttaacagcctgaactcctcgggtgaaaaaggaatatatcctcttgaaatcagagacaggttacaattgtttctcaaacttttaataggttatttgggagacggagcaagttgcgttcattttcatgaaacaaagcttaaagaactgttctggaacatacggttttattatacaagaacggaacaggcctcctttttccgtcctatattggggaatgaccacgaattcaaaaagaaagtgcttgataattatagaaatgccaggacagtaaaggagcttgcccagatgtgcgaaagttctctttctacttttaaaaggaagttttttaaagagttcagagagcctgcaagcgagtggttacagaaacaaatgaatagtataattaaatataaattggctgatgaggatataccgataaggaatatagccgatgaactgcatttttcttcacaacctcaattttgcaggtactgcaaacgaaactttggatacactcccggagaatggagaaaactgctgaaaaatagagataaaactccaagaagaccctccggcagagtataa

SEQ ID NO: 1403 - DNA, 372 bp, B.fragilis
ccctacagaacaagacagtccttgcaacagatcgagtgtagattgatgataaaatgcgatcccttgtgtgggaattccactattagtaaggtgtcgggtggtatctgtaaaacgactaaggtcaactttcctgtttatggtctgtcggaaaacaaacgcacccgttatccaatgatagcggctcttattgaccgatttaatcgtaaattcctggcaatacatatgttgccgtatcttattttgaccatagaatatattgcgaggcgagaaatcttgatcgattcccatcttgtcctgtatatattgataggatgtttggctgttgaagctgatatgggggccgttataccgtatgttgattccggaggttag

SEQ ID NO: 1404 - DNA, 489 bp, B.fragilis
ataattatgaccagcaaggattttatagaagctgaagcaggtaataacggaagtatcattctttatcgtgaggggcttttttggaaagcttatgaaaagtctgcttacgctgtctgtacgcagatcaagcctttgaaggctataaaaagaaggttaaagtcactcggtggcggtgagatagtttcagtgggatttccatgtaagcatgaacaaaagtatataggttctttggagcatatggagactatgcctgaccgtcttgtgttgcgaacgctaaaacctatagacggacagaggtttgaagaatggaaacaggaactttcatcggagcattcagttgtagggaggagagatgcgtgtgtgcagaatctgtcacggagtaatattccgcatggagagttaatcatgcgaatccggatgttcaatctggcggaaagtactccgatggattgtatgttatttgtaaatgagttgaaaaagatgctctaa

SEQ ID NO: 1405 - DNA, 192 bp, B.fragilis
gctgtcattgctttttgtaaaatagaaacaattataaaaatctcgtatcttcaggttacaggggaagaagtctatagaagcctgtctacatatcctcacggacttgttggcttagtagatgagccaaattggatacaaaagttcagagacttctgttgtttatataattacaaaaaccatgccatattttaa

SEQ ID NO: 1406 - DNA, 1287 bp, B.fragilis
tgttttgttgctttcatgcgatttttgcaacctttttcatacaaacagttaatttatataatcatttgtaattcatttatagttatggcaacagtaaaaacggtattagtaaaggggcggtgtaatagtcgcggggcctatccattggctgtgcaggtccttcataaacggaagaaaaaagtcttttatacgggatacagtattgagccctgtcagtttgattccattagcggacgggtaatctttaatggtatgtatacaatggaaactatccggcgcatgaaccgcgtgtgtaggaaaattagtaaagtcttggacaaggctattgacatattggaaaagggggatagtgaatatacgacatgtgacatatccagaatctatgaaaccctgacaggaaaggtgggtttttatagctatttccaagagagaatccgtgtgcttttcgataccggacatgaggggacggcaaaagcatatgagtcgaccctgcattccatgcaaagacatttgtgtgagagtgattttccatttccccatctttcttcccgtcttgtcattaagtatcgtgacgctctgcaggaagccggtgtaggcaagaatacgataggcttttatctacataatatgaaggcagtgtataggagaggatgtcttgaattgaatctggtattcccttcaccttttagtgatattagaatccggtctgaaaagactgtcaaacaaagccttcctatgaatcaggtaaggtctcttgcccgtctgtctctttcggccggaacaccggaatgcttggccagagatatcttcatattcagtatctatacccgtgggatgtcgttcgtggatattgccctgctgaaaaagagcgatgtttttcccggagtaattcgctatagaaggcacaaaacgggtcagttgcttgaaataggtattaaccggcagatacagagtttgctggacaggtatggagatactgccggtaactaccttttccccctggttgacgagtcggaaactccttattcgggttataaaaaagcttataataagatgagatatgcactgaagaaggtttcaaagagtatcggtatgaaccctcctttacgtctgcatgccgcccgtcactgttgggcaacgatggcccgcgaaaacggtactcctctccataccatcagtgaatgtttggggcattcttcggagaaaatgaccagaatctatctgaaggaacttgaccggtcggtactggacgaagtgaacaatcacatagcagataatatatgttaa

SEQ ID NO: 1407 - DNA, 1572 bp, B.fragilis
acagatactgcaatggaaataaggaaacaatattttaaggagaaacaatatatgtggcataaagtaagggagcttcagttgaaaggactgaacaaaacacaaattggaatatatctgggtgtgaaccgtaagactgtacgacggtatctgaatatgactatggaggagtttgttaaaaaacaaagttctcaccgcaagtacaggctgaaactggaaaactacgagcaatatgtacgtgcaaacctggaagaatacccgtatatatcggccgccaggatacatgactggctaaaggaatgctatccggacttcccccgtgtatgtaacagaaccgtatccggtttcgtggaaagggtacgcaaaaaatacggcatcgggaaaaaggttgaaacgcacaagcgaaactacgagaagcagcctgatactccctacggggaatacgcacaggcggattttggggagaaatggatgcgcactgaaaacgggaagtccatcaaagtgtacttctttgctattgtcctgtcccgttcacgatataaatttatctattttagccggaggccctttgacaccgggcttgcggtttatgcccatgaacttgccttcgaatacttcggaggcaggccgcaaaagatcatttacgaccaggataaagtacttatagcacgggcgaacatgggggatttgatactgaccggcaaatttcaggcatttgtaaaagagcagcatttccatcccgtgttctgtcacaaggccgatccggaatcaaaggggaaggtagagaatgttgtgaaatatgtgaagacgaatttcctcacggcgcgtatttttcagaatgtagacagacttaatgaagaagcacgtctctggcttgaaagaacgggaaacgggaaggaacatggtaccacacaccggattccccttgaggaatttgcacaggaaagagaataccttgtaccctatcacggtactccgcactcacccggtggagaaatgaaggaatatcatgtacgtaaagacaataccgtacagtacaggggaaactactatagcctgccatgcggaacctatcggggaggagaaacgacagtatggctccatgaaacagacggatgcctggagctttataataaggagacgggaaagcttgtctgccggcatgatctgtgcgaactcaagggaaagactatctatggtgaaggacacagaaggcaaagaaatatcggagcacaaaagctggctgaacgcattcttatctatgtatcgtacaatagagaggtcgccttatggcttgagaacctgcagagaaggaaggaacgttattacagggagaatctggaggtaattctacgcataattcccggatatgacaaagccatcctgacagaagcggttagtgtatgtctggacaagggaatctataatggtgagtccgttaaaagcctgtgcggacatatatggaagaagaaaatgggagaatcggatgtaggaaaaaatcctgcctcccggacacagtcaaccggattggtaaaaacatataatgaaatctttagaaacaatggcaaggtataa

SEQ ID NO: 1408 - DNA, 1437 bp, B.fragilis
caaactgatgctccactctccacactcatattcaaaacctttataacaatgaaccagacagtaacagaaaatcatcgtttgcgagataccatcatcatcggtgcaggtctaacaggtctgactaccgcctattgccttacccgtaagggatgtgatatcgaggtaattgaacagagcccctgcgtaggcggccagatacgtacctaccacgaaaatggttttacgtttgaaagtgggcccaataccggtgtaatctcccaccctgaagtagccgaactcttggcggaactatcccccacctgccgtttagaaacggcccgtgaagcgtccaggcaacgccttatatggaaaggagatcgctttcattctctcccctcaggactgttcagtgcaatcaccaccccattattcagtacaaaagataaattcaatatactgggtgaacccttccgtgcaaaaggaaacaatcccgatgaaacgattggtgaactggtacagcggcgcctgggtatctcttatctacattatgcagtagacccattcatttccggggtttatgccggtgaccctatgcgattggttacccgtcatgccctgcctaaactttatcaactagaacaaacttatggcagtttcattctcggtggtattgcaaaatcattttcacatcgaagtgaacacgaccggttggctacacgaaaagttttctctacttatgggggacttagtaacctgacaaaagcattggaacaggccattggaatcaaacgattctccctgggagctacttccacttccctaatgccatgtgaacaaggatgggtagtttctttcacagattcctgtggaatagttaaccgaatccactgccgaaaggtgataaccaccacacctgcctttgtcctcccttcacttcttcctttcgtccctgacaaacagatgaatcggataagtaatcttacctatgcccctgtgatgcaagtctccgtgggattgcgtaatacttatggaaaagagtttcatgcctttggcggattggtcccttcctgtgaacaaaaaccagttttaggtattctgtttccatcagcctgtttcgataaccgttcccccgaaggaggtgcattatattcatacttcttaggcgggacgagacaccctgaacttctagagaaaagtgacgacgaaattatcaggttgataaccaccggcctgaatgaaatgttagattatcctgccggaatagtacctgatcttatacgtatcttccggcataagaaagccattccccaatacgaaagcagcagtaccgacagatttgctgcgatcaatgaactgcaaaaacagtatcccggattggtggtagcaggaaatctcaaaggaggaatcggcatggccgaccgcatcaaacaggctgttgaaatcgcccgagaaagatga

SEQ ID NO: 1409 - DNA, 474 bp, B.fragilis
gggacatcagcaattccgacagacttaactgtttcctttgttgcgctgacacacgttatacatacaagcaaatcagaaaatcagcggcttaagatgaaaagaagaaaagaacctacggagttcagacttggaacaatcattgttccctatattgaaatgttcgatgaagcagtagccataaggacggatggggtacggcttatcattgatacctattttaacgacctgtctattgatgacattccccagcaatatgtgttcacttggaactggctcggtaaaggttacaagtttaccgtcataaatcacctctataaatcgtctaaagcgaaaactaaacgaggctttaagaagttactcgcagaggcattgccattgcttatagaccctaaaaacggactaataaaaaagccggaacttagtccggctgatttaaataggtttaatactgtgctgaagacttgttcaaagtga

SEQ ID NO: 1410 - DNA, 267 bp, B.fragilis
gaacttttttatcgagatatctatctattgcttacttcatgtcagttgataaaccaaaatccgtttacttatgaattgcttgtgccgattcttcatcaagatacttttgtacaaatggtattgcgaggcatcacttacctccccctgctgatactggtcatggtggtcatggatgggctgttatgtattatcggtttactgccattcgcagaccgtaacaaaggaattggtcatgagtacgactgcaacgaacttttcggaagatag

SEQ ID NO: 1411 - DNA, 189 bp, B.fragilis
aatcttctctatggcttcactcaactctttttcaggaggaattacattgaaatcttcccaaaagcttttgtcgtatacaaatggaatttccgcaaagatggtatgtacggacaaccgctcattatggtcgaaacggctgacattatccgtttctatcttgcaggtgaccatttcaaaccatgtatgtag

SEQ ID NO: 1412 - DNA, 204 bp, B.fragilis
aattacaatctacagggtcagcgggcacaggatgtagaagcagtgtttggcaatctcaaaacaacaaacaatccaagaaggttttatcttcgtagagtggagaaggttgatattgagttcggattgctggccatagcatataatcttgcaaaagtagcctcttcgacaactttttgtgcccccaaagacatactgaaagggtaa

SEQ ID NO: 1413 - DNA, 1584 bp, B.fragilis
tcccggaatcaaaacccaaaaacaatgaaagcctcgaaaagtctctgcctacaatgcctgttcacctgtctgctattattcatagcagcccgggtaaaggcggatgactccggtatactcgatcgtatcatccggttaccgaaaagtgaaatgaccgtttataaactactttctaaaataacggaagagacaggatacctgttcatctacgacagcaaactggttgacaatgaacgtacggtaaagttgaaaggtggaaaacagaccgtacgccaagccatttacagtataattggtaatgacaaccttaaactacgttcggtagacaaacacatcatcatttatcgaccggaaacggcattaagtataagtaaggaagaaggtttatgcagagacagcacactctcattcactcttgaaggaacattaatagaccaactatccagagagccgatcccctatgctaccgtaggtgccgagggttcctccatcggtagtgtcaccaatcaaaacgggagtttcaggcttcatctgcccgattccctccgaaacggccggattcgcttttcacatctgggctacgtaccgcaaaccacggatgcatccctacttgccggacgaaacggaacttttgctctggagcctaaggtaattcccctgcaagaggttattgtacgcattgtcaatccggtgcgtctattgagagagatgctgcaattcagaaaaaagaattattccaaagtccctgtctatctgacctctttctatagggaaggtatcgagcaaaagaaccggtttgtcagcctgactgagggaatattcaagatatataaggcttcgtcaagtaccccggaaaagaccgaccaggtaaagttgttgaaaatgcgccgtatcactaaccaagctgtaaaggataccttaattgctaaaatgaaatcgggtattcatgccagcatcgagttagacctaatcaaaagtttgccggattttctgcttccggactccaaagaatgtgtctatgtctacacttccagcgaccttgctattatcgataaccggcttgcccatgtagtctcctttgaacagcgtccaagtatcaagtatccctattattgcggtgaactctacatcgactcggaaaacagcgccctgcttcgggcacgattcgagttgactccgcggtatatacataaagcagccaacatgctggttgagaaaagaagccgcaacatccggattattccccaaaaggtggtttataccgtatcctataaaccttggaaacagacatattacatccaccatgtacgcggagacttacactttaaaataaaacaaaagaacaaatggctcaacaataccatcctacatacatggtttgaaatggtcacctgcaagatagaaacggataatgtcagccgtttcgaccataatgagcggttgtccgtacataccatctttgcggaaattccatttgtatacgacaaaagcttttgggaagatttcaatgtaattcctcctgaaaaagagttgagtgaagccatagagaagatttcatcgaaaatcgaagagacagaaaattaa

SEQ ID NO: 1414 - DNA, 564 bp, B.fragilis
aaaataaaacaccttattactatgatcgtacaggatttaaattttgatcaaacagtcgccatggcaaaagccaaagcggaaagcatgatacaaaacggactttattcacgtttcgggttatccgaaaaagagagactggacaaagcccttctaggctgtatcggagagttggcattccaaaaacacctgaaaaatctgggaatcccattcgaattggaccagacagatttccaatcccatcactccgatgaatttgacgtaaaagtaaacggtgccaaaattgatatcaaagtagcaaagaaaacaactgccaaccctccaaccgacaattggacctatggttatccacaagagcagcaccccgaaaccaaagattacgtcgttgtaggttgggtagacttcaacagaaaagaagttggcttttatggttggatcagaggaaagcaaatagtggaatttaaagttgtcacccaaaattcttatgccaagtatccctatctgacacctaaccatgaattcaaatggggatgtctcaccaaggatttgaatgagattttgaagtaa

SEQ ID NO: 1415 - DNA, 1305 bp, B.fragilis
ataaccatgcatatgtttaagaagcttttaatattgctgctgtccttattggattgtatacctgttttctgcggtggtgacaccctgcattatcgtttctacttccgcgtaggtgcttcctctctggatctttcctatcgggataacggtttacgcctggactctcttctttctgttattcactctcggcaggcacacgccgtactgcgtcgtgtaagtctatactccagtgcctctcctgaaggaggttctgctttaaacaaacgcttgtctgatagacgtcttgcatccttacgcactgtcattcagcatcgtcttgccattcctgattctatacttatatccttctctttaggagaagactgggacggtctttcctctcttgttgaagggtctgacattccctaccgtggggaagttctccgtatccttcgtgatactcccgtatgggtcatccggaacggtatcgtcgtggactcccgtaaacggcagttgatgaatctgcgtggcgggcgtgtatggcgttatatgcatgaacatttctttcccgaacttcgtaacagttccgtgatcgaatgtgagttcgagccttttgttgccgaaaacgatgatgtccctgccccttctcaaaaaggggtgtgtccaccggatactgtaatccttcgtgatacggttgaaagagccattatgatgcgtgatacggtagaggtacccgttcctattgctaatatccccaaacctttctatatgggactcaagacgaatctgctctacgatgcccttctcgtcccgaatatcggcgtggagttctaccttggcaagggctggtcccttggaggtaactggatgtatgcctggtggaacaacgacagacgtcatcgttactggcgtgtgtacggcggcgagatcggcctgcgtaaatatttcgccccccgtgctgcatatacaccttttatcggtcatcacgtcggcctttacggacaaatgttgacctatgatttcgaatttggcgggaaaggctatatgggtggcaggcccggtggttctctctgggaaaaatccaattacggtttcggtctggaatacggttattcccttgccattggcagaaggcttaatctcgacttttctttgggcgtgggttatttggggggcacttattacgagtatgctcccatggatgggcattacgtgtgggaagcaaccaaaaaccgtcgttggttcggtcccacgaaagcggaggtttcgctcgtgtggcttctgggacgtggcaattataatgataagaaaggaggcagacgatga

SEQ ID NO: 1416 - DNA, 975 bp, B.fragilis
agacacatgcaatacgtcggaatacagacacaacagagccggaacaatctccgttccggtatcttactcattctctttccatgcctggtggcggtattgacttacctgttctgctatctgcttatcacttttaccgtggaagacgattatgggcagtacaatacactggcaatgaccaatcaaatgtttatcaacctgattccttatattataggaggtgttctggtttggtttatcatagcttactttaccaattccagtattatcaaagctgccacaggcgcgcgtccgcttgaacgtaaagagaataaacgtatctacaatttggtagagaatctctgtatgtcgcaaggtatgaaaatgcccaaaatcaacattatcgatgatgattcactaaacgcatacgccagtggaatcaatgaacagacctatacagttaccctatccaaaggtatcattgaaaagcttaacgatgaagaactcgaaggagtcatcgcacatgaactgacacatatccgcaatcatgatgtccggttattgattatctcgattgtatttgtcggtatcttctctatgctggcacaaatagcattgcgttccgtctattactcttcgtggacacgcagtagaaatgataagaataatggagccatacttattctggttttggcaatgattgtagctgccatcggttatttcttcgccactttgatgcgtttcgccatctcacgaaaacgtgaatatatggctgatgcaggtgcagcagaaatgacaaagaacccgttggcgctggccagtgctctaagaaaaatatccgcagatcccgatatagaagctgtagaacgcgaggatgtggcacagttattcattcagcatccgggcaaacaagccaaaagtgccctgagcggattaagcggattattcgccacccatcctcctatcgaaaagcgaatagctatcctggaacaattctaa

SEQ ID NO: 1417 - DNA, 402 bp, B.fragilis
caagaacagcaaaacctattccccgaaaaccaaggcagcaagggcacggtgtggctgtatctggaatccaagagaggcattccccatcttcacggcacgttctgccgtatcgacgaacggggaaatgtcaacaacgaccatgacatacacctgcgagcacagcgggcagccgggcgtgtggccttgaaacggggctggatgaccgccgccgaggtgcgggagacaaacatcgggcatgtgaaccgggattgcatggaacccctgcaatctatgaaaagcaggtcatgggacgagtacgcggccggactccagagcatgggctataaattttgggagccgcgtgacaacaaaaaaatattgcatggttacgtgctgaagaaaggcaacgccatatactattga

SEQ ID NO: 1418 - DNA, 969 bp, B.fragilis
gaaaggaggcagacgatgaatagaatattgactaccaatcatatattacatgttgtcagtgtttttacaattctgttattgacatcttgcgaacataaggatttatgctatgaccattccgatgctactgaaatacaggttgttttcgactggacgaatgctcctgatgccactcctgagaccatgcgcctttacctgttccctgtggggggaggcactccccatacatacgaattccccgattaccgtgggggtcgtattaacgtacctgcaggccgttacaaggccctttgtatcaactccgatacggagtccatactttaccgcaatattgactcgtttgacagtttcgaggcttacgctgcggacggtgtcctgaatgtgaggtcatcttcgtcccctcgtgcggaaggtactgccgatgagcgtatcgccaggtcccctgaccgtttttacagcgcccgtcttgacgatgtcacgattgaactctccaaagagaaccggacggtaaccctctatcccgaaccatcggtatgtcgttgccgggtcacgataacgaatgtgtccaatcttaaatacatctcctctgatggtatctccggtgctctttcgggtatgtgcggagggctgttggtaggtcgcaacgaagctacgtccgatcccgtgaccgtccctttcggggtggtttccgacggtgcctctactctgacggctgatttcctggtttttggacaaatcggtcccagcggctatcccgcacataaattagttatttatgcaatcatgtctgacggcagtaagaattactacacgttcgatgtgacgcgccaggttgatgaagctgctgattcccacgatatccatattacgttggacggacttccttttcctaaacccattgttaacggcggtggttttcatccggcggttgacgagtggcagaatgtcgatgtggatgtttccatgtga

SEQ ID NO: 1419 - DNA, 729 bp, B.fragilis
gaaaggaggcatgaaatgaaaaaggtatatactgtaatggaatacgttcccttgctcgcgggaatgctcatgctgctttcgtcatgcgggcacaaggacttgtgtttcgaccatgacgtgcatgccccgaaatcggaggtgcgcatagaggcacggtacgaaaaggagtggcaatatacccatgagggcagtaccgattggaagagccattccacgtggcctgaatctttcggtatggaatacgacgcgttgcgccccggaataccggatggattgcgcgtacaagtgtacaacgcggatggctcggacgagatcatcaacacagctcccgagggggatgtcgtttatatgcggccaggtgaacactccctgctgttctacaacaactacacggaatacatagtgttccacgagatgcagtcgttcgcttcggctaaggccaccacacgtactcgtacccgttcttcttatcttggcaattcctacatggaaacggcgtctgaaaacactgtgaaccagcccgatatgctttaccgcagttacatggagtcatactgtggcggaacgctcgaccgaaaccgacgtgatacccgtcaccatgcacccgatggtgttcacctatctggtacgttacgagttcagccacggggtggaatacgtgtctctggcacgcggtgccttggctggtatggcgcaggcggtatggttgaacagcggacacacgtctga

SEQ ID NO: 1420 - DNA, 204 bp, B.fragilis
ttgtgggttaattttagtgtctttatctttgccgccgtaaataaacaaacaactaaaccagatttaaggaatacagtttctataaccctaaaaacattagagttttgctttcctttttttcctatccatgcaggcactacaacttttcaaaaagagtcgatatgggtgttaagtaagcaggtaataccgctatccgtagcttga

SEQ ID NO: 1421 - DNA, 651 bp, B.fragilis
tgttttcctaaccggcataaagatatcatcctgttgtatgatgacacatcacttaaaatcggtgtatatttccttatgatctgtctgacgggacatggaacaaagaagatcgggagaaggaaccatgatgggaaaagcggaatctatttcctctcccacgggataaatgacattcaatatatcacgggagaatcgagaaacaagaaacaagaaacaagaaacaagaaacatcccgagcttatcttccatatcatcaaggacaatttgctgccgtccggtctggatgccacgggtatatgggatttcatgcggctgacacaggagaagtccaaaaaggtcaaaaattccgtcattcacatcgaggtcagccgtgcgccggaacacaccaaagactttactatcgacgactggcggcggttgtgggacgacttcatgggtgagttcgacaacatcgaactgcttgacaagaacagcaaaacctattccccgaaaaccaaggcagcaagggcacggtgtggctgtatctggaatccaagagaggcattccccatcttcacggcacgttctgccgtatcgacgaacggggaaatgtcaacaacgaccatgacatacacctgcgagcacagcgggcagccgggcgtgtggccttga

SEQ ID NO: 1422 - DNA, 1296 bp, B.fragilis
agtaaagataacatgcatatgagaggtttaatagtatcagcgttcttgttgctcggatgcatccaggcgttcgggcaagagaaccggaaggaggtctgtatcggattcccggtcggcaactcgacactggacacggcttacggcaacaacgccgcgcgcctgtccgaagtggtgtcgtttctggaaagtgtgaaaaaagacagcacgctcgaattgaccggggtgtctttctgtggttcagcttcgcccgagggcggttttacagtcaacaggatgctggcggaaaaacgccgtaattccttggagcgttatgtacgtgaacgcgtatcgcttccggacggtatcatttcacgtcccgaaggatttatcgcgtgggaacgcctcgcggagctggtcgaagtatccgacatgccccacaaggaagaggcggtggacgtgttgcgcaacgtgcctgaatttacctatggtaataaaggtgtattggttgacagccgcaagaaacatctgatggagctgcaatatggccgtacctggcattacatgcacaagcatttctttgaccggatccggaatgccagtgtcattctcgtgaccgtgcgtcaaaaaccgctaatcgaggagaaaacggttgtcaaggaagaaccggttgtgccgactcccgcagacgacacgacaaccgttgtggagaaagcggatacggtcgtggcagtttcctctgaaacttcaaaacctttctacatggctctcaagaccgacatgctctatgacgtactggccgttcccaatatcggggtggaattttacttgggcaagaactggtcaatcagtggcaactggatgtatggctggtggaaaaagaacagcaaccaccgttattggcgcgtctatggcggtgacctcgccgtgcgttactggctcgggaagaaagcccatgaaaagcctcttacgggacatcatataggcatatacgggcaggcgttcacttacgatttcgagtggggaggcaaaggttacatgggcggtgaacccggcggaatgctctgggacaagacgaattacgcggctggcgtggaatacggttactcgctgcccattgcaaaccgcctgaatatcgactttacgcttggcgtgggctactggggaggaaaatactacgagtacgtccccttggacagccactatgtatggcaggccactaaaaaccggcactggttcggcccgacgaaagcggaaatctctttggtatggcttctcggaagaggcaacagcaataataagaaaggaggcatgaaatga

SEQ ID NO: 1423 - DNA, 594 bp, B.fragilis
tatcaatgtaaaaatagaaaagaaataaatatgacgatcagagaatttaaagagcacgtaaaaacaaggaaactccttgatacagaagaaatccatcaattcatggacatcatgagtaacgaagcgagacgtatcacatttcaactcaacacgacatatcatacgcccaacgaggtacgagaactgctttcagaactgttcggttatcgtgttccctcttcatttcgtgtatttcctccgttttacacggatttcggtaagaacattactattggcgaagatgtgtttatcaatgcctgctgccactttcaagatcatggtgggattacaatcggtgacggttgtcagatcgggcataatgtagttttcgccacactcaaccacggactgctacccgaagaacgcaagtccacccaacccgccccaatcgtactcggcaagaacgtgtgggtaggctccaatgccaccattcttcaaggagtaagcatcgggaacaatgccattgtcgcagcgggagcagtagtaaccaaagatgtcccgtctgataccgtcgtcggtggagtgccggcaaagtttatcaaaacaatccgataa

SEQ ID NO: 1424 - DNA, 267 bp, B.fragilis
attaagaacaaaaaaattaatggaatgaatatgaataagaagatgtatatattgccgggggatgagcgcatagcagcctccgatgccaaagagtttgtacatgaacttcggacgggcagttggatggattccaactgcacagatgaacagtacatgtgcaattttgccgaacgttacgtgattcaggcaggtgtgaggattgccactgatacaccggagaatttccttgccgatttgattcggacaggatacgccaaagagatgtaa

SEQ ID NO: 1425 - DNA, 2073 bp, B.fragilis
aatatgataaaaagattatttttcctcctacctttctctacgatagtctcggccaatgagcccgatacaatacaggttaagcgtatcgatctggatgaagttacaatagtagcttttaaacaaaacacacctaatcgtgagccactttctatctctaccttagataatcgcttcctgaaagagaatgaaatatcgggagctaaagacttaagttccttacttcctaatttctatatgcccgattatgggtccaagcagaattctccggtttatattcgggggataggagccaaaaaggatgctccatcagtaggcttttacgtagatggcattccctattttgaaacgtccgctttcgatattgacttgtcggatataagtagtatagaagtacttcgcggaccgcaaggcacactctacggacgtaattctattggtggaaccatcaatgtatatacccattcgcccctcgattatcaaggtacgtatttccggttgggatatggcagttacaatgatatgcgattaatagcttcgaactatacaaaggtgaacgagcagttaggtttatcctttagcggtaattatcatcacaatgatggcttttttaccaatttgcatacccataaaaaggcagataaacttgataacggagccggacgaatcgggctcacatggaaacccgcagcccattggactacccgcttcataacctcctacgaatattccaatcaaggaggatatccatacggattgtataatgccgacaagggaacaacagaagccgtaaactacaacaatgaaggattataccgacgaaatctgctaacctccggaatcaacatacggtataacggcccccatatcagcttcaacagccaaacatcctatcaatatatacaggacaagatgggaatcgatcaagatttctcgcctcgcaatatattctatggtcaaaataagatacggcaacatatgtattgccaggaatttacgattaaatcggtcaataagagccgctatcattggataacgggtgcgtttgttttccgacagaccataaacaggaaagttgaccttagtcgttttacagataccacccgacaccttactaatagtggaattcccacacaagggatcgcattttatcatcaatctacactcgatctgttgcaaggactgtcttgttctgtagggttacgttacgattatgaacacgcccgatgcgatttttccaaagtacagcagccattaaatggaaatggggaaacaaaatcgcttgaacaattcaaccgatcgcttcacttcgggcagtttactcctaggttcagtatgcagtacctttcttctcacaatcaattgttctatgcctccgtatccaaaggatataaagccggaggattcaatgtctctttcctcaacaatgacgactacctttattcccccgaatataactggaattacgaaataggtaccaaactatcattcctgaacaatcggctatcagctgatttgagcctgttctatatagattggcgcaatcagcagataaccaatactattccaactgtaggtaacgtaatccgaaatgccggtcgctctcgtaataaaggcatcgaagccagttttcaagctcgtccgacgaaatcatggatgatgtatatgaattatggatatacagatgcacgatttgttcactatcaaaaagaagaacgcggtatcctaaaagattatgaaggtaactatctgcctatggttccccgccacactttctctttgacaaccggatattcattttatgacatctgttcctggatcgaccgccttaccctcaacgccggcgtatcggtaacaggtcccatttattggtatgaagataaccacccctcacaaagcccgtatgcattggtcaatctaagaattagcataaacaaaggatgctttacatgggaagcctggagcaagaatctcacaaataccgactacctgagctactacttcgtaaccagtaaagcctatgctcaaaagggaaaacccattaccttaggtacatcagtcagcatcagtctctaa

SEQ ID NO: 1426 - DNA, 252 bp, B.fragilis
taccccacaaacacatatatttacataaagaagaatactatttatatgtatcagacaatttcagaatacgagtccctgcagccggttacatatcaaatagacacaaaccgcttcgaaaaaaatcaaataaaagactccgcaaaagaacagtataaatcagttaccaacctctacttaccacgaaacgacaaaaactgtatatgcacgtcagtcccgaacgttaatacccaagaagccaagcctggcagataa

SEQ ID NO: 1427 - DNA, 696 bp, B.fragilis
ctatataaaaagagcttaattatgaagaaaattaaatttatggctttgtttctaagcatggcgcttgttttcggaagttgtggaagcatgaataatacagctaagggtggtgtcatcggcggtggttcgggagcggccctgggagctattatcggtggtattgccggtaaaggaaaaggtgctgctatcggtgctgcagtaggtactgccgtaggtgccggagcaggtgttctcattggtcgtaagatggacaagaaagctgctgaggctgcaaagatcaaagacgcacaagtagaacaagttactgataacaatggtctggctgccgtaaaggtaactttcccctcaggtatactttttgcattcaactcttctgcactaagtgcagcatctaaacaatcattggctgaatttgccaatatcctgaaagaagatccgacagtcgatgtagccattatcggtcataccgataaagtaggcagctacgaagctaaccagaaagtatcggccaaccgtgcatacgccgttgaaaattatcttcaggcatgtggcgttaaaccttaccaattcaaaaaggtggaaggtgtaggctactcacaatacaacgagtcggaaacaccggaacaaaaccgtcgtgtagaaatatttatgtacgccagtgaacagatgattaaaaacgctgaagccggtaaataa

SEQ ID NO: 1428 - DNA, 1275 bp, B.fragilis
actctgaaaaagatgaaaacgcaatggataagatcaatcggatgtatactggcagttttgattctgtcgggcatcatgccactggctgcacaggacaatgcggaaagatacaccacgatcagtggagtggtcaaagacaaactcaacaaaaagaaactggagtatgtcaatgtatcgataccgggaagcagtgtcggtaccgtcaccaacgcagacggtgagtttactctaaagattcccgagtcggttcaggccaaagacattgaagcctcacatgtaggttacctcaattcccgtatccctttaaaagaagaaaatcccacagaacggattgtctggctcactccttatgccaacctgcttagtgaaatcctggtaagagccagagatccacgcagcattgtggaagaagcacttcgcaagattccggccaattatagtccccagagcaacatgctcacaggattctacagggaattggctcaaaaagggcgtcgttatatcaatatttcagaggctgtaatcgatatttataaaacgccctacaatgaaactgccgaacacgatcgggttcagatttacagaggacgcagactgttgagccaaaaacagagtgacacactggctgtaaaattactcggaggccccaatatggccatttatatggatatagtaaagaacccggactgcttgttggctcaagaagacctattgttctacgaatttcgaatggaagacccgaccagcattgacgaccgatcccagtatgtcatcagcttccgtccaagagtaaaattatcctatcccttatgctatggtacactctacatcgataaagagcgactgtcattcacacgcgccgagtttaacctcagcatggatgataagaataaagccactcaagctatcttaagaaaaaaacctttcggactgcgtttcaaaccggtagaagtatcatacctgatatcatacaaaaacctggaagggatcacttacctgagttatatccggaacaatatccgctttaagtgtgactggaagcgtaaactgttttctaccaactataccatcttatcggaaatggtggttacggacaggaaagaaaacaatattacagctattccatataaagcagcattcaaacaaaatcatgtattctcagacaaagtggataactttaccagtgacaacttttggggaggctataatatcatagagcctacagagtcattggagcatgcagtaaacaaattaaaaaaacagcagaagcagtaa

SEQ ID NO: 1429 - DNA, 951 bp, B.fragilis
caagttatgaatgaaacaattagacgcattttagccgagagtggaacaaaaacctcaaaaatccgtaagcttcttctgaccggactttcacaccgtgaaattgccgacctcgttacccgtggaaaccgtggcttcgtgtggaacgtctataagagaatgagggacgagggcctgcttcccgcttcacagacagcgactgtcttaagaccagaacccgactatactttcaaccgttgcttcggggttgagatcgaagcctacaactgcccgagacagaccttgacggatgcgcttcgggagactggcatccctgtggaaattggaagccgtaatgccgagaccaacagcaactggaaactgaccacggacggaagtttggagggaagccatacttttgagctggtcagcccgatcctctgcggtgagcagggtttggaggtactggagagggtatgctgggtgctggacgcatacaatgtaaagataaatagcagttgtggagtccatgtgcattttaatgcgggtgactttaatcttacaacttggcagaacttaatcctttcctacaaacatgccgaaactgaaatagacaagttcatgcctgcctcacgcaggggaaacagaaatacctactgccgttctctcagagcgttctccgatgaagatatcagatcggcggaaagtatcgagtcactacaaagactcttcggcagcaggtacatgaaagtaaaccttgaagcttattcacgtcacaggacagtggagttcagacaacactcgggaacgatcaatttcacaaaaatagagaattgggttagattcttgggaagattgattatctttgcatctacatcttcgcttcctgcgggaatcagactggaggattttcctttcttggaggaaaaacaaaaattatattataaattaagaacaaaaaaattaatggaatga

SEQ ID NO: 1430 - DNA, 1206 bp, B.fragilis
aataatatgaatttcaatgaaataaaaaatagacttcttataggagcattggccatcactgtttttcccttttatgttcatgctcaaaacgataagatggaaggacaaacagcacatagaaccaaagcctgggaaataggggtaggtggagctcttatcaactgggacagagtgactttctcgaattttcgtcaggtcgatgggaactatctgtatcgaatgaatatcgatcatctttttggcggtatccaactctatgcagctcgtgaattgaatccttggttttatcttgatttgcaggggacattgggactggcaagaaaacaagttgaaacaggcgggcgtaagtttgatttcatgtatatggccggtccgggacttcaattccggttaaccccattgtttaaatcaaaatatgtagaaccttatttacgcgtaggtgttaactacctccatcatgatttttatgcaattaatgcaggaaagtttgaaaatgatcctataggagaagcagaatggacatcatccaatccttggaacaaagagaaaataggatctaaacaatcctatttccccttatccttcggagccggagtacaagcttggcttaacgatcattggggagtaggattacagggagaatacatcatgcctgtcgataaaaaacaaacgcgttttgttcaggcttcgatgcgtattatgttccgtttgggtggaagtacaaaacgtcctatgccggttgtgcaatatatagaccgtccggttgataggattgtagaacgaattgttgaaaagagaattgaagtgccggctgtggtggaaagtcatgtttgtgatttattcgataacattcattttgcgtttgataaggatgtgattacttccgaatctgaaatcactttggataagattgcagatctgttgaaaagttatccggataacaatttcttgataaccgggtatacagatgcaagaggaagcgacaattataacatagatttgtcgaaacgccgcgctaaagctgtgtatagtgcattgctgaaacgacaagtacctcaacatatgttgaaatggcgcggagtcggatatcatgctagttcagtgccggcttcaggtccggataaagtcaggatgggtgatcgaaaggtgtctattgagagagtgacgaattcagattattggggttggttaacgaatgaagaataa

SEQ ID NO: 1431 - DNA, 906 bp, B.fragilis
aagaatatgaaaacaactcagagaacggccggatggtatcatgtgatggcagcggtgacagtaatgatatggggaacaactttcgttgctactaaagttttaataaaatatggcctgtcacctgtcgatattttattctaccgttttttattggcatatatttgcatctggtttttctctcctcgtgtgttgctggctaagagttggcaggacgaactgcggtttgtaggactcggactatgtggaggttcgctctattttgtagccgaaaatacggcattgggtatgacgcttgcttccaatgtatcgttgattatctgtacgactcctattctgactgcactgttggcaccctttttctataagggtgataaattaaaagcacgtctgataggcggttctctgatggcgcttatcggagtgggactggttgtgtttaatggtagtttcattttgcagcttagtccggccggtgatattctgaccctgatagctgcattaatgtgggctttttattgcttgcttctcaggaggatgaatactcattatccgacattgttcattacacggaaagttttcttttatggtttggtgactcttttacccctattcttagtgtatcctttacagacggatatacatatcctgttccggcccgttgtcgctctaaatctgctttttctgggggtgattgcttcgatgctgtgctatattatgtggaatacggcagtgaaacaattgggagtggtttgtgccaccagttatatttatgtagttccccttattactttgctgacctctgccattgtgatcgacgaaaccatcacaatagttgctttattgggatcggcactgattctgagcggagtatatattgccgaaaggggagtgaacttgaagaaataa

SEQ ID NO: 1432 - DNA, 234 bp, B.fragilis
ctgacaatgaataaagtggtatatgtacatctcgtttttgagaagaaagactattttttcggcagcattgccgccatctatgactatttgagtgcggatcagatcggagccggttacaatacgctccggaacgttcggtggaaagaaacgtcagtgtatgttactccaaaagccatcataaagatcggaaaacttcttcgggcaggcagttgcaaaaagcaaccgataaaataa

SEQ ID NO: 1433 - DNA, 561 bp, B.fragilis
tctgtaacgaaaatgaatacgaataaagaatttttgactaaaatgattcgggtttctccaagcgtaaaaaagcgtatggaaatttttcagggaggtgattccgccaattcctgtattgacagaatgattacattttttgaaatcacaggattcaatccccgctacgcatcccggaatccgacggcactggtggaaaagagaattgaggacgttgtcagaatcatcaagtcccaggaacgggatatactcaagcccgtacttgagaaactctccgccataaacaacaccccgcaggagtcacctgactatgcccggttgatgaacgagctccgggatctgaaagatgaaaaccggaaattgaaggaaaggcttcaggcggatgatctccatacccaagacgccgccgtataccaggacaagctcaaacgtctgggcggcctgctgaaataccagcttgatccggagaagtttccaaggataaaatacagcgatgatgtaagagtccccgtcaacaccctgcagttgcttatcaagaagatcaacgaggaatatgtattgtaa

SEQ ID NO: 1434 - DNA, 459 bp, B.fragilis
aggaaaacgaaacccggaaaaaagaaacggggtgccagtaccatcagccagcagacagcgaaaaacgtctttctttggccacaatcttcgtggatacgaaaaggatttgaggtctactttacatttctgattgaaacttgctggtcgaaagaacggattatggaagtatatctaaactccatcgagatgggtaaaggtatttacggtgctcaggcaaccgctaaatataaatttaaaacgacagctgccaaactgacccggggacagtgtgccctgatcgcagcaactttaccaaatccaatacgattcgactcggcacacccctcaccttatatcaaacgacgccaaggacaaattctgcgactgatgaatctggttccgaagttccctcctgttgataaggaaaaagcgaaaggacaagatacaaaaaaacaaaagaataagaaaaagaagaaataa

SEQ ID NO: 1435 - DNA, 615 bp, B.fragilis
ctaataaagaatacaatagactcccccaataatgacagatcaattatgtacaaaattatattcgtatttctggcaataatgggcatagccactgcatcatgtgcccaacaaaaacaaggcgcaaacagaaagcagcccaataacaaagtgcttatagcctacttctcggcgacaggaactacagcaggtgctgctgaaaaattgtctaaggttacaggtggagaactttatgaaattactccagcccaaccctatacaaatgctgacctcaattggaataacaaacaatcgcgcagttcgctggaaatgaatgatccgaagtcacgtccggccatccggaaatcttccatagatatcgccgattatgacgtgattttcgtcggctatcctatctggtggaatcttgctccacgtattatcaatacattcatcgagagctatcatttgaaaaacaagacaatcatcttgttcgccacatcgggaagcagtagcatcactaacagtatggcaactctgaagaaaagttatcccgaactgatctggaaagagggaaaactgctgaatggaatgaacgaaaacgatatccgcgaatggatcagtaaattggactattga

SEQ ID NO: 1436 - DNA, 279 bp, B.fragilis
ctatcctggaacaattctaatagtgcatggcctttgctgtacaagaaagaacaccaaaggcctatcaccgcaaaatacacagggctacactgcatcaaaagtaaacaaccgactatctataaaaatgagttgtataaatctgtgcaatctatagtaaaaaagagttttgaaactctctcttttattctttgtgaaatctgctccgacaaacacgaaataatattaaatcatttgtacgctttgtacattttatctcttccgatcgttatctttatgtaa

SEQ ID NO: 1437 - DNA, 318 bp, B.fragilis
atcccaaacctattgggagtgggaatgggatttattcaagtgtataacggcaacttgaaatatgttgccactaaagacagaaaggaggtaaatatggcaggcaagaacattcatgttgttcacaatggcgaccaatggaaagtaaagcaagaaaatgctcaacgtagttctggtaatttcagaacacaacaagaagcatttgagcgtgctcgtgaaatcgctattaagaacggtcaagaagttgctatacacggattagatggacgtattcgtgaaaagcatagctatggcaatgacccatacccaccagaaggttaa

SEQ ID NO: 1438 - DNA, 621 bp, B.fragilis
atagagactgaatcacatacctttggatcaagtttaataacgttaagaatcaaaagaattatgaacttacttatcatcctggggattataatcatcctcgtcattatcattgcttccatgtataactcattggtaaaattgagaaataatcgcgaaaacgcatttgccgacattgatgtacaactgaagcagcgtcacgaccttattccacaattggtagatacagtaaaaggatatgcagctcacgaaaaagaaacacttgagcgcgtcatccaagcccgcaacggagctgtcagtgcccggacaatcgatgaaaaaattacagctgaaaatcaacttagttccgccctcgcaggattgaagattacattggaagcttatccggacctgaaggccaaccaaaacttccttcagctacaggaagagatttcggacgtagaaaataagctggctgccgtacgccgctactttaattcggccacaaaggaactgaacaatgctgtacagacattcccttctaacctgattgccaacatgtttggctttcataaagaaatgatgttcgacttgggcacagaacaacgtgccaatttagaagaggctccgaaaataaaattttaa

SEQ ID NO: 1439 - DNA, 1311 bp, B.fragilis
gtacgggctgaatctggaagtacgcttgaagaacggaaaaatcaagtcgttcgatttcgacgtgaccgaccaggtggtggcgcaaccgcagggaggtgtcatcgtggtgaagggcatcgagatttccgacgaagagggtacggaaggcggctccggcttcgacgtggatgtggacgactggggagattacgaggacatcgaacttcctctttaatttgcatagagagttatcaaaacatttttattcacaatttaatttttaatcaaatgaaaaagatctttttgattggattagcagcaacagccatgttggcaagttgcagcaacgacgagaccgtggaaatggcacagtctaaggccatcggtttcagcaacgccttcgtgaacaacggaacacgcagtatcgtggatccgagtttcacatcaacaagtttggaagactttgccgtgtatggtttcacacgggcaggccagatcttcaagggtgacaaagtgtataaagaaagtttggaatctactccccaatggtcatacgatgtattgcagtactgggttccggacaacacttacactttcggtgccattgcgccttacagtgtagcgacaaatgttttcgatgtagcattgcctgaaaatgccacaaaggtagaaatgaaggttgctttcaccaacactgatgcagaccaggttgacttgcttcacgcagctcccacacaaattgctggaacagaagtaacggagacatacgcaactcctgttagcatgacattcgaccaccagctttcaaaagtgaaattctcgttcgagaatgcagtaggtgagggctacaatgtaaaagtaagcaatgtgagaatcacggatgcttacacaaaaggtactttgacagtaaccgctgccggtaacatttggagtgctcaggcggataacaatcttatattgaacttcggcaatgtggtagccaacgatgctaccgctgatgaagctgctgtcattgctaacgctacaacttctgaaagctacaacgaaaagctgatgatcccgatggctgctaccgctacatatactgtaactttcacggcagaattgtatcatggtgacgtattgttaggttcttacaaccacgaagtaacaattaagaatgttgagttcaagctcggttactgctatgatttcaaggctactttgacttctagtaatataacagacaaaccgcttaatcctatcaagtttgaggttgacaatattactgactggaacaaaactgacattgacaaagacttggccgttcccacaacccagagcggcaactaa

SEQ ID NO: 1440 - DNA, 222 bp, B.fragilis
ggtcagcaagataattttttcctgtatacgtttgtctacgcaaagtataagatgtatacatataataggttaattatcaacgctatgcgtcgattcatgttcccgtgtgcgggaactcctcttgctcttccttatcaggaatttactaagggacctccggcccttagcccgggacgcttccgagaggcccggaacatcaggcaagggcatggctgctggtga

SEQ ID NO: 1441 - DNA, 2664 bp, B.fragilis
aataatatacttatgagaccttcccattttacattacattcctgcagggatgccttttcgcattttctgctttttacactcgtttccggcagtatctgtctttcctcctgtgaggatgacatggaccggccttcgccttcctcacatgtctctttcaccaccgagatcagttcctcccggactccatccacccgttccaccaccgatactgatactccgcagggtactgtcaccgccttgcaaggcggcagtacccctctttacctgcacacgctttacaccgacagcatcgccctccctccttcggacagccggcctgacaggggcgttcttacccgtgccactcccataaaggatgccaacatgtacgagagtttcggtgtctcggcttactcgtataccggttcctggagcgaagacaaaactcccaactacttctacaacgccacagccagcaagtccgacggcggctatacgctttcctccacctattactggcccggttcttcatataaaatgaagttcttcgcctatgctccgacagccaacactcagtacgtactttccggcaggacacatgcaggttctcccaccatcagcgtcactattccgggcgatgtcaatgaccaaaaagaccttctcgtggcaaagacggatgaactggccggcaacaccaacactgccgtggcgcttagtttcaatcatgcccttaccgccatcaggttcgtgtgcggagatgacatgcaggtaggtaccgtaaagagcgtcagtttgaaaaacgtttattccaaagggacttaccatatggggacacagtcatggagcaatgtaggaactcccgctactttcccgcagacattgaataaatccattacgggaaccccggacgaaccccttactgtcgatgcgcagaccttcatgatggttccgcagacccttcccgacggcgcgcaacttgaagtcgtattcactgataactccagcatggaccacacgctgactgccgatctcaaaggcacggtctggcctgttggcaagaccgtcacttataagatttccagcagttccataaactggacctacacacttgccgttacctccccggccgactttacctatgaaggcggtacgcagcaatacaatgtgaccagttaccggcagaacaccaaaggggttaaagaggctgtcgcatggaccgcacaatattcagaagatggcggggcatcatggagcaataccagacccggctggctggatgcgtttaccgtatccggaaatggtggagatactccacaatcatacaatgcaactgtcatcgcacagactggcgtagaggctaatcctcaacatacggctgctctacagaatgcttcggtcaaaggtactgaaactgtcccatataatcttgccaaccagactaatggtggcacagtggatgaaaacaccgccaactgctatgttgtcagtggttcgggatactactgtttccctttagtatatggaaatgccatcaaaggtggtacgaccaatacgtccgcatatacctctacggctccgtccggaaccactattctgagtcctttcatcaaccatgctggtaacgcgatcactgccccctatatacgcaacaacgctgactgcacgcctgctaaagcagaactggtatggcaggacgcaccgaatttggttaccgatataaaatacaacaatacgggcaacggcaatatatctttcacggtggacaagaataccatccgacagggtaatgccatcattgccatcaaggatgccggcgacaatgtcctgtggtcctggcatatctgggttaccgatgaagatatcaataatgtcattgaaattaccaatttccagggtaagaagtataaattgatgtctgtcaatctcggctggtgcgatggaagtaccacgaattatgccgaacgtagttgcaaggtgaaattcactgccggaggagagagtcagacaataactatcagacaggcctctaaatcaatcgttgtcggtggtaataatccttactatcaatggggacgcaaggatcctttcctgccttcgaatggattacgcgatatcaataaaacctggtacgacaaagacggcaatgctcacacgggaagtcctaaaacggaggacttttctatcggcgccccttgtatcacgaattatattctcaaaccggatgtgatgcagagtcaagattatggcgataatacatatgcaaatctatggagtgccgataacaatgtttatactgccaatgacgaaaatgtcataaaaacgatttatgatccctctcctgtgggcttcaaagttccccccagtaatgcttttacgggattcacaacaaccggaaacaatacaagtacatcttctgaaatcaacggaacttgggacagctccttgaagggatggaatttttacactgactcctcaaaaaataaaaccatcttcttccctgcgtcggggtttcgcgactattcctatggcggggcgctcatcgttggcagctacggctactgttggtcggcggttccgagcatccagtactacgctcgcaacctgaacttcaactcgtcgttcgtgaacccgttgaacaactccagtcgggcgtgcgggtttggggtgcgttcttcccaagaatag

SEQ ID NO: 1442 - DNA, 264 bp, B.fragilis
agaggggtactgccgccttgcaaggcggtgacagtaccctgcggagtatcagtatcggtggtggaacgggtggatggagtccgggaggaactgatctcggtggtgaaagagacatgtgaggaaggcgaaggccggtccatgtcatcctcacaggaggaaagacagatactgccggaaacgagtgtaaaaagcagaaaatgcgaaaaggcatccctgcaggaatgtaatgtaaaatgggaaggtctcataagtatattattttag

SEQ ID NO: 1443 - DNA, 204 bp, B.fragilis
gcgacgctctgggaaacaattatgcaaccgtccgcattcttacgtgacaaggtggaaaactcgaaaaacagactctcggaagccctgaccaaactggacgggaccgtctcttccctgcacgaggcaagcacgatttccgtcagcgcaaaggccaagcggacgcttgagcagggaagggaggcgacttgccagaaaaagggctga

SEQ ID NO: 1444 - DNA, 186 bp, B.fragilis
gaaaatggccgagctaatcggccttgcactgaacctgaagtgcacacgcaatcaaaacataatcaccctctccgagtaatcccggaatcaaaacccaaaaacaatgaaagcctcgaaaagtctctgcctacaatgcctgttcacctgtctgctattattcatagcagcccgggtaaaggcggatga

SEQ ID NO: 1445 - DNA, 516 bp, B.fragilis
aaaccgcaacgtatgaaaagtttaagttttagaaaagatttaataggagtgcaagaagagttgctccgcttcgcttataaattgactgctaatcgcgaagaagcaaatgacctgttacaagagacctcattaaaagcattagataatgaagataaatttatgccagacactaattttaagggctggatgtatactatcatgcgcaacatctttattaataattaccgtaaaattgtgcgtgatcaaacttatgtagaccaaaccgataatcttttccatctgaatctcccgcaggactccggttttgaaagtaccgaaggagcctatgacctgaaagaaatgcaccgtgtagtaaatgcgttgcccaaagaatataaagttccattttcaatgcatgtttccggatttaaataccgtgaaatagccgaaaaattagaattaccactcggcactgtcaagagccgtatcttttttacccgtcagagattgcaacaggaactgaaggactttgtttga

SEQ ID NO: 1446 - DNA, 2235 bp, B.fragilis
gaccggtttagcatcgtgtattctggaattatcatccatggaatagacgatctacctacagggtgtaaggggttgaatgtccccttacactcactaacagccgttcaggcaaacaaatataaaacagaagaaatgaaggtacataagaaaaatccgagttggatggcgggcggcatggcgacgatgttgctgtgcacgctacttttctcgtgcaataacgaggactttctcgaaagcgggaatccggagaaagccggtgacaacatttgttttggcatatcgtccgataagaacatgcagacaaggggatatgccggtagtgatgacgaaggatataccgcggaccgtttcgtgttgcggtcggacgactcggcagacacgctttgtgtccgtgccattgtgtcggacggtatcaacgtgtccggctttgagggcgaacaagccttgacacgcggaacgcttgttggcaaagacaatttctataataagttccatgtgctggcatactggagtaagaatggggcgtccattgaccagttctacatgaacacgaatgcttccaacgcggctgcttccgttggaacaggtgctatatggagcacggaacaaatatactattggccgggagcagaccattcgttccaattctatgcctgggcaccgacggatgccggtggcttgatcactccgtccgatccgtcaagcaaagaacttaaatacaccgttccggcagatgctgccgaccagaaagacattgtggtggctactaccaatgaaataccgggcaacaacaatgcggctgtacctctcaacttcaagcatatctgcaccgccgtccgttttgccgtgggcagccagatgcagcccggctctatcaagagcgtggctttgaaaggtgtcaaaaatgccggaacttacgatatggttgccggtacatggactcttggtgatgcgactgtggatttctcgcaggaattgaacaaagaaactaccggaagtgaagccaacggagcggaaatcacctctgcagaaggcacattcatgatgttgccgcaaacattaccggctgatgcgatggtggaagtggtatttaccaatgctaatgcttccggtgttgaccgcacactcactgcgtccatcggaaatacagagtggaagacaggtacaactgtgacatatatactctcaatcacgccggaatatgaattggagttcgtttcccaacctgaaacacaggatgcgcattatgtcatttatcccattgccattaaggcggacaagttcccagaaggaggttggaccttgacatccaatgacaaggaaaatgttacttttgttgaaaaatttgctgacgacggaataaaaaatctggttgaccaagggtattggctcaaggattattgtggtgcaagcactctgaccggttcatccttcggtgaggtcccaatatatgttttccttaaagagaatatatcggaaaaggaccgtgaaattgtactctcgctcgctccggctaatgatccaaatgcaaaaccgaagacatttacattcaaacaacactgtccggcatggaacaatggtataggagtggaacgtattcagggaaaagactatccttggggattcaactggagttcggatatgaagattacttattccatgccatccggcctttggtcaggaattatacatgtactatttgaaatctttggagaccattcttatgtggaaagtagtggattggctgtgctaggaacttggaaagttattgttaactttgctaaagttccgtccctgaccatcgccataagcccgacagacggcattacaaacacatgggagctatacaactttgatggcatcaacgaagcgtcaatcatcatgagccaattggaatcgtggggaggtgtcccagataaagagttgccagtcaacccaagcgagtttgtagcatgggcttgtgcaaagaagaacagatttggggtagaaagaaagagtaattccggagaaacaatctatgtaccgactttagaacaaacggacatggtatggtatcttcctgcacaagaagaagcactttatatgaaagatgacctgtcggagaattattggacttccaccgctataacggacccgggaaccaccgcttatacatatacagcagaaagtggttctacatccgggatggatcgtaatgaggtaattcatgttcgtgctgtacgaaagaaaccctag

SEQ ID NO: 1447 - DNA, 1494 bp, B.fragilis
cggggtggtagccggattgaccggttaccacggtctttttattttcgaagttatattggcttccatatcattgatctatatattttatttcttcagaaaagaatctcaacccattcattcttaacatatatgtatactgaaataatcaataaatacaatgtaccggtacctcgatacaccagttatccaccggccaattattttgagccatttaccaacgcccgctacctggaggctgtacagcagtcgaatcaggcttcagagcgtgcattatcgttttacctgcatatcccgttttgtcggcacttatgccactattgcggatgcaattcgtatcccatggcacgtcccgagattattgagtcatatgtagtagctttgcatcaagagatagatctgattcttcccctgttagataaggatcggccgatcgcgcagatacattatggtggcggaagccccacagccattcccgttgctttaatcaaagaattgaatgctcacttattatcatcattcccagccatcgaccgccctgaaatagccattgaatgtcacccaggctatctctcagaaaaagactggctgcaacttaccgaatgcggctttaaccgtctcagtattggtgtgcaggactttaatatcgaggtactgaaaacagtcaatcgccgcccttctttattaccgatggaagatatatttatcctgctacgcgaaaagggaataagtatcaaccttgattttctttatggtttacccaaacaaactgtggagaacttcacccgcaacataaagcaggctattcttttatcacccgacagactggttatgttcagttatgcccacgtgccttggattaataagcgacagttgcttctggagaaatcaggcctacccgacaaccatgaaaaacagacaatgtttgacactgctgccggactattgcataaatccggttatcaatctatcggaatggatcattttgtactccccaatgacgagctgagcatcgccatgcaaactaaaaaattacatcgtaattttcaaggctactgcacccggcgtactaccgcacaggtatatggtttgggcgtaaccgctatcagtcagcttgaatcggcttatgctcaaaatacgaaagatattccccattacatcaagactatcagtaaaggcgaactaagtattaccaaaggttatgccctttccccaaccgaacagctcaccagagaggttatcgaaaccctaatgtgcaatggctgtatcgattggagagatctttcaaagcgcctgcatgtatcggtatccactttaaaggctgccactgcctacgatgaaaaaaaactatctggctttgccgatgacggactgatttattatacagacgactatcttgagatgacaaccgcaggttcggcatttgtacgcaacgtagcggcttcacttgacaaactgatgctccactctccacactcatattcaaaacctttataa

SEQ ID NO: 1448 - DNA, 216 bp, B.fragilis
agacaaatcagaccatcaaaaagttcccataaaagatatgttatatatcatattgtcacaaaagtaaaggagcaaggagggggtccctcacttactccttcttttgcacaactaaaaaattacactaaatcactacctaaaatcaatctttttattaatgaaaaatacctaatcaaacaaagtccttcagttcctgttgcaatctctgacgggtaa

SEQ ID NO: 1449 - DNA, 1281 bp, B.fragilis
attatgaaaagaggaaaacgattgatacttcccttactgggaactcttatactgacaagtcttttttcctgtggtgtagaccgctggccggaatattatccggagacgggacgcgatatttggatagacagtgtgatgcgtcaggagtatctgtggtatagagatatgtcatcacctgctgctccggactatttccagaaaccggaagcgtttctgaaaaaagccgtcgcttccatggataatggctttagtaagatcgactccttgctggatgaacccattccgagctatggttttgattatactttatataaagtgcttgataatgatacagcgtataacgctttaatctcttatgtggtgcccggatcgcctgccgaagaagccggattgcagcgtggtcattggattatgatgatgaatggagattatatcactaaaaaggttgaatcggaattactgcagggaagtacccgtcaacttcagataggtgtttataaagaagttgtcggtgaagatggtgaggtaaccggtggggtggtgccgataggagagacgacaatgcccgcttcacgttctttggtggataagcctgttcaccgttttgagattattccatggaatgggaaaaaggtaggctatttgatgtataatgaatttaaggcagggccgacgacagacagtcaggcttataatgatgatttgcgtagggccttccgggatttccagacaggaggggtaaatgagtttgtattagatttacgctataacaccggaggcagtttagattgtgcccagttgctctgtacgatgcttgctccggctgataagatgaatcaattgttggctctattgagatacagtgataaacgcgtggaagcaaatcaggatttgacattcaatccggagcttatccaatccggtgccaatcttaacctatctactgtttatgtactgactaccaatgctaccagaggggcggcggagatggttatcaattgtcttaatccttatatgaaggttgtattgataggtactaaaacggcgggggaatatgttgctacaaagccttttgttcatccaacggatcggtttatattgaatctggttgtttgcaatgtatacaatgcagaagaaaagtcagattatgccaccggtttcaaacctacatacgaatacaatgaagattcttatctgagtacttatttgccttttggcaatacgaatgaaactttattgaatgcagcattgaaaatcatgagtggaataacggataagtaa

SEQ ID NO: 1450 - DNA, 612 bp, B.fragilis
ataaccattttaatattgaagagtatgaaaaagaattttattacagtaactcccgatagtggaacatcaggtagcagcaataccattagtgtagctgctgaacctaatatactcctgaaagaacgttctgaaatactgaattttaatgcaagcggtggagtttctaagtctgttcaagttatccaaaattcgatgccttactttccaatcagatttccctttgtactgaatatgaacaaattcattggaaatcttaaagtggattcatcgggtgtattacaaggagcttattcgatatcagaaataaaaagtatagatccttccgcttatgactcttctttaggagaagggtggggaatgggaagtactcaaaaaatgctcatctacgaccctttcagtaatgtaaccgaaatcgtagctcatattattgacagtagtggaacctatgatgcaaactttatctcttcaaatgcaaatatggggagaatatggggtgaccctggattattataccaaaaattactcaagattatttcagaagattatacaaaaggaggctacgagattcgcataaattcagtgcttgcaatgaaatttgtttttgtggaataa

SEQ ID NO: 1451 - DNA, 1167 bp, B.fragilis
tctaacattattatttttatgaagaaaaatcttttatttacggctatagctgtagcagtcctggcctcttgttccaacgatgacgtcgttgatgtaaataatggtagcggcatttctttccgtgcctctttggataaggccataacccgttccaacgtgacaaacttgcaaaacctggctgcattcaacgtgacggccatcggtaacggcgccaattttttcacagacctgtctgtcacttctactgacaacggtactaactggacaactgcttctacttactattggccaaactatgcgctttctttcttcgcctacgcccctcaaactcccggcggtactgttagtatagacaatacggcaaagaagataaccgggttctctcccgcgcagtccgttgcagaccaaaaggaccttgtaatctcttacaatacgggtactaagggctccaatgaaaatgccggtgttgccatgaacttcaaacatgccctttcccaaattgtggtaaatgccaaatgttccaatgacaagattaaaattgaggttctcggcgttaaactggtgaatgccgcagcaaaagccgactttgcttttccggaagcggtaaccaataccggatacaccttgccgcaaggccaatggagtaacttgtctgaaaaagacgatccttcaaaagcttatatgatcaggggagatgctcctcttactctgacggctgatgcccaatctatcatgttcggtgataacaacctcatgcttattccccagcagctaacggcatggaacggtactgtcgcaactgccggtgcttatctgtctgtactctgccgtatttacagtttggatggtggcaatgagacccttctttatccagaaccgacatctactgatgataagagcggtaaatatgcattctctgccataggtattaataccaactgggaaccgggtaagaaatacacctacacgttgaacttctgtggtgatggcggcggcggtggtaaaattgatccgactcccactgatccgaccaagcccactgatccgacagtcgatccaactcctatagatggtggtagtggtggtgatcctattttgggaaaaccgatcaaattcactgtaactgttgacgattggaccgaccaacctgtggatgttcctatgtaa

SEQ ID NO: 1452 - DNA, 876 bp, B.fragilis
aatgatgttatgaaattactttattttaaagaacatctgtcatgcataaactatcaaataaatgttaatacaggtttcgtttattataatttagagaaagatagtgtaagtaaaatagataatagtgcttctccttgtattcttttccttcttgatggagaggtgtctattgatagtggtgagtatcagaatgtacatattgagaaagataaaatggttcttattccgcaacatgtagataataaaattgaagttatatatgatgcaaaatgtcttttactattttggaataaagacataagggtgtgtgacaaagtatatatgaactctctttcttcttataaggaaagaaaaaaagagatgtgtgtgcttcctataagagatcctttgcaagctgttttaaactccgttgtcgcatatttatatgctaagatgcagtgtaaacatatgcatcttatcaaacaacaagaggttttgttggttttgagaggatattatacgaagaaagaattatttacttttttttcttctatattggggaatacagggcattttgaagattttgtaatgaataattataggaaagtaaagagtgtaaaggaatttgccggtttgtattgtacttctgagcgctcttttaatcgtaagttccaaaattgttttaaagaaagtccttatcagtggatgcaaaaaaagaaggcggagttgatcagagaaaaaataagtgagtcggatactccttttcaagagatcgcaatggattttgatttcaattcgcaagctcatttcacttcctactgtaagagattatttggaatgactcccagcaaattgagaacagaaagtaagaaggttgctcctgatttggagtactga

SEQ ID NO: 1453 - DNA, 1248 bp, B.fragilis
tcaaacgatatgaatcacatgcgtataaacaagctttcaccgctttcccggaaagcactgaacctcagtacatttttttgcttatacattgcacaagccatcccgatgagtttcttctctacagccatacaagtactaatgaggcaagccgattactctctttcttccatcgccttattacaactcatcaaactcccctggatattgaagtttctttgggcaccgcttgtcgaccggcattgtatcaccctaaaagactataaacgctgtatcattacatccgaaatcgtatatgcattactgatcctgatggtaggcctgctcgatatccaaacagatctctaccttatcattggattagtatttctatcattgatagcctcagctacacaagatatagctacagacacacttgcagtgctctcctttggtaagtcggataaaagtttggtcaacagcatgcaatcaatgggtagcttcggaggcacattgataggaacaggtatattactcctcgttcttcagcactatggctggcatgtggtgataccatgcttatgcatttttgtactattggcaattattccgttattgaaaaacaaacatatgaaaataatacccaaagaaccttcgaaacgggcacaattcactgattttatctggttctttgcccgtcgtaacatctggaaacaaataggattcctattactatattatgccagtattatcggaattttatcggtgttacgctcttatctggtcgatttgggttattcaatgaaagagataggcattatgataggtatcggaggtaccggagctgctttcgcatcatctttcctggccggattgctggttcgtaaaatcgggcgatatcattccagaatactatttgcaatattcatcctgcttactacactctattttatgtgtatttcatggacagtcccttcattttcaatgctttgtttagggatcgtcctgctatggagtgcctatggaatggcaactattgtagtgtataccacttctatggattgtgtacgcaaaggatgtgaaggaaccgactttaccatccaaacagtactcacacacttaagcggcttactaatagcctttcttagcggggtggtagccggattgaccggttaccacggtctttttattttcgaagttatattggcttccatatcattgatctatatattttatttcttcagaaaagaatctcaacccattcattcttaa

SEQ ID NO: 1454 - DNA, 852 bp, B.fragilis
aaacatataatgaaatctttagaaacaatggcaaggtataagaaagaactgaccgaatgtgcccgcaacctgaagctgccattcctggcagaacacctggatgaaatactacatgaagcacaggaaaagcaacagacttactccgagtttctgtcaacttgtctcatgcgggaacttcgggacaaggaaaggagaagttatctgaccaggttgaaatttgcaggattgcctgcaaggtatgatctggatctatatgatttctcacgtaccgaagggattgaccaaaggcagatgcgcgaattgcgtgaactggtatggataagaaggacatataatcttctgctggtaggagattccggaaccggaaagacattcattgcttcaggacttatccatgaagcagtgaaagcgggttataaggcatacctgctgaccttggaagaactgcttgtctgtttgaaggctaaggagatatcacgacccgcgatgaaaacatacaaacgaataatgaaagcgcagctgctggcaatcgatgatgttacgctgtttcccctgaaaggagaagatgtactgctgctgtttaaactggtgaattgcgttcaaggtaagacatcacttatcattgccgcaagccgggatcttaccggatggctggagatggcaggagacgaagtttgtgcggcagctctactggacagactactctattgttgtgagataatcaggctattaggaaaaagctaccgcatggaaaacaggaaaacaatttttagcaatcaacagatagggactgcacctcaaaaagggttaatgaaagtaaagaagagaactaaggaaagtgggtactgttaa

SEQ ID NO: 1455 - DNA, 1785 bp, B.fragilis
cttacggcaatgaaaaaggaaattaaattcagtctcgtatatcgggatatgtggcagtcgtccggtaagtatcaaccccgtgtcgaccagttagtgcgaattgcccctttgattattgaaatgggatgttttgcccgtgtggagaccaatggcggagcgttcgagcaagtcaatttattgtatggtgaaaaccccaataaagcagtgcgggcttttaccaaacctttcaatgatgccggaatacaaacccacatgcttgaccggggactgaatggtttacggatgtatcccgttcctgccgatgtccgtcggttgatgtacaaagtcaagcatgcccagggagtagatatcacccgtatcttttgtgggctgaatgaagtaaggaatattattccttccatacactatgcacttgagggaggaatgattccgcaggcaactttgtgcatcaccttttcaccggtacatacagtagaatattatacggctattgctgataagctgattgaggccggtgctcccgagatttgtctgaaggatatggcaggtgtcggacgtcctgccatgttaggacaattgacaaaagccattaaggaacgtcatcccgaagtgttgattcaatatcatggccatagcgggcccggattgtcaatggcttccattcttgaagtttgtgagaatggtgctgatattattgatgtagccatggaacctatgtcctggggaaaagttcatccggacgtgatctctgtacaggccatgttgaaagatgccggttttcgtgtacctgaaattaatatgaaagcctatatgaaggcgcgtgccatgacacaggagttcatcgatgatttccttggttactttatggacccgaccaacaaacatatgtcttccttattgctgaaatgtggcttgcccggaggaatgatggggtctatgatggccgatttgaaaggtgtgcatgccggtattaatatgatattaaagagtaataatcagcctgaactcagcattgacgatctgcttgtgatgttgttcgatgaagtggaatacgtatggcctaagttaggttatcctccactggtaactccattcagccagtatgtgaaaaatgtggcattaatgaatgtaatggcacgtgtgaaaggtgaggaacgctggagcatgatagacaataatacctgggggatgattctaggtaaaagcggtcgtttacccggtccgttggatccggaaattgtagcattggccaaagagaaggggtacgaatttacagatgaagatccgcagaagaactatcccgaccagcttgatgaatatcgtaaagagatgcaggagaatggttgggagtccgggcccgatgatgaagaactgtttgaactggccatgcatgacaggcagtatcgtgattataaatcgggagtagccaagaagaggtttgaagaagacctgcaacgtgccaaggatgcggcattggccaaacaaggtttctcagaagaagatgtgaaaaggatgaagcgtgccaaggcagagccaatcactgcgatggaaaagggtaggattatctgggaaatagatgttgaatcgccctccatgcctccggaagtagggcataaatatgaaccggatgatgtattttgttatattgccactccatggaacacttatgatagagtattggctaattttagtggacgcatcattgaggtatgtgccaagcaaggtgctttggtcaataaaggtgatgctttggcttatgtagaaagatgtgaagaaccggcataa

SEQ ID NO: 1456 - DNA, 459 bp, B.fragilis
atgagccaaattggatacaaaagttcagagacttctgttgtttatataattacaaaaaccatgccatattttaacggacaactccatttcttcactttcacgttacatattcagtatcaatcattaaaattactgaatatgaaattagacgaaaacattttgaagacctgtcaaggacttgtaatgaactgtaattgtaaggttttaatccttaacgtattgggtgaacaccgtgtattccttgtgaatgatgtacacctaaagacccgtgagtgccgatacaatgaagtccgtgatgcgcaagacatcaccactcttgtcttgaatatcgggcataactttgccaatggtatgaccgaacagaccttattggaacgtacccaatctattcacaaggaagatttcaagtttggaactgataattacctgtggataacaaaagttgatttgaatagataa

SEQ ID NO: 1457 - DNA, 2319 bp, B.fragilis
tataacaaaatgaacaatgctaaattattacatttaatggtttacatcttaaccattattttagggcagtcttgtacagaagtggatattacgatgcccaaaggaccgaaaggtgatagaggaatgtcagcttatgaattttggaaagagaatgtagagaatggagtgatttcttggcctaagaaagagactgaaataactgatttttttaagtatttaaaaggtaaggacggtctggatggaaaaagtgcttttgaactgtggaaggaagaagtagctactggtgctctggataatcctcaccgcccgggaagtatgtggcctgtatcccagaataatcttagagatttttggtattatctgacaggagcgagtggcgagaatgggcaaacacctcatataggtaataatatgaattggtggattggcaataaggataccggaatacgtgctcagggtagggatggacagaatggagaagatgctgttccaccggtagttacgatcggggataatggtaattggttgattgatggagtagatacaggaaaaccttccagaggtgaagaaggagttgcaggaacaacacctactgttacaattggagaaaatggaaattgggtaatcaatggaaaagataccggaaaggctgcgataggtaaagatggaagatcgccagaggtaataatcggtaccaatgggaactggtatattaatgggaaagataccggtattcgtgcatatggtaaagatggtgccaatggtaaggatggcattaacggtaaggatggtgccaatggaaaggatggtgccaacggaaaagatggtattaacggtaaggacggggctgctggaaaagacggcgctaacggtaaagatggtgctaatgggaaaagtgcctatgaattgtgggtagagagtgttgaggcgggttgtaacaatactggccctaaagtgaaaaatcctcataatccgtctttggattgggattgtggtaaaacaactttaagtgatttttgggagtttttgagaggtgcggatggtaaagatggtgcggacggtaaggatggaaaacccggtgttccgggaaaaccgggtgctgaagttactattatcaaaggagtacctaacgtgattgcactttattcacaacaagaatttggagagtatgttcgtacaaccgatggaggagtagcttatcgtgtgtatgacgaatctggcaataaggctccgaaggctgtggttaagggaattcccggtttggatccggctaaaacttatacagctaatgaagagggagaatttattattccgaaagaagatcttcctcaaattgacgatatagatgcccgatgggggaaagttaaggaggtgactattaataaggtgacaaaggaatctgcagaaaatacttatgtccccaacagaatgcagattagaatgatttatattgccacgtccccatatcttgattatgaacataacctacagtttagagtggaaagaaagacggatcctagtgcggaatggaaaacattgcccagctatttgcctaatgtcaatgccgtatttacggcatatcaggttacaaatccggaagacccgacatctcttgataaaacgaaaaagatagagagtactacacctaatatgagtagtacatcaatgtctattaatcctaatcgatatgttaaagagaatcctgccggcataaaaaatggaataactgatttttgggatggaaaagacaactatttctcaatagtaaaagataccccttattatggagaaacgatttattggaatggagtatgtaagatggcaccttatcagatacctcctacacttaaaactctagccttaacaaaggcatctgctgaaagtggagatgatgtattcttgaataaagcccagggggaatttgacttttcgactattgatttcaatatcatatgtaaacatgaattggtaaaaacagtaaaaccgaacggaatagattacattgaacctgaatattatgctccggaagaggcgaaggaactcctactctgttatgttaagtttacttatacctctccattgggggtacaaacagccacaagcgaacttaatatgtcgagttacaagaaacctgagtatgctgcccttagcccgtacttgggagctacaatctattcggtaggagcgagtagcacttttatctactctagcaatgtgtctttaggagttctcaagaagaaagcagataacggtacgtattatgttgagaatacatataaagatatgcctgaaattagtgtaacctataaagaaaaatag

SEQ ID NO: 1458 - DNA, 549 bp, B.fragilis
accagcccgatatgctttaccgcagttacatggagtcatactgtggcggaacgctcgaccgaaaccgacgtgatacccgtcaccatgcacccgatggtgttcacctatctggtacgttacgagttcagccacggggtggaatacgtgtctctggcacgcggtgccttggctggtatggcgcaggcggtatggttgaacagcggacacacgtctgatgaagccgctaccgtgctgtatgattgtacggtagaagatttcggcacacaggctttggtgcgttctttcggaatacctgatttccctaacgaacattacggcacaagggcagaacgtaagtacgggctgaatctggaagtacgcttgaagaacggaaaaatcaagtcgttcgatttcgacgtgaccgaccaggtggtggcgcaaccgcagggaggtgtcatcgtggtgaagggcatcgagatttccgacgaagagggtacggaaggcggctccggcttcgacgtggatgtggacgactggggagattacgaggacatcgaacttcctctttaa

SEQ ID NO: 1459 - DNA, 261 bp, B.fragilis
agatacgagatttttataattgtttctattttacaaaaagcaatgacagcttacgatttaaagaacattgcatctgcaggtggaaatattgtcgttaatgcagaagatttttcagcgtatgatttaaagaatattgctgaaaacggagtagcaacaaaggcaaagctaaccatcaaaaacgcaggtggattatctggatatgattgcaaaaatattgcatcagccaatccagggaatgtaacatttgattttagcgaataa

SEQ ID NO: 1460 - DNA, 705 bp, B.fragilis
acattgtggataataaaaggaagtgccttgatactcgaagaatcgccaattcaacaaaaagtacaaacgaggcacagtgggcaacctatatcaagtgggctgttcatctgtgtgtttgtacaagcgtttggcgatgctttcgagttcacacaggtggcagtccactttctttgtaataacgtaatttctcactggctgtctgagaaaaactcgaaaaatttcgccattatgaaaaagtatttcgttttatcagtatttattatgctgattggagcatttacaaatgttcaaggtcaaaattctgcaactcccgataaaggagtgttagttcatggaaacgtccgtttatgcaactatgaaagaggctgtttaataacagacaacgacatgaagcattggacgcaaaaacttgaaatctcctacgacggctcggacaagacatacggcatctatatcaatgtccgaggggatattatcaatttgggtgtcaaatataaaagtagcggaacagaatcttatacatacgaaggaacggacagggtaacaggacgaaaggttgttgtcgtaacaaaacaaaagttgagttggtatttgaataacaatggagttgattctcatacagaggttgaaagtccaaaggggataatcgttaccgttcctgccacttatacagtgttttcagtagttcctattaagaataagtag

SEQ ID NO: 1461 - DNA, 849 bp, B.fragilis
aacaatcacttcattataacatatatcattatgaacaaagtttttttatttttattattcagctttttaacaataacgagtatggcacaagaaaaaatcaaacagacagccgggcgcgatcaacttggtgattttgcccctaaatttgcggaactcaacgacgatgtccttttcggcgaaatctggagccgcactgacaaactcagtctgcgtgaccgtagtttggttacgatcacttcactcattagccaaggtataacggataactcactgacgttccatctccagtcggccaagaataacggtatcagtcgcacggagatatccgaaatcatcacacatataggtttttatgcaggatggccgaaagcatgggccgcttttcggcttgccaaggaggtatgggcaaaagatacaaccggggtagatgcaaaggccgctttccagcgtgaaatgatattcccgataggagaacctaacacagcctatgcacagtatttcaccggtaatagctaccttgcacccatatcgcatgaacaggttaatatctccaatgtcacgttcgaacccggttgccgaaataattggcacgttcatcatgcgaagaaaggtggcggacagatgttgatcggtatagcaggccgcggctggtatcaggaagagggtaaaccggcggtagagattcttcccggtacagtcatacatatccctgccaacgtgaaacactggcatggtgcaacagccgaaagttggttcgcacaccttgcattcgaaattcccggggaagactcctctaacgaatggctggaacctgtgactaataaagaatacaatagactcccccaataa

SEQ ID NO: 1462 - DNA, 186 bp, B.fragilis
  unsure (159): Identity of nucleotide sequences at the above locations are unknown.
attaatactgtcccatcatcattgcttacacttacggcacgtaaaaacggtcagcacgatacagagtgcaagaaaacctgccgtacagccgaacgttttctagagcatggcactgtgtatgagccgggcattggccatacaggtgcggatgaaagccgncaaaagaaaaatgagcttttccattaa

SEQ ID NO: 1463 - DNA, 225 bp, B.fragilis
tatttgtatgttgcaccggatcacataaaattgaacttacagttcaaaaacggcttttatcacttaaaaaaacaggatgacggatggctcactacagagataaatcttgtaccatttctctcagtaaagttcttaactgcactcttgtttatacagaaacttttctactttcaggaattaatattgtcgaatggatgcaaagcactaaaaactcaaagcaattaa

SEQ ID NO: 1464 - DNA, 1911 bp, B.fragilis
acctttaatgtgatatttagtatgaaacaaatgatgaaaaaatatctatatatggcagctgtggctgttgtaggtacaggcttcctgatgtcgtcttgtaaagacgaatttgccggacagaataccaatccctccacagtctcaaaaccgaacgtacgctatttatttactcaatgtgccatgagttttcagccggccgattatcttcagtggtttgctggtttcgatgcaatgtctacctgggtgcaggcaactgcctcaggaggtggaaactccagcaaattgaatatggtaactcagaccggctgtggctatcaggtcaacgaggtgcttcgttatacgaatgaaataaagcatcagatcagtctgatgtcggatgatgaaaaagcaaaatacgaatatattgcttatttatgtaatccgatgctggtgtacttgggacttgaagactcggatatgtatggatcccgtcaatattcagaggcagaaatggcccgttatggtgggactctgactccgaaatacgatacgcaggaagaattgttcgaactctggctgaaacagcttgacgagacaattaactatctgagagagaacaatccgcaagacgtgcttggtgcgcaggattttatttatagaggaaaacttgataaatgggctaaactggcaaactcattgaaactcagaattgctgcacgcctgattaataaagacaaggctcgtgcaattgccattgtgaatgaggctgcccagaatccggccggtcttattttaactcttgacgatgattttgttttcaataaaggtaaaagagacaataactggaacaatgatatttccgttggtgcgggaactaagcagttaatcgattttatggtgagcaatcgtgaccctcgtttgttttactttttccagaagaacgattacaactctaatgtagttcaaggtttctttgatcaaaaaagagctttaccgtcttatgtagaagccaatgtgaactatacggtcgatgcggacggaaagaaacactttgagagctggaaagctcccggagagccttgggtacgctattatggagttccttgtcaagtggatatcaataaaaaggaagagtacaaagactatttcgaccccaataacgagttgttctatttgctgagcaaagacggtgcgaaaaagacctatactccgattgcctaccggaataccgaaaatattaaaggtctgttgatttacacattccccgatgttcctgatgtagctcccgtacaggataaagaagaatacggctggtacggactgtacttctctgcaggtgaaaccaacctcctgctggcggaattcaaattattgggtgccaatctgccgatgaccgcacaacagtatttgagtgcaggtgtcgagatgtctgttcgtggttatgattttgtttccgctaagaatcatattccttattatgataaaacctacacaggcgatgtacacgataagacaatcagcctgaaagaaggcatgattgatgaaatgctgtcacatgatgcataccatctgacaggtgatttgagtaaagaccttgagaaagtttatattcagcaatatattcactatctgatgcttccgatggacatgtttgttaccgcccgtcgttcgggagtgccaatgaagaacagtaccttgttgccatatcaggattttgatccgttattgggtgaccagtacgtcattcctcgacgtttcccggtaagcaaacctcttgattctgatttgctccgtgacattacaattgcagcctatcaagcacagggttatacgtatgaaggtgagatgagtaattcacctgtgacgttaagcaaagaacgtgtctggtatgataaagaggcaccggcttttggtacaggtcctcaacagtaa

SEQ ID NO: 1465 - DNA, 375 bp, B.fragilis
gaagtggcagtttatgataatttgcctgtgtataaggctgcatatgacttgttaaggagtgtgtatgagaagacgggaaagattccccgtgatgtgaaatatacactggtggaggtgttgaaaaaggatctgaccgagattatggtaatgatatacagggctaatgctacgactggaaaacttccgtatattgaacgggcaagagatctggttgtaggagtcaaggtccgtttaagactgttgcaagatatgcggcatatcagtgtgaagcagtatgcggcgtttgcccaacaggtggagttgctgtcgaagcaattgtcggcttggcatgattatgcacggagacaggacgcaaagagtcaagaaaaaatataa

SEQ ID NO: 1466 - DNA, 1750 bp, B.fragilis
  unsure (2): Identity of nucleotide sequences at the above locations are unknown.
anaaccttatttatcatcctcttttctttgggatattcaggaatatactcacaggaacagcaggtgaagaaagactctgtctaccaattgcaagagatagtggtatcgtcccaacagatacttgggagtaagtttaaagcaagaaaccgcacaggatcggcatattatatttcgcctgaggaaattcgcaggttgggatatacggatattaatcgtatgttgaaggccgttcccggagttaatatgtatgaagaagacggtttcggtcttcgcccgaacattagtttgagaggaacgaaagccgagcgaagtgaacgcatctcgattatggaggacggtgtactggcggcaccggctccttattccgctccggcagcttattatttccccaatgtagcccggatggaggccatcgaagtgctgaaaggaagtagccaggtacaatacggtccgttcactacgggaggagctattaatttggtatcgactcctattccgaacagtttttccggtaaagcgaacatttcttacggaagcaaaaatacgtttaagtcgcatacatctgtcggaagcagttggaagcatttcgggtatatggtagaatatttgcgttatcagtcagatggttttaagaaatacgaagatcatgctgccaaaggatttaaaagaaatgatattatagctaaaataagggttaaaacggatcatgtaaaaggagtgaatcatgctttggaactgaaattcggatacgcagacgaaaattcggatgaaacgtatgtgggactctctgcagatgattttaagaagactccttttctcaggtatgcaggttcgcaaatggataaacttaaaaccgatcatcggcagtgggtagcaacttatctgctgactttttccaacaagttgaaaataactaccaacgcctattacaactatttccaccgaaattggtacaaactgaatgatgtgcgcgcaggaatcacttcaaaagagaagagatccatcgccgatgtacttgtggatccggaaacgaatatccgttacttcgacattttgacggggaaaacagatcgggaaggggaagcactgttggtaagagccaataacagaacttaccgttccagaggtatacaaaccagggccgaataccgtttcaacctgaacgagtttttcttcgatctggagttcggacttcgttatcatgccgatgaggaagatcgttttcagtgggatgattcttactctatgaaaaataagaaaatggtactgtttatggagggtattcatggtacgaatgctaaccgtgttacttctgccaacgcgttagccggttacctgcttgctaaattaagatatgacgcgtggactgtcactgccgggctgcgatatgaagatgtagacttactgaaaaaagactatacgaaagaagatttggcacggtcgggtaaggtacgtattgaaactccgaatcatgcgcgtgtactgattccgggggtaggattacattatcaattgatgccggctgcttctgttttcttcgggattcataaaggctttgcccctccaagcgcggaattatatcaaaagcctgaaagcagtgtgaatatggaactgggtacacgtgttgctatcgggaattttagggcggaactaatcgggttctacaataattacagtaatatgctgggaagtgatctggctgcttcgggtgggggtcttcaccacggggctgcaaggagccgtgcagtat

SEQ ID NO: 1467 - DNA, 186 bp, B.fragilis
tgccggcatgcctgcccctccggcaggggcggaccgggtgacggcgtgtgtccggctctcggtacgggtagcgggggagactacccgggcggcggtacaggcggatgcgacggtggaggagaagatctcttctgttgccgtttttctggtgtcggtcgacgggagtggaaaggaggattggaatga

SEQ ID NO: 1468 - DNA, 1152 bp, B.fragilis
gttctcgcttatcaggatatcttaagagaaaaagatctctgtggaactctgtgttactctgtggtgaaacacccgttcaatcataaaattttcccaaccatgtccgataagtttcagactttctgtttttcccattccggcagttggtttctgccgttcttgtggctttcgttgttggcgggcttatctgcctgctcgtggaccggggacgaccgtagcgactgtcccagtggtttccgtattcgtcttcagcctgcattgcatgcacagatacagcccgacagcgggacaggcgtcatcaccgacgagatcgacacgctgtccctttacgtgttcgacgcacagggacagttcgtctgcctgcacacagagaacaggcaatcgctgactgaaaacgattatatcattaccctgccgctggaatataaagacggagacgtttacgaactggtgttctgggcgggaggggacaaccggcattaccggatgccacaactcacaccgggcagttcgacccgtgacgagctgaccctccggttggaacgtgacggagacggacgtcaggatgacgaattggggcacttgtggtacggtcatctccggttgagccggatacagccttcggaactgacatcggtcagcgtaccgatgttgaaggacagcaaccggttcgtcattaccttgcacgatacgtcggggcaggggctggacgccgatgattacgactttacgctgttggcggataacggccggatgaatgctgacaacgaagtgatgacgggcgaccgggtgacttatgccgcctatcataccgagtccgcttccgaaacggaaccggccgccacccgtacgggagaagtcagcctagcgcgtgcccgcttgaacacactgcgcttactggcggatcaggaggcccgtctggtggtgacggaccgtgtctcggggcagaaagtagtggatgtcgacctgacgcgttatctgctgatgacgcgccccctgtttgaagagagcaacggtgtggagctcagcgaccaggattaccttgattacgaagatcggttcaacgtgattttctaccttaccccgatgggaaagctggaggcgctgaacattaacggatggattatcagactgaacgatgcacaactgtaa

SEQ ID NO: 1469 - DNA, 879 bp, B.fragilis
cgtaaaaaagaaatgaaaaaactaaagtacatgagtatgatggggttggctgctttattgctgacaacctgggccgcctgttccgacgatacggatgcttcgggcggagagaatccggaagaagcgagagcttataccacagtgaccattgccgtaccgaatggtgtggcggagacaagggcctccgatccgacggcggatactgacgatacgaatatggatatcggtttaacggatgaatacaaagtgacgaaggccaatctgtatctgtttccgggaggaacgggtagtagctttggtagcgctaagttgacagagattatttccatcagccagtttacgcaaaccaccactactactaccgaccagaagaccattgtatggaccagtaagaaaacagccctgaccccgggagactatcgtatttatatagtggtgaacggtacggtcaatggggtgggtgacagtgacaagggaactctgaccgaagctgcttttctcgcaaagacaacggctgctgctacgagtgtgatagctgctgtaccgagtgacggactggtaatggcgagccgttctcccaacagtaataactcgaatactcttccttatattgcccaggagataaccaaagacccggagcagaccattgcggcaacagtggagcgtgtgatgggaaagattacggtgactgcgggaggaaccagtgcgtcttctgctgctactgttaataaatatacttcgttttctaccacagtagctcagatcaacaatattaaggatatcaccctaaaaactcattatgtagtccacgccggaaaagagggatattatttccgtcatgtggataaagaaagctctgcaacgaatcctttgacttag

SEQ ID NO: 1470 - DNA, 753 bp, B.fragilis
  unsure (170): Identity of nucleotide sequences at the above locations are unknown.
cagatccgagaacgtatgataaaacttatacttccaccacctgttttagccaatagctatggcaattggtatctgcaaggatcaagcgcatttggcttgtcgtctttcggcactttttccggaacttatacggatatgccgggctactcttccggggcggtggaaactanagtcgccgcttactgctatgaaaacacgatgctgaaggataaacagaagaacggatatacaaccggcatcgtatttaaagcggaaatagctccgagtaaaatgatgaaaaaaaggtcttcgggcggtggtgtggaagaaactactacaattggttcgattggtgaaatcttctaccattccggtatcttctacaaagatattgaagcgctgaaagaagccggtgtattactggcagacggaactacttccagttcggccagcggtgtccctgccgacctgaaaaagaacgacgtccagtgtttcaagaaaggaaataccgatggcaagttcttttgttattatccgtattggatcaaacatctcccctcggatacagcagaagatgtgatggagttcggcattgtccgcaacaatgtctatcaagtaaccgtcgccagtattcaaggtgtcggcaaagacggtgtaaccgaaaatatcattaccgataccgaaaccgatgatccgactaccgtattgctgaatgtgaagttaagtatcaaaccttgggtagtgcgtgcgaatagtgccgtattgggccgttaa

SEQ ID NO: 1471 - DNA, 1488 bp, B.fragilis
atatcggggagcgaacaagaaaaattttctggcgccgacccgtgcgggcatcagtctgatttatatgttaaaataaaaagtcttatgaaagagaagatacgatcgacccgtttaagaatgtgctttcggaagatgccgccggcagtgtgcttcctgacgctctttgcactgtgcttcggtgcgctgtctgtccgtgcggcagatccgtccggaagagtagccctttccgccgtccgaatgcagcgtgcgggtggacaggtatatgtctcgtttgccgtaaagatagccccccgtgcagtgcgtgcccgtcaccgctgggtgattaccccttgtctgggcaacgcctcggatagtgtgttgcttggcccgtttgtggtgacgggacgcatcatggcgcgcgaggaaaatcagcggcgcctattggccggccttccggaccgtgacgtcaatcatcggtggaccgcccgcaatggagacaccttcttgtataccgatacgttgcgctatgccccgtggatggagaatggcttgaacctgcggctcgacatcgaccgggaaggttgctgccgggtacagacagtgggaagcatcgtctcctccggcgcttttccggtggctttgccctatcgtccgtcggttagtgagctcactccgagggtgagccggacggtggcggaacatgcggatgactatccgttcctgtgcgaggcaggcagccgccccctgcatgaaagtggcatcggtattcgcttccgtgcggcatcggcagtggtggatacgctgtattccgccaatgccggaaacctgcgccggataacggaagccatcgggttgctgcgtgcggacagttgcgcatttctgcaaggtatctcgatcagcggatatgcttcgcccgagggcacgacgggactgaaccggaaattatcggcgaaacgtgccgaagctctgcggcatgctctctcggtgcgcatgaacctgcctgtatcgttgtttgaactgaatgccggaggagtagactgggacaggctggccgaactggtgaatgggagtgacatgacatataaggaggaagtgctcgctattctccgcagtcatccggaggaagagcggaatgacaggctgaaagccttggcgggcgggcgtccgtatcgttcggtgctggatgtgctctatccgcagttgcgcgatgcctgctacatccgtgtgcagtatgccaaccgccctgacagcgtggcggatacggtgaaccgtgcgatagaagccattcgggggcggaagtatgaagaggcattccggttgctgaagacggtggaggcggacgaacgctcgtggaatgtacggggagtctgccatctgttgtgcggagacgacaaggaagccgggctatggctgcatagagcggtgaaagccggaaaccgggaagcggaagaaaaccttaaaaagatgaatgcggaacgacgggccgctaccatcggtataacgcaataa

SEQ ID NO: 1472 - DNA, 339 bp, B.fragilis
gccccgctattgcctttgtcaagtcattctacggacaccttcttgggtgtacatgcgggtgggggagaatccaacctgagccgggtgcatctcctttttgtttcccgttgggtttcttcccgctacgaggggtgggcgctgatgccggggttttcatcgggttactcgtgggtgctcggcaaacgctggaatctggaggctaccataggtgcagggtgggtgcatgcccaatacaaacgttttaattgtccggtctgtggtgaatatcggggagcgaacaagaaaaattttctggcgccgacccgtgcgggcatcagtctgatttatatgttaaaataa

SEQ ID NO: 1473 - DNA, 1035 bp, B.fragilis
cgtactgcgtcgccgttctctccatccggcacggcgtctgtgaacggaagatctatgaaatcgtcggaagattcaaaaaggagtgtacgctccatgcagtataaatgccgtccgttttttgttttcatgggaaaaactgaagaattttgctgcccggaaatacaaacacatatattacacgacaaaatgattatgaaaaaggaaaagacttactcccgtgctccgctccctttcgtggggcagaagcgcatgttcgtatcggaattcaaaaagatcctgaaacattttgatgacaaaacgatatttgtcgacctgttcggcggctccggcctgctatcacacattaccaaacgtgaaaggccggatgcggtggtcatatacaatgaccatgacaactaccgcgagcgtttggaaaacattgaccggaccaataccctgctgagagatctccgtaaaatagtcgggatatatccccgccatcagaagattaccggaaaaatgcgcgaggctttccttgaacgcatcaggctggaggagacaaccggtttcgtggactatcttaccctctctacttccctactgttttccggaaaatacgcacaaaacatggaggaacttgaaggattgtatttttataacaagatacgccagtctgactaccggtgtgacggctatctggacgggcttgaggtagtctgctacgactataaggaactggcagacacatacggggtgtttccgggagtggtattcctggttgatcccccctatatgggaacggatatcagtacatacaagatggactggaagctggcggattacctggatgtcctgctggtactgaaaggacacccgtttgtctatttcacttccgggaaatcccccatactggatttttgccgctggatggaagagcatcccgggatcggtaatcctttcaagggagccggccggtccacacttaccgcacggatgaattacaactcctcctataccgatatcatgctctacaaagacctgccaagggcggcctga

SEQ ID NO: 1474 - DNA, 264 bp, B.fragilis
gcgcgcggcacaaccacatacatacagttcattacactttccgcccattcaatggtacgtgcgacaacggttgcaccatccttgctcttcaaggtaatacccgtacaggctcccgccggtatttgcggaacgctacataaaactgacatcaataatgctgataattttgtattcatactttctattttaatggtcgtttatggtagtgtaacacattccattcccgaaaggttgattacaatagagagtaattattcattttaa

SEQ ID NO: 1475 - DNA, 435 bp, B.fragilis
aatttgaaaacgcataaagaagtaacttcaaataaaagtaaaacactggattttgtaataagtaaaacaatgaaaatatttagatatatattgctcgcctcgcttacctgtacgcttttctcatgcggcccggatgaactgataccggaatccgtgccaccggtggtgaatcccggggataaggacgagccgggtgaagaaccggaggagccggaagagcctgaaaagatacagttagccatcaccgcatcattgcagaacatgcagcagaccaggggaatcatagaggcttttgctcccggccatgaaatgggagtctttgtcggaacaagtcagacagatgaagcagcaggtataaaaaacgcctcctatctttttgatgggaaagtatggaatgccggacaggatgtaccggtggaagcggacgccggtctt

SEQ ID NO: 1476 - DNA, 351 bp, B.fragilis
catacagatgcgcatcaccgcacgaccgggggtaaatacccttgtcgcgggatgcgcttttatctgtatatgaatgattggctttgcaaagataaaaaaatattcgctatgacactatttgagattttaaattttaatagagaactactggaacgtctgacccgcatgggtttcaaaccggatgactataaatatatcgacctgtacaaggagtatgaacagatgcgccggcagggtgataaggtgacgtactgcgtcgccgttctctccatccggcacggcgtctgtgaacggaagatctatgaaatcgtcggaagattcaaaaaggagtgtacgctccatgcagtataa

SEQ ID NO: 1477 - DNA, 1101 bp, B.fragilis
acgaccattaaaatagaaagtatgaatacaaaattatcagcattattgatgtcagttttatgtagcgttccgcaaataccggcgggagcctgtacgggtattaccttgaagagcaaggatggtgcaaccgttgtcgcacgtaccattgaatgggcggaaagtgtaatgaactgtatgtatgtggttgtgccgcgcgctcaagagttgcagtcactgactccctccggtatggatggacttaagttcagggcaaagcatggctttgtgggcctggcggtagagcagaaggaatttgtggtggagggcatgaacgaaaagggactttccgccggattatactattttccgaactatggtaggtatcctgtttatgatgcggcacagagggacaagagtcttgcggattttcagttggtatcatatgtgctggcagaatgcagcacggtagatgaagtgaaggaggccctttcgcaggtgcgtgtcatcaatattgatccccgttcgtccacggtgcattggcgctttaccgaagcatccggaagacaggtggtgttggagattgtaaatgaaatgatgaacttctacgacaatccattgggcgtgttaaccaattcaccgggtcttgaatggcattggaccaatctgaacaattacatcaacctacaaccgggcacgttacctgaacataacttcgggccgttggagccgaagtctttcgggcatggcagtggtctgctgggacttcccggtgattttacacctccatcccgttttgtgcgtgccacctttttccaacttacggcaccacaacaacccgatgcaaaaggaagtgtgttccaagcgttccatattctgaacaactttgatattccgacgggtagtgaacagccctggggaaaggcgtcagccaatgtaccgagtgccacccagtttaccgttgcgtgcgatatacgggaccagaaggtttattatcgtaccatgtacaacagcaacatccgttgcattgatttgaaaacgataaatttcgacaatgtaaaatatcaagcggatcctttggatgaaacgaaggagcaaccggtggaaatgaaagtgataaaatag

SEQ ID NO: 1478 - DNA, 189 bp, B.fragilis
aaggtgacaaaattgaatcaaattgctcttctgtatattccaaccctgtgtggactgtatacgtcatttgttgctttcgttgtgctgcaacatagccaatctgctaaccacagaactgtatacatggcaaatggtaaagagaatgtcaagcgtaaccgtatgaaagggtcggacaagacaaagtactaa

SEQ ID NO: 1479 - DNA, 426 bp, B.fragilis
ctcaataagaagaagctaagttttctatttctaaaggtgataattacagaagctatcaaacaacttttttcttctcacacattccaaacgctctcccttgaaagtaggacattattagacgaatataatttcacaaaatccatgatagcaaatcttttggataaacaagaaaaactctaccttgtaccctctactaaaaaggaaaatgaacttttagcagggattatccttaatgatgaaattatttatctactaaaattttcaaaggcatctgataacatttatactctttacaacgaaacaaacgaacctatatgcgatgtcaaatatgattttgaaaaacaaaatatagttattattagcaactatggaaatgatgctatcccccctacaacacaagttggtacagttttgtttgtaatatag

SEQ ID NO: 1480 - DNA, 816 bp, B.fragilis
tcaaggagatgcaaacgtatgaaaacaattacaacggcatgtgtgaaccataagggaggtgtcgcaaagacaacctcgctgctgaacctggcagccgggatcgcacggatgtataagaaaagggtctgcattatcgatgcggatccgcaggcgaatacgacaatggcagcgttcggggaggaaatggcaagccttccccgggaggttctgctcgagagtgcgctacaggactgtatgcaggacactccgccggagttaaagccgcaaaagtggctggagaaggtggacatactgccggcctccctggatctggcggctacggaagtaatcatgtacaccacacccggaagggaattccttttcagggaaatagtaaaggggctggaagagaagtatgaccacatacttatcgactgtccgccatcattggggatcatcacgcagaacgcgctgatggcaagcgattacgtgatcatacctacggacgggaattacttcgccatgaaaggaattgaaaagatacactatatcatcggcctgctcaaaaggaagctgggagccgaagtccggatactcggatactttatgaccaagtacaatgccaggagaaagctggatatggatatcagggagagtctggtaagaagtttgggagatggtgtcttcgaaacggtaatacgcagcaatgtcgccctgggagaggcacaatacaaggcacagagcatatttgactatgcgccttcctcaaacggggctgatgactacagggagctggtcaaggagttcctgggcagaattaaaaaaataaataaatag

SEQ ID NO: 1481 - DNA, 294 bp, B.fragilis
aagaaaggcaggattatgaaagactttacatcgaaaggaatatccctggaaaacatggtgggagaaaccccgggaaaagaaaaaggtatgacaggaaaaacatcacccaaaacgaaccagaccgttgcactgacggaagatctgaaatgggagttacggacgttcgcttcggaccatcgctgcaggggagtcaagacactgcttgaaacgatgatagaatgtttcgtcagggaagacggtacgcttgaccgtgacaagttagaaggcttctggcgggaatatgtcgaaaaataa

SEQ ID NO: 1482 - DNA, 1569 bp, B.fragilis
ttgtataccatgaaaaaaatatcaattttaattgcggctttaaccctcagcataagcctgaaaccacttgccgctcagaataaaaaggtttttatcatcgataaacagaccgtctatcaagaaatagacaacttcagcgcctcagacgcttggcgctgcgccttcattggtaaaaactggcctcaagagaaaaaagaaaaaattgccgacttactattcaaacgtgaatttgacgaaaaaggtaaccccatcggtatggccttgactaactggcgcgtaaacatcggagccggaagctacgaaaaccgtgaagcaaaggaggtggataactcctggaaccgtaccgaatgtttcctctcacccgatggtaaatatgactttaccaaacaagctggacaacaatggttcatgaaagcggcccgtgaacgaggcatgaacaactttctgtttttcacgaactcagctccctactttatgactcgtagcgcttctacagtttctactgaccaagattgcatcaatctgcaaaatgataaattcgatgactttgcccgtttcttggtgaagagtgcccaacatttccgtgaacaaggctttcacgtaaattacatcagcccgaacaatgagccaaacgggcaatggcatgccaattccttccaagaaggcagctttgccaccaaggccgacctttaccgcatggtagaagaattggataaagcaatcagcgaagctcaaatcgacacaaaaattctaattccagaagtaggtgacatgaaatatctatttgaaattgattcgatagccaaaattccagatgatatcatccactctatgttctacaaagacggacaatacagcgtgctgaagttcaaaaacctgtttaattgtgtagcagcacacgactattggtcggcctaccccgctaccttgctggtggatatacgtaaccgaattcacaaagagctctcagccaacggtcacaacaccaaattttgggcatcagaatactgcattctggaaaagaatgaagaaattactatgccagcctctccggaacgcagcattaacctaggcttgtatgtagcccgtatcatccacaatgatctaactttggcaaatgcttcggcttggcaatggtggactgccgtatcactaggcgaggatgtgcccattcagctattgccacttgaaggttcaaacggattgtcactacaatatgacggtgaaatctctaccaccaaaatgctgtggactactgccaactacagtttctttgtgcgtccgggtatgaaacgtatcgccgtaaaacctacctataaggtaagtgacttggaagccgctacttcactgatgatttcatcgtatactgatgggaaagaagtggtgaccgtagccatcaactattcaaaggaaaatcaggtgattagcctaaactgtgaccatgcccaaaaaggaaaagtttatctgaccaccatcgacaagaatctgcgatacatgggtgaacaaccgctgaaaaagttacagctgccagcacgttcggtagctaccattgtagtcgaagacaactaa

SEQ ID NO: 1483 - DNA, 222 bp, B.fragilis
agcgtgtttgttgccagcatgaaacggcagggtgtagaagtgcatttcaggcacatggaacagagcaataagctacaggacatcgtattcactatggacagctaccatttcaatggttccaaagtgggcaggcgtttcagttattctaagtttggtacaactcttttttcgtgggctgtaccgcctctgtttgccagtggaagcctctgctgccggatatga

SEQ ID NO: 1484 - DNA, 1269 bp, B.fragilis
aaaacgaaagttcgctttctacgggcttggcgttactacatgatggtaactgcatatggtgacatccccttggttacagaagtggttccttctttggaagatgccaaactgccggctaatccagaaactgatgtagtggaattcatccttgatgaactaaatgacatcaccaaagacggagcactggacgtaagtccaaaacagaaaggaagaattacacgcggtgctgctttggccttgaaggtaagattgtgtctgttctacaaaaagtatgatgaagtgattgacgctgccaatgaaatcaatagcttgggtgtgtataatctgtaccaagaaggtgaagttccttactctgaattgttcaaagaagccaatgaagacaactgcgaaatcattctggctgtaaagaaagtaatgaacgactacaaaaaccaaaccatcattgaattctgtaacgtaattgatggcggttggtcggcattcgtacccatccaatctctgattgatgcatatgaaatgaaggatggtctgacaatcgaagaagctcaggctaaaggtgagtataatccagaacatccttacaaagatagagatcctcgtttctatgctacaatcctttactcgggtgctgattggatggataacaagggtagaaagagaatctataatacgctggacagaaacattaacggtgaacctaacaaagatcatcgtcttgattctagaaatgcttctcaaactagctattctatctgtaaatacatgaaaccactgactcaatattcagatataaacaacactggtctggatatgattgtattccgttatgctgaaatcctactctcaaaggctgaagctatgattgaaaagaatacagacctttcgggtgctactgacttgattgacctgatcagagaaagagctggcatgccaaaagtagacagagcaaaatataatacacaagctaaactgagagaattgctcagaagagagcgccgtgtagaatttgctttcgagggcttgagaagagatgatatcatccgttgggacattgccaaggacgtactgaatggtccaatctatgcttctaaccaaggtaccgtagatatggatacaagcattccccaagaggagcgtgctacaattttccaaggtgaaaagaaccaggtggtactcgagatccgtaaattcaggaaccgttacatgccgattccacaagctgaattggataagaacccgaacttgaaacaaactaacttcaaaatataa

SEQ ID NO: 1485 - DNA, 246 bp, B.fragilis
cctgttttatcacttcacctatgtatatattactctttttcatattccaaataccattcagtctttcccaaagataccaatcacataaaaatccccgacagccgtcacggacaccggggaggtataaataaatggacttatttatttataaaatcgtccacccggccgatggcctatcagccggatggagatagaggtcaaaacttaaatccgatcttaaatgtcggagcggccagcacactgtag

SEQ ID NO: 1486 - DNA, 459 bp, B.fragilis
ataaataagtccatttatttatacctccccggtgtccgtgacggctgtcggggatttttatgtgattggtatctttgggaaagactgaatggtatttggaatatgaaaaagagtaatatatacataggtgaagtgataaaacaggtcatagccgaaaagcaggtgacaaaggccgagcttgcccgtaggttgggggtaaaaccacagagtgtggactatctgctgacacggaaaagtatcgatacggataccctgtatagcttgtcgttggcgctggattatgatttcgctgttttatattccataaagaaagaacatgctcttgctacggacgaagagtctccgtttaaagtgggaaatgcaaagatcagtttagagatcgagttgcgtcccgatgaaatgttgaaattgaacctgaaacagaagattgcagacctgttggaaggaaagggaaagtga

SEQ ID NO: 1487 - DNA, 2250 bp, B.fragilis
cggagatatctgccaccggctattaattttgtttcaaattgtataacgattgataccaaactcctgtcagaagcggatactggcagccagctccacggtaaacggacgaatataactgcccgccatccaatgaccgttataagatgccgcatcttttttgtccaccagttcggtcccggcaatgcttcctttagccccggtctgattcaggaaattgataaccgtggcactcaacgcaagatgcttgttcaccgtccagttgatacctccgaaggtttcccagcgtccgttgaaatagtaagcatttttaatgttggcatacgtcttgctgaagtagcggaagctggcccagactctgagatcattcgtgatgttatagctgggatccagttcgacaagcactttcggaatctccgtcacaatattccctgtggcatcgatctcccccaccgtaccgtctttaaaggtcacactcgtttcatacttcttgtaagtcggactttgataagtgaagaggaagtggaagttgaagcccttaaacggcttgatcactgcatccgtcgtccagccgatggtttggatgtcataactcaacggggcggcgagaatctcagtctggtcattcggattaatcaggttcagtgtcgagttgttattcgtcttcgagatataagagaacagagaggtcagactgatccaatcggtgttataatagatcccggcacgtcccaggggaacagagattttatcggtattgggcatagtggccggtgcaaagttcgacaagccgggacgctgtgtgttgtaagtgaaatcggcggtaaaaccaaattcacgggtcagcttataagtagcggcggcagtaaaggccatgttcatccagtcgtagtcgaaaagacggggagtgatcctgactcctttatcggacacagctcccaggtaataatccggaaaacggcctacggcattcccttcggcatcgtatacagccgcattttcaccttccaggtgctgccattccagacgggcgccataatacacgttccacttgggcgaaatatcccaatcgtgagtggcataaacagccagtttgttttcatgtcctttataatattccgaagcattcttattgaaatcgtaatatacaccatctgtattcccttcacgtaccagacgttcgggatactcctctaccgtatgatcgtacatggtagtattcgaagcataatccaccttatagtgccattcgttcactccgattctccaggtcgtattacgataggaacgggagagttcggaggtagcgaaaaactcatcgatttttccccggttaaggcaagacatgcggctctgcacatatccttcatacggtttcaatgtaccgtctaccgctttcaggtagtaaccggcagaggcatctttctgttccatggccattggagtctggtagacatacgagcccaaggcatgatcatacttcagattgatcttccagttcaggccattatcccaggtgtacgtgttgagcaaggtcaactggtttcctttattcaaagtggcatcataaagattggtctccttcagttcacccgtacgcatgtcacggtaggccatttcgcccgttgtaggcagataggaacttgttccgaggctgaatcccggtatttctttcacgctaccgtcgcctacatagatgaaaggggcggaagtcacttcgttgcttggccaacggctgttgctgtagtgatagatagccgacagctgtccgcgtccttcattataattcttggtcagggctgctttatagatttgagtacggtcctgattcgatgtaaaacgcagtttgaaactgcccggatcaaaattttggtaaacgcttccactgtagaaccatcctttccccataccaccgctgatattagcatcgaactgctgcttgccaaagtgattggtactataattgacgattccacgaaacttttctgttcccaactgggtaaaagagtttacagcataaccgatattgccggtagtaatggcggtttcggagattttgagcaacccgacgtgcccgagactgctgtctccacgccagtgcgtatttacattatgcggattagaggtatagactacggggagtccgttttcgagtacatttacgtctccacctggcaagccgatagagatttcgcggggaccattggcgctcgaagcgttcagcataacattacgattgccttcttcctttga

SEQ ID NO: 1488 - DNA, 411 bp, B.fragilis
gtgaagacggagtataatgacgcattggctgccgtatcgggtgataatgctacggcatatgctaatttattaactgctatggataatgctgttaaagcacgagtggagactctaatagcatactataaagctgatcataactattctgttcagaacacattggcttatacattacaaactatagctgatggcttggctgattatgatcagttgattttagtccagaaacaagctattgctgctgctgatgaaaatatagctaatgccgcttcagttgtatcaaaggaacaggctattgctaatcaggagaaaaccattgctgaccttgaaaatagtttggctgtaaatgaacctatttacaatgattatttagctcagatcaaagctttagtaggtgactctgcagaataa

SEQ ID NO: 1489 - DNA, 786 bp, B.fragilis
  unsure (510): Identity of nucleotide sequences at the above locations are unknown.
aaaaagtatcgtatgaaaataaaaagacttttagtgttggccgttctacccatgctgtgtcttgcagtgaatgcacagaactccagtaaagacaatactcctaaaaaaggagactttactgtagcagctactgttggatacaatagttacacaagtgtcacagccccttcggggctgctgactgactatgaagtcagagcgctctcaaccaactgggcagacaaaaagctgatggttggttttgaaggaggctggttcttcaaagatcagtggaaactaaatttgggtggcggtgtcagcttcacgaataaccccggttatccggctgttcccggcacaatagacgattcgaataagaataactcggctgacgagaatatgggagagattcctaattatcgtgccgtagccgatgctcagtcgttcgcctataatgtgtcagcaggtgttgatcgttatttcaacatcaagcgtgttcctaacctgatgtggtatacaggtattcgcgtnaggtttgcttacggtgaaaatgaaatgaagtatgatgaagagacctctatgggcaaatctattgccgagagttggaatcttcgcggcgccttgactatcggtgtcgactactttgtttttcctgcactctatatcggtgcgcagatcgatccgtttgcttatacgtacaacaagactacgtataatccgcaagcaggtcttggcgatctgtcggcagacagccacaactacagtgtgctggccgctccgacatttaagatcggatttaagttttga

SEQ ID NO: 1490 - DNA, 795 bp, B.fragilis
aaataccatgttatcatgaaaacaacttttatgaatgtaagtagaggagtgatcggtgctttggctttctctctcggaatttcgtcttgccaaagttcacaaagtaaaatgacatttgaacaagaaggcgacagccttacggtgattcatattacaaatcctacacagtatttacttttgcccgtcgaggagaagactcccgaagcacaggtctgcattgcttcggactcggttccggtagacatggacgtacgcctgtcaagggagaaagtggactattttgttccctttgctttgcctaagggagagaaagaggtagccgtgcgtatccgtcacttgccgaaggaggctttgtgttggaaagaacttaagctttcggatacttttgatacgaccaatacagaccaataccgtcccttgtatcaccatactccgctctacggatggatgaacgatgccaacggactggtatataaagatggtgagtatcacttgttctatcagtataatccttacggctcgatgtggggcaacatgcactggggacattcggtgagcaaggatctggtgcactgggaacatctggagccggcacttgcccgcgatacgctgggacatattttctccggcagttcagtagtggatgatgccaatacagccggatatggggcaggggccatcgttgccttctacacttcggccagtgataagaacgggcagatacaatgtatggcctatagcactgacaacggacgtacgtttaccaaatatgaaaagaatccgtcttcaccacgg

SEQ ID NO: 1491 - DNA, 2373 bp, B.fragilis
aacaaatcttttagttgggaaatgggattccgcgttcctttgcggcatcaaaacaatctcaatcaactaaaaaatttaagtaccatgatgaagaaccagaaaagggctgtttgcttgctggcttgcttgctgatagcgggcttcacagctgcacaggaaaagaaagaatctgctcaaacagcttccggatcaaaggaagaaggcaatcgtaatgttatgctgaacgcttcgagcgccaatggtccccgcgaaatctctatcggcttgccaggtggagacgtaaatgtactcgaaaacggactccccgtagtctatacctctaatccgcataatgtaaatacgcactggcgtggagacagcagtctcgggcacgtcgggttgctcaaaatctccgaaaccgccattactaccggcaatatcggttatgctgtaaactcttttacccagttgggaacagaaaagtttcgtggaatcgtcaattatagtaccaatcactttggcaagcagcagttcgatgctaatatcagcggtggtatggggaaaggatggttctacagtggaagcgtttaccaaaattttgatccgggcagtttcaaactgcgttttacatcgaatcaggaccgtactcaaatctataaagcagccctgaccaagaattataatgaaggacgcggacagctgtcggctatctatcactacagcaacagccgttggccaagcaacgaagtgacttccgcccctttcatctatgtaggcgacggtagcgtgaaagaaataccgggattcagcctcggaacaagttcctatctgcctacaacgggcgaaatggcctaccgtgacatgcgtacgggtgaactgaaggagaccaatctttatgatgccactttgaataaaggaaaccagttgaccttgctcaacacgtacacctgggataatggcctgaactggaagatcaatctgaagtatgatcatgccttgggctcgtatgtctaccagactccaatggccatggaacagaaagatgcctctgccggttactacctgaaagcggtagacggtacattgaaaccgtatgaaggatatgtgcagagccgcatgtcttgccttaaccggggaaaaatcgatgagtttttcgctacctccgaactctcccgttcctatcgtaatacgacctggagaatcggagtgaacgaatggcactataaggtggattatgcttcgaatactaccatgtacgatcatacggtagaggagtatcccgaacgtctggtacgtgaagggaatacagatggtgtatattacgatttcaataagaatgcttcggaatattataaaggacatgaaaacaaactggctgtttatgccactcacgattgggatatttcgcccaagtggaacgtgtattatggcgcccgtctggaatggcagcacctggaaggtgaaaatgcggctgtatacgatgccgaagggaatgccgtaggccgttttccggattattacctgggagctgtgtccgataaaggagtcaggatcactccccgtcttttcgactacgactggatgaacatggcctttactgccgccgctacttataagctgacccgtgaatttggttttaccgccgatttcacttacaacacacagcgtcccggcttgtcgaactttgcaccggccactatgcccaataccgataaaatctctgttcccctgggacgtgccgggatctattataacaccgattggatcagtctgacctctctgttctcttatatctcgaagacgaataacaactcgacactgaacctgattaatccgaatgaccagactgagattctcgccgccccgttgagttatgacatccaaaccatcggctggacgacggatgcagtgatcaagccgtttaagggcttcaacttccacttcctcttcacttatcaaagtccgacttacaagaagtatgaaacgagtgtgacctttaaagacggtacggtgggggagatcgatgccacagggaatattgtgacggagattccgaaagtgcttgtcgaactggatcccagctataacatcacgaatgatctcagagtctgggccagcttccgctacttcagcaagacgtatgccaacattaaaaatgcttactatttcaacggacgctgggaaaccttcggaggtatcaactggacggtgaacaagcatcttgcgttgagtgccacggttatcaatttcctgaatcagaccggggctaaaggaagcattgccgggaccgaactggtggacaaaaaagatgcggcatcttataacggtcattggatggcgggcagttatattcgtccgtttaccgtggagctggctgccagtatccgcttctga

SEQ ID NO: 1492 - DNA, 384 bp, B.fragilis
atccgcagcacccccaaggcgatttcttcacaatacctttaccagatatttcgatacgacctacttttagtaaaaaggagggagtcatggccccatttcccatgctcctattattttcccgtggtcgtcaatcttccggactttgattttaaacaccaacttccttcattgaactactatcctctaaatcctttaggtggaaaaattttactcaagtgttcaaccagccgtttattccgttcttcgtttgcacgaaatattaatcctttactggaaaaatcccgttgtcaacagactcccactgtcaagaccctattttaccgtaccgccttaacaatacgcctggcacctggttcatggaacaatccctacaccctctgttaa

SEQ ID NO: 1493 - DNA, 1203 bp, B.fragilis; identical to SEQ ID NO: 94

SEQ ID NO: 1494 - DNA, 222 bp, B.fragilis
cgaccacgggaaaataataggagcatgggaaatggggccatgactccctcctttttactaaaagtaggtcgtatcgaaatatctggtaaaggtattgtgaagaaatcgccttgggggtgctgcggatctatcctttctaatatgtatcaaattcgggatttcaatggagcattattgacaatggttgttttcttggaaacagtagacggtcgttattcctag

SEQ ID NO: 1495 - DNA, 1254 bp, B.fragilis
cctcttatttttatcatgaaaaactcaaaaatttatccttggatagtggttgccctcctttggggggtagccctactcaattatatggaccgacaaatgcttagcacaatgaaagatgctatgcaggtagatattgtggaacttcagtcggcaaccaattttggccgtttaatggctgttttcctttggatttatggccttatgagcccgatttccggtatgattgccgatagattgaatcgtaagtggctgattgtcggcagtctttttgtctggtcttttgtaacctatttgatgggtattgcagaaacatttaatcaggttttttggctgcgtgcattaatgggagtgagcgaagctctttatattccggccggtctttctcttattgccgattatcatactgaaaagtcacgttctttagcggttggtatccacatgactggtctttataccggacaagctattggtggatttggagctactgttgccgctgctttctcatggcataccacattccattggtttggtattattggtattgcctatgctttggttttggtattatttctgaaagataagaaagaacacgttaaaacagaacgtttgaaaccttcatcaaagaatggtgaaaaagctggcttgtttaaaggtttgtcgttgctgttcagtaacatagctttctgggtgatattactttattttgcagcacctagtttgccgggttgggctactaagaattggttgcctactctgttcgctgaaaatcttgatattccaatgtcacaggccggacctatgtcgactatcacgattgcattatcttcatttattggcgtgattctaggtggtaccctttctgacaaatgggtacaaaagaacatccgtggtcgtgtatataccggtgcaataggcttgggattgactattccttctttattgttattgggattcgggcatagttttgttgctgttgtgggagccggattattattcggtatcggttatggtatttttgatgctaataatatgcctattctttgtcagtttgtctcttcaaagtaccgtgcgacagcatatggtatcatgaatatgaccggggtatttgcaggagcgtttatcacggatttgttgggtaagtggaccgatggaggaaatttaggtttaggttttgccatgttagctatcatcgtatttattgctttggcagtgcaactctacttcctgcgtccgaagacagataatatggaataa

SEQ ID NO: 1496 - DNA, 450 bp, B.fragilis
acggtcgttattcctagctttgccgaaataaaatatacttttgaaagtatgtatgaatacaatcagtgtcgtatgtataaagggggtaagtttgatatgcttcacggacaagataaaacgatccttccatgcctagctatgggaggtccccagggaggtattggaggaactgccaactacaatggtgtaaatctggttggtattatagaagcatggaaagcaggtgatcttgagaaagcacgtgaattacaaaatttctctcaggaagttattaatgtcatttgtcatttccgcgaaaatatcgtaggtggaaaacgaatcatgaagttgataggattggatttgggtaaaaatcgtactcctttccagaatatgacggacgatgaagaagtacgtatgaagcccgaaccgcaagccattcatttcttcgatcgttgcaataagttttaa

SEQ ID NO: 1497 - DNA, 453 bp, B.fragilis
aaggaaatgattgtatctaatttgcaaaacagtcaacgggtggaaggactccacccactgtttaaaactctgtttgattacgtaaaaacacatgatttatttcatgccgaattaggacgaattgagatagatggtgataatttatttatcaataacgtgaatcctgagtgtgttgcacgtgacaagcaagttttggaactacatcgcgattatattgatgtacatattttgttggaaggtactgagactattggttggaaggctatcgaagatctgaaagatgaagtgaaaccttatgaggcgaacggtgattgtgctctttactctgatgcacctaccacctttgttgatttgcttcctgggcaattcatgatagtatatccggaggatcctcatgctcctcttataggacaaggtaagattcgtaaattgatagcaaaagttaaattgtag

SEQ ID NO: 1498 - DNA, 2094 bp, B.fragilis
  unsure (2002): Identity of nucleotide sequences at the above locations are unknown.
acatctttattattaactcaaaaagcaatacttatgaagaaaaccatcttcttgattttgtgcattttatgttctcttggagccatggcacaaaagaaatcaatcacaggtgtggttacggatgctagcggtgaatcagtcatcggagcgagtgttgtcgaggtcggtaccaccaatggtgtgattactgacattgacggtaagtttacgttgtcggtcgatcctaacggaaagatcagagtatcttatatcgggtatcagcctcaggtacttgatgtaaagggcaaaaattcttttaatattaaattgaaagaagactctgaaatgctggaggaagttgttgtaacggggtatggtggcaaacagctgcgtacgaaagtgacgaactctattgcaaaagtaaaagatgaagcattgaaagtcggcttattctctaaccccgctcaggcactctccggagcagttgcaggtttaaaggttacccaagcctctggtagcccgggtgcggctcctaaagtaacgcttcgtggcggtactaacttcgatggttcaggtgaccctctggttattgtagacggacaattgcgtgacggtatgcaggatatcaatccggaggatattgaatccatggaagtcttgaaggatgccggagcaaccgctatttatggtgcgcgagcaagtaatggcgtaattttaattactacaaaaacaggtaaagaaggacgtcgcgaaatcaacttcaaagccaaaatgggtttgagctatgtaaataacccttatgattttttgggagccaaagattatatcaacgtactgcgtacaggctatagtaaatccggatttacaacctcagacggagagtatgtctctattgccccacttggtaacttgacaagtgcttctccattcggtactggtaatacactgaatgataaaacgatctggaatattatgaataaaacggcagacaatgcctatctgttacagaaaggatggcaagaaatgccggatcctctggatcccagcaaaaccattttatataaagatactaatccggcagattataacctgaataatccggcaatatctcaggactataatatcaatatgtccgggggtaatgataagggtacttactatgcaggattaggttacaaccgtcaagagggacttcctatcaagacattctatgagcgctatagttttgttttgaatgccagttataaaattacagattggcttaccagttcatccaatttcaattataaccgtgcaaattggaaaaacatgccgggatcacaaaccagtgaaggcaattacttcggacgtatcatgtctacacctcccactgtccgcttccaggatgaggatggaaatccaactttaggtccggtagctggtgatggaaaccagaattatcagcccgacaaatggtggaattttaatcagagtgacaaatttaccatggtacaggccttccagattgatattttgaaaaatctttctgtaaaaggtactgccaactggtattactccgaatcattggctgaaagtttcaccagagactatgaaaacacgccgggtcaatttgtgagaacacgtagttcttcagcaagtttctccagagatttctctcagacctataatgtggtattaaactataatcaaactttcgctaaagatcataatgtggctgttatgttgggtatggaatattttgatagatatagccgcagctttagtgcatccggttcaggagctccaacggatgattttgccgatctatcattgacagataatggagaagggaaacgttccattgattcaggacatagcgattatcgtattctttcttatttcggacgtctgaattacgactataaaggccgttatttactttctgctgtcttccgtcaggatggatattcatctttattaggtgacaaccgttggggatttttcccgggagtttctgccggatggatttttggacaagaaaatntcgtaaaaaatgctctgcctttcctgtcatttggtaaattacgtgcgagttatggtgtaaatggtaactcaaccggaattggtgcgtcttca

SEQ ID NO: 1499 - DNA, 222 bp, B.fragilis
agcctaaggtctatcggtttaaaaccaagacccctttcctttgaaaccaacggaactttggttttaaaggtattttcacgttggtacaatactatctatcagcacattgtgagtgagacattcgccaaagcaggctcctcggttcgcatcttaattactgacaaaaagaactacaaacccacttccgagagatgtgtcgaaactcttttcaccacagagtag

SEQ ID NO: 1500 - DNA, 990 bp, B.fragilis
agaaaaaacaagaagatgggattattcataaagaaaccctttgaagccctattggcagaggccaatgcgtcgggcagtaaatcattaaaacgagtattaggcccctggagtctggtagcactgggcgtcggtgttatcatcggagcaggactcttctcaatcaccggcaccgtagcagcgggctacaccggaccggccatcaccctttcattcgccatagctgcactcggatgctgcttcgcaggactctgctacgctgagttcgcttctatgattccggtggcaggcagtgcttatacgtattcatacgccaccatgggcgaactgatagcctggatcatcggctgggatctcgttctcgaatataccgtagcagccactaccgtcagtatcagttggagccgatatctcgtcgtctttcttgaaggactcgatatacatctgccgcaagccctgaccgcctgcccatgggatggaggaatcgtcaatatcccggcgttcctgatcgtagtgttgatgagcatcttcctgattcgcggaacagaaggcagctccatcttcaacggcatcattgtatttctcaaagtatcggtgatcgccatattcgttgtcctgcgctggaaatatatcaatgccgacaactatactccatacatccccgccaatacaggtacactgggcgaatacggtctctcgggtgtcctgcgtggagccgccatcgttttctttgctttcctgggattcgatgccgtcagtacggctgcacaggaaacaaaaaattccgaaacggaatatgccgatcggtattctggtatcactcttggtatgtaccgtactttatatgcctgttgcccacgtaatgacaggagtagcccattaataccgaattttaacggccagaagggcatcgcaccggtagccattgccattcgaacacatgggacatgccgatgcaacagggcatcattcacccggattatcccgtggtga

SEQ ID NO: 1501 - DNA, 351 bp, B.fragilis
aagtggattgaagaggcgcgtgcgttgggtgatacacccgaagaaaaggaattgtacgaatggaatgcccgtgtacagattacgacctggggtaaccggaacgcggccgattacggtggtctccgagactatgctcacaaagagtggaacggcttgctgaaagatttctattacatgcgttggaaactatatttcgactttctttctcagcggatagagggaaagacccctgcggaaattgatttctatgccatagaggaaccttggacgaaagctgccaatccctattctgccgaggcggaaggagactgcattgaagtagcgaagcaggtgatgcaagcggttgaataa

SEQ ID NO: 1502 - DNA, 609 bp, B.fragilis
gccatgacggactacttccccccattcttttcacacatcaacgagaagttccgtacaccggcgcgcagtaacctcctgtttatgctgatagtgggcctgctcgccgcatttgttccggcacgcctggcgggagagatgaccagcatcggtacactgatggctttcacactggtatgcgcagccgtcctcgtagtgcgaaagaccatgccgaacgtaccccgttcatttaaaactccgtttgtgcctctcgtccccattctgggaatactcacttgtctgtgcatgatgcttttccttccggccgatacctggatacgattagtactgtggatgctgatcggactggacatctatgtcggctacggcatgaaacacagtaaactggaacatggtgtgaaaaatcgccggggacaatcggcattgaacatgatcggcattgcactgtctctgctttgtgtcattaccggcttatggcatcagcagactgtaggttggaatgaaagtaaaatattgctgatcatctcgtttgttttcgcatttacgcattgtgcatattatatgatgcggatatggaaagggacaacaaaacaaacgaatgacaacggttaa

SEQ ID NO: 1503 - DNA, 1298 bp, B.fragilis
cattgtgctgtgctccttttgccatgcaggcacagcagccacaaatatataccctgaaatcctgcctggagtatggacttcagaataactactccctgcaaatagtccgcaatgaagagcaagtgagcaggaacaacgccaccccgggcaacgcaggctatctgccgacactcgattttacggcaggatacaaggggacagtggacaacactaataccaaggtccgggccaccggagaatcagtaaaagaaaacggtgtcttcgaccaaaccttgaatgtgggtctgaacttgaactggaccatcttcgatggctttaacattacagccaattaccagaaactgaaagagctgcaactacagggagaaaccaatacccgtatcgccatcgaggacctgatagccaatctggcagccgaatattacaactatgttcagcaaaaaatccgcttgcagaatttccgttatgcggtatctttgtcgaaagagcgcctgcgaatcgtagaagaacgttaccacatcggtaacttctcccgtctggactatcaacaagcaaaagtggacttcaacgccgacagcgccaaatacatgaagcaacaggaattgctgcatacctcgcgcatccagttaaacgaactgatggccaacgaagatgtggatcaaccgctcgtgatagaagacagcattataaaagtgaatgccgggcttcgattcgaagagttgtggaatgctaccttactgacgaacgcgtcactgttgaaagctgaacaaaacaacacgctcgccatgctggactataagaaagtaaactcgcgcaactacccttacctgaagatgaataccggatacggatataccttcaataagtacgatattgccgctaatagccaaagaggtaatctgggagccaattttggagtaacggtaggcttcaacatcttcgatggaaatcgccgacgcgaaaagaacaatgcacgcattgccataaaaaacgcccgccttcaacgtgaacaactggaacaagggctgaaagcagaccttagcaatctgtggcaggcctaccagaataatctgcaaatgctgaaactggaacgacagaatctggtagccgccaaagagaatcacgagatagctatggaacgctacatgctaggcaacctttcgggtatcgaaatgcgggaagcgcagaaaagtttgctggatgccgaagaacgcatactttcggctgaatacgataccaagttatgtgagatttcacttttacaaatcagtggaaagatcacgaaatacctggaatag

SEQ ID NO: 1504 - DNA, 1341 bp, B.fragilis
agacctgtgtggcgcaatgtgcttgataagttgggatataccaagacagagatcaatgaattcatttcgggtccgggattttttgcctggtgggttatgaataacttgggagggtggggtggtcccaatcccgacagctggtatacccggcagattgctttgcaaaaaaagatcctgaagcgtatgcgcgaatacggtatagagccggtgcttccgggctattgcggcatggtacctcataatgcgaaagagaaactcggcctgaacgtatccgatccgggaacatggtgtggctaccgtcgtccggcgttcctgcaaccgagtgatccgcgtttcgaggagatttcttctctttactacaaagaacttgagaaactgtacggcaaagctaacttttactccatggacccctttcacgaagggggaaacactgcaggtgtcgacctcgatgcagccggtaaggcagtgatgaaagctatgaagaaggccaatccgaaggctgtctgggtggctcaggcctggcaggcaaatccgcgtcccaagatgattgagaacctgaaagctggagatttgctgatacttgacctgaccagtgagtgccgtccgcagtggggagattctacttccgagtggtatcgcaagaacggatacgggcagcacgattggatctattgtatgcttttgaattatggtggcaatgtgggattgcacggaaagatggacaatgtgatcgataacttctatcttgccaaagccgatccgcatgcaagcgctacgctgaaaggggtgggaatgactcctgaagggattgaaaacaatccggtgatgtacgagctggtgatggagctgccttggcgtcccgaccggttcacgaaggaagagtggctgaaggagtatgtaaaagcccgttatggcgttgatgatccggtggtacaggctgcctggaccaatctggcgaactctatttataactcgccgaagaacctgacccagcaggggacacacgaatcagtattttgtgcccgtccggcggaagatgtgtaccaggtgtccagctggtcggaaatgaaagattactaccgtccgcaggaggtgatagaagctgcccgcctgatggtttccgtagccgatcgctttaaaggtaacaataattttgaatacgatttggtagatattgtccgccaggcactggcagagaagggacgtctgatgcagaaagctgtgactgccgcttatcgtgcaggtgataaacaactctttgcactggcatcgggaaagttcctcgacctgattttgttgcaggataaactgttgggaacccgtccggagtttcgagtatga

SEQ ID NO: 1505 - DNA, 903 bp, B.fragilis
aaatgtatatcaatgaaaccttaccatattaacaagaagcaaatccttatcatgggctgcctgggaatgtttcccttgttttcttccgcccaggacattttatcaacgtcaggtacctcgcgttgggattattcaaacagccgtgtggagcgtgaaccgggtagagatgcgttggatattactttcagtgtcttccctctggcagggcttggaagccaggaagtcgcttacctgttccccgtctatgtctcggctgacgggcgtgacagcgtccgcctcgaaccggtctgcgtggccggcaagagaagatataaggtgatcaagcgtcgaaaggcgttgggcaacctgaaacccggtaaccccggatccggcgaggtccgttccgccaaggtgctggaaagttcgggcctgactgtgaaaaggagcgtcccttttgaacggtggatggctgacgggcgtctcgttgtcagggaggtgtcgtacggctgtgccgagtgcggcacgaacgagagcgaggatattgcctttcaggccggtatccccctcttcggggaaaaggattatgcttacagtttcatcgaaccggaaaaggtcatgatcaaatgctacaaggattccttcgactgtaaggtggtctttcctgttgcacgccacgacctgcaggaagattttgcaggcaatgctcaggagcttgacagtctgaagaagtttctctcggagaacatgaatattcaaggaacgtcactcaaggaggtacatataaaaggctatgcctctcccgaggggagcttcgattacaacaggtccctcgcgcaacgacgcacccaaaccctttcagattatatttcgcgtcaataccccgccttgtcttcaccacggggctggaagaatccgcgctggcgc

SEQ ID NO: 1506 - DNA, 219 bp, B.fragilis
ttgaccgggcccgaccgcgaaagatatcagctcaaattcttcagttcccgtctggacgatggacggcggttaagcactcccaaagaggcttttaccaccgataattttaccattcccggatgtttctgtaaatcccgccttggtgcacgtggcgggattatacaggaaaaaaaaggaacaccttatttagctaatttatcttataccgtcttcaattga

SEQ ID NO: 1507 - DNA, 3000 bp, B.fragilis
tttatgaatacacttcaaaaaacagcgggagcaattctgtcgctctcgctattgtgtgggatgcaggtttatgcgttccctgactacccttccctgaggggacaaattatcgaacagagtgatatctgtcaaggagttgtcaaagatgccaatggcgaaagcattatcggcgcatccgtacttgtcaaagggacgacaaacggcagcattacgggacttgacggtgatttttcccttaggaacgtaaaaaaaggggatataattgttgtttcttatgtcggctatcagagccaggaaatagcctggacaggtgaaccgttaaacatcgttttgaaggaagatgccgaagtccttgacgaggtggttgttattggctatggtgctgtaagaaaagcggatatggccggttccgtagccgtgctggacaacaaaaatttcaaggaccagcctataacccaggttgcagacgctcttcaggggcgtgtcagtggcgttcatgttgagaacagcggcgtccccgggggaagcgtgaaaatccgcatccgcggtgctaactccatcagcaaaagcaacgaccctttgtatgtggttgacggaatcgtccgcgaaagcggtttggacggtatcaatcccgaggacatccgttcgatgcaggttctcaaagatgcatcgtccactgccatatacggttccaggggttcgaacggggtcgttctgatcactaccaagattggtaaggccggtgtgcgtgaaattatgttcgacgcatcagtgggagtttccaatgtatataagagatacgatatccttggagcatacgattacgctctggcgctcaaggaggtcaaaggtattgatttctcaaacgaagagatgcaatcctatcagaacggaacggggggcatcgactggcaggatgagattttccgtacggggatcacccagaattacaagttggctctttccaatggtagcgagaagacccaatattacatttccgccaactacatgagccaggaaggtgtggtcattgaatcgaagaacgagcgttatcaggcgaaggcgaatctttcctcacagcttaccgactggctgcatatcacggctgacatcaatgcttcccacggtgtgcgtcgcgggggatcttttgcctccggtaaggataatccgatctggattgctttgaactattcgcctaccatgacgatgatggccgaaaacgggaactataacaccgatacttataattccatagcttccaacccggtcggtatcctaaagttgcagtcgggagagacaatgaccaatgttttcaacggacgtgttgatttgcgccttgatataatgaaggggctgacattcaccacaaccaatggcgtggactattatgacgggaaaagttatagtttcagctccaaacgagtggggaccaagagtggtatgggcaataacgatacttatcgtctgatgctgcaaagctccaacaatctgacatatacaggttcctggaatgaccatcatctgacagccacggctgtatatgaggtgacctcctccgaaaccaggacaatgggtataaccggtaacaacctgctgaccgagggtgtgggctggtggaatgtgggtatggcttcctctcgtgatgcaaacaatggttacgagcaatgggcgctgatgtcgggagtggcccgtgtcatgtacaattttaaggatcgttatatgcttaccggaacatttcgtgccgacggttcttctcgctttgccaaaaagaaatgggggtactttccttctattgccgcagcttggacgttgagcaatgaggatttcatgaaggatgtttcctcggttcaggacattaaacttcgcgccagttatggtattgtgggtagccaggccatcagtccttacgcgaccatgggccttatgagtgctactgcatacaattttggaaccaacagtaattttaccggttattgggcaaatgacatagcgactcccgagcttacgtgggagaagaccaagcagttcgacctgggtctggagttctccctgttcgacaggcggctgaatttcagtgtggactatttctataagcgtactacagatgcgttgcttaaaagaagtatccccggatatgtcggcggtaactctttttgggtgaatgacggcgaaatcagtaatcgtggtattgatttgagcgtgaccgcccggattatgcagaatgaccggttccaatggacctccaccttgaacggtacttatttgaagaaccgcgtggaacgcctttccggtggtgagaatgatttcatcaacggctccagtccggctgccggtatggttgattatgccaccattatcaagccgggtgaggccatcggtactttttggggatatgaatggaccggcttggatgaaaacggacatgacacttacacggatgtagatggaaatcagatgatagacggtggcgaccgcaaggtcatcggcaaggccaatcccgatttcaccctgggatggaataactccctgtcttataaaaactgggatctgaacctgttcttcaacggatctttcggagccaaacgtttgaatcttgtaagatatacgatggcttcggccgaagggaattcccgctttgtaactctggcagacgcctatctgaagggattcgacaagattggctcttcggcaacatacccgagcctgaccgaaggtggaaataatctgcagccggtttcaaccaaatggctggagaacgcggacttccttcgtctggagaatatcagtctttcatacactttccccaaaaagacaacgggattcgctgatttgcggcttactttcagctgtcagaacctttttacaataaccgggtacaaggggatggatccggccggtactaccttctcgaacagcagcgttgacgttgacgcgggtattgacatgggagcctatccttccccaagaacattcacattcggtctccggatgaatttttaa

SEQ ID NO: 1508 - DNA, 207 bp, B.fragilis
cgccccggcacgttcaccggtcacgaccacttccccgagtttttgtatgtccggggagagacatacggtatgtatgctgctttctttgaatacctcgttcaaaggcacacgccgggaaccgtaacccaggcactgcacgaggaccgtatccatgaaacacgttccatgaccgaaaacaatcattccacggggggagctgacaagtaa

SEQ ID NO: 1509 - DNA, 864 bp, B.fragilis
gcaacaaaaacagaaacaatggaacttttttatttgaacgagcacacgtcttgttataattactcaaaatctatgcaggagggattccggtattataaatttgacgaaggattgaaccacgaggaggaattggtaaaagattgtatcctgttcgtactcaaggggagtctgcaattctcctgcaacggttttcagttcactgtttcatcaggagagatggtctttttttgccgtgacagcctgtttaacacccaatcactggaaaaatgtgaagtcgtggctgccctgttcgaggggggagtatggccctgtcaaagggcctccttttcagagttataccacctgagggaaattgtcgaatatcgtatggaacctcttgaaatcagggatcggttatgcaaatttcttgaactactggtgtgttatctggaagatggagcgaactgtatccattttcacgaaataaaactcaaggaacttttctggaacattcgcttttactattccagacaggaacttgcgaattttttctatatgattataggccgttcgcaagacttcaaaaataaggtcttgaacaattacaaaagttgcaggaccgtaaaagaactcgcatcggcctgtgatatctccctttccgccttcaaaagacagttttccgcggagtttggagaggctccagccgaatggatgcagaaacagttgttgggagaaatcaaatacaaactttcagttacagacctgccgttgggaaccattgccaatgaactggagttttcctctcttgcacacttctccagattttgcaaaagatgtctgggatgttctcccagagagttaagacagcagataaaaggcgggtaa

SEQ ID NO: 1510 - DNA, 624 bp, B.fragilis
agtaacgaaacaatgaataacagtatgatgaaaccgttttttcttctggtgtttttgctttgttcggctggtgccttctctcaaaaggttgccttgaagaacaatctggcctacgatgccttgaaaactcccaacctctccttggagttctccatggggcgtaaatggacccttgacacacaggtgggtatgaatttctttttctacacgcgggacgccacgtcttcccggtacaaggcaaagaagttcagtcactggcttgtccagccggagctccgttattggacctgtgacgttttcaacggctggttcttcgggttgcatgcccatggcggccagatgaatatcggaggtgtcgatgtccccttcgtgcttcagaaaggggacggaaacatgaaggaccaccgttacgagggttatttctggggaggcgggttgagcgccggttaccagtgggtgctttccaaccgtttcaatatcgaggcctccttgggtatcggttacgtgcacgcccgttatgacaagtacaagtgtaccacctgcgggcagaagctgggcaagggggatgcggactacataggtcccaccagggccgccatttcaattatttacatgttgaaataa

SEQ ID NO: 1511 - DNA, 291 bp, B.fragilis
aaatcagatgcgttttccgttcgttcattgtcacatcctacaaatataaatccggccaagagcaatacaacactccataatgtgaatttacttttcatatttatatttacaacaataattgataaaaataatatatctataaatcttgccaagaagaatattaatcatctaaggcaaacaaattatctaattaacaacaatatatttattgaatataatacgcagcccattatttattgtgcaaagaaaaaacaagataaaatattattgattatcattttagccctataa

SEQ ID NO: 1512 - DNA, 1404 bp, B.fragilis
aaaaaatcctatacatacaagacgtaccgttcccttaccgacgggtctggaaccgacttcccgtctttcgtgcaattttcccgcttggttactgaacttttttggtctttttccgatttgatgcatataagtttatgcttcctttccaggaaacaaggaagcgtcaaatgtctaactaataaaaaacttatggcaacagttaaaacagtattggtaaaaggaaggagcaaccggtccggcaaattcccgttagtcgtgcaggttcttcacaagcgaaggaaaaaggttgtttatacaggattcagtatcccggataccctgtttgatcccgtaaaagggagggttatcgacggcggggaaaacaccccggagtcgattcggaggatcaacaacaggtgcgaaagtatctcaagggtactgttaaagtgtatttcaatgatagagaagaaatcccgggaatacgaaatagaggacgtattcaggacttacggcgtgttaacccgcgaagccggtttttatttctatttttcacggaaaatccgagagcttcgtgaaagcggtcatgagggaacagcccgggcatacgcctccagcctgcgttccatgcagaggtacctgggaaaaaaggattttcctttcataaaactctcttcccggatcatttccgactaccaggggaaactactcgcttcgggtatatgcgataacaccattggtttttatctgcataatatcaaggctcttttcaggaagggatgtcgggagatgggcctggaacttccttgcccatttcgcgatataagcattaaaacggaaaaaactctcaaacgctcccttgatccggttgtgattaaaacactatccgcaattgaactggaaaaggacagcccgttatctcttgcccgggacattttcatgttcagcttttacacgcgtggaatgtcattcgtcgatattgcattgctaaaaaagaggcatgttttcccgggtgaaatctgttacaggcgtcacaagaccgatcaattgatgcgggtaggtataaacaaggagatcagtcgtatcctggaaagatacaagaatgtaccgggagaatacatcttcccgttgtttccggcagaacgggatccgtacgctggttatagaagtgcctaccataggattcgttactccctgggaaagatttcccgggtcattggtttggaattcccgctgagacttcacgcggcccgccattcatgggccacgatagccaaggtgaacggtgcctcggttcatgttattggtgagtgtctggggcatacgtcggaaaaaacgacccgaatctatctgaaagaactggatcattccgcactggatgcggttaataatcaagtggctgacttcattttagcggtggatgattga

SEQ ID NO: 1513 - DNA, 1461 bp, B.fragilis
aaccggctgcagattatttccaccttcggtcaggctcgggtatgttgccgaagagccaatcttgtcgaatcccttcagataggcgtctgccagagttacaaagcgggaattcccttcggccgaagccatcgtatatcttacaagattcaaacgtttggctccgaaagatccgttgaagaacaggttcagatcccagtttttataagacagggagttattccatcccagggtgaaatcgggattggccttgccgatgaccttgcggtcgccaccgtctatcatctgatttccatctacatccgtgtaagtgtcatgtccgttttcatccaagccggtccattcatatccccaaaaagtaccgatggcctcacccggcttgataatggtggcataatcaaccataccggcagccggactggagccgttgatgaaatcattctcaccaccggaaaggcgttccacgcggttcttcaaataagtaccgttcaaggtggaggtccattggaaccggtcattctgcataatccgggcggtcacgctcaaatcaataccacgattactgatttcgccgtcattcacccaaaaagagttaccgccgacatatccggggatacttcttttaagcaacgcatctgtagtacgcttatagaaatagtccacactgaaattcagccgcctgtcgaacagggagaactccagacccaggtcgaactgcttggtcttctcccacgtaagctcgggagtcgctatgtcatttgcccaataaccggtaaaattactgttggttccaaaattgtatgcagtagcactcataaggcccatggtcgcgtaaggactgatggcctggctacccacaataccataactggcgcgaagtttaatgtcctgaaccgaggaaacatccttcatgaaatcctcattgctcaacgtccaagctgcggcaatagaaggaaagtacccccatttctttttggcaaagcgagaagaaccgtcggcacgaaatgttccggtaagcatataacgatccttaaaattgtacatgacacgggccactcccgacatcagcgcccattgctcgtaaccattgtttgcatcacgagaggaagccatacccacattccaccagcccacaccctcggtcagcaggttgttaccggttatacccattgtcctggtttcggaggaggtcacctcatatacagccgtggctgtcagatgatggtcattccaggaacctgtatatgtcagattgttggagctttgcagcatcagacgataagtatcgttattgcccataccactcttggtccccactcgtttggagctgaaactataacttttcccgtcataatagtccacgccattggttgtggtgaatgtcagccccttcattatatcaaggcgcaaatcaacacgtccgttgaaaacattggtcattgtctctcccgactgcaactttag

SEQ ID NO: 1514 - DNA, 1029 bp, B.fragilis
ataaaaagaaaaatgagaacaattgcatgtaaaaccgtgtgggcacttctgataggagtgtcccttgtcctgtcgctgaactcttgcagcaaggatcctgtaataccagaagacgagacgaagaacaaactgcatgaggacccggcaaaaatgaccgtccgcctcgttgaatgccacctgcacgctgactggaacgagatacagaaggccggaggtccccaccaaaatccggaatccccggccaggtatatgaaacgtgtccaggagatcacttatgaactgaagaccggcagtggatggacccttgctgaaggaagccagggcaagttttacgttcagaaaaacggcgaatataaaaatggaaacaactttaccccggccccggtttacctgatgtttatctattactacaattccaaaggagagttgatgaacggccagttcgtggagaacgggcaggagaatatccaccagcatttcttcaccccggagaacgtgagacctacctttgacgggaaaccggaagctgacgacaatgatccggaggcactggtggattatctctatgtggataccacgccctgggacaagaccaaacatgacaacgaggcggaaattacgggaagcactaacccggtaggattaaaaggagttatccggttcctgaaggaccgcaaggagtttgacctgaaactccgcctgtatcacggctacaattctaaaaagaacccgcagacaaacggctttgacccgttctacaagccctccggggtattgatccagcgtggaacatgggatattaacctgagcatcccggtagtggtgttttggagccgcgaggagtttgttgatgtggacccggaggcagatgtgaacctgatcggggaggatagcctggatgaagacagcaaccgcacgctacactccatcatgaaaaccttcagtcttacatggaaggaggcgcttgaggagttcatttcctatacctaccaggcgggggatgtggaagctggatccatatggctttga

SEQ ID NO: 1515 - DNA, 198 bp, B.fragilis
tgccacgggaacgatctccacaccccattcccctatcagctcaaaagtcacgtgcaggtcacatacccttctttccgaaaacatatgaccggaaaggcaggagcagagaacacggaaaaaacaattcaaaatttagtacatgatattaaaaaattatacattgaaaatcagaggagcgacccgccaatcaactggtga

SEQ ID NO: 1516 - DNA, 783 bp, B.fragilis
  unsure (210),(221),(222),(237),(242),(251),(255),(256),(264),(265),(266),(267),(271),(290),(291),(292),(293),(302),(319),(322),(323),(324),(325),(326),(327),(338),(359),(376),(377),(379),(395),(396),(398),(401),(406),(407),(410),(411),(412),(428),(429),(430),(431),(432),(438),(439),(442),(443),(444),(445),(446),(449),(450),(451),(452),(453),(454),(455),(456),(457),(458),(459),(460),(461),(462),(463),(464),(465),(467),(468),(469),(470),(471),(472),(473),(474),(475),(476),(477),(478),(479),(480),(481),(483),(485),(486),(487),(489),(490),(491),(492),(493),(494),(495),(496),(497),(498),(499),(500),(501),(502),(503),(504),(505),(506),(507),(508),(509),(510),(511),(512),(513),(514),(515),(516),(517),(518),(520),(521),(522),(523),(524),(525),(526),(527),(528),(529),(530),(531),(532),(533),(534),(535),(536),(537),(538),(539),(540),(541),(542),(543),(544),(545),(546),(547),(548),(549),(550),(551),(552),(553),(554),(555),(556),(557),(558),(559),(560),(561),(562),(563),(564),(565),(566),(567),(568),(569),(570),(571),(572),(573),(574),(575),(576),(577),(578),(579),(580),(581),(582),(583),(584),(585),(586),(587),(588),(589),(590),(591),(592),(593),(594),(595),(596),(597),(598),(599),(600),(601),(602),(603),(604),(605),(606),(607),(608),(609),(610),(611),(612),(613),(614),(615),(616),(617),(618),(619),(620),(621),(622),(623),(624),(625),(626),(627),(628),(629),(630),(631),(632),(633),(634),(635),(636),(637),(638),(639),(640),(641),(642),(643),(644),(645),(646),(647),(648),(649),(650),(651),(652),(653),(654),(655),(656),(657),(658),(659),(660),(661),(662),(663),(664),(665),(666),(667),(668),(669),(670),(671),(672),(673),(674),(675),(676),(677),(678),(679),(680),(681),(682),(683),(684),(685),(686),(687),(688),(689),(690),(691),(692),(693),(694),(695),(696),(697),(698),(699),(700),(701),(702),(703),(704),(705),(706),(707),(708),(709),(710),(711),(712),(713),(714),(715),(716),(717),(718),(719),(720),(721),(722),(723),(724),(725),(726),(727),(728),(729),(730),(731),(732),(733),(734),(735),(736),(737),(738),(739),(740),(741),(742),(743),(744),(745),(746),(747),(748),(749),(750),(751),(752),(753),(754),(755),(756),(757),(758),(759),(760),(761),(762),(763),(764),(765),(766),(767),(768),(769): Identity of nucleotide sequences at the above locations are unknown.
cgcggcgaggacgccgcgcgaccgcgcgcaacaagcgcgcgccgacgagccccggcgcccacgcacgacgcggacaggagcacacgagcaccgcgcacgacaggcagggccccgcccgcgcgaacaggcacgccgcaacccacaaccccagaccgcgcggcgcgccgcgcacggggagcaagggagagagggaggaagagacggaggaanacgcgaaaaannaaggaagaaaaaaanaaaanaaccaaganaaannaaaaaaannnnaaanaaaaaaaaaagaaaaaaannnnaaaaaaaanaaaaaaaaaaaaaaaanaannnnnnaaaaaaaaaanaaaaaaaaaaaaaaacaaaanaaaaaaaaaaaaaaggnnanaaaaaaaaaaaaaaannanaanaaaannaannnaaaaaaaaaaaaaaannnnnaaaaannagnnnnnaannnnnnnnnnnnnnnnnannnnnnnnnnnnnnnanannnannnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccaatgaattga

SEQ ID NO: 1517 - DNA, 330 bp, B.fragilis
caaacacacagggggtgcacggaggaaatgcgggaaaagaatgacgatgacatctgtttccccggagataagataccttacaggcctgccagtcggaatataatcgtatataaaaatccctgcctcgacaaacggggagagcgtaaagagacagatggtacaattttcaggagaatcgtgacgggagtgtccctgttcgttatgggatacgcacgaatgttccccgtgaacatgaaaagctttcacgaggaaaaagggcatcaatgtcagcaacaacatacatgctatgacagcccgctgtctctgtctttttttcgtacgatccattag

SEQ ID NO: 1518 - DNA, 780 bp, B.fragilis
  unsure (212),(223),(224),(239),(244),(253),(257),(258),(266),(267),(268),(269),(273),(292),(293),(294),(295),(304),(321),(324),(325),(326),(327),(328),(329),(340),(361),(378),(379),(381),(397),(398),(400),(403),(408),(409),(412),(413),(414),(430),(431),(432),(433),(434),(440),(441),(444),(445),(446),(447),(448),(451),(452),(453),(454),(455),(456),(457),(458),(459),(460),(461),(462),(463),(464),(465),(466),(467),(469),(470),(471),(472),(473),(474),(475),(476),(477),(478),(479),(480),(481),(482),(483),(485),(487),(488),(489),(491),(492),(493),(494),(495),(496),(497),(498),(499),(500),(501),(502),(503),(504),(505),(506),(507),(508),(509),(510),(511),(512),(513),(514),(515),(516),(517),(518),(519),(520),(522),(523),(524),(525),(526),(527),(528),(529),(530),(531),(532),(533),(534),(535),(536),(537),(538),(539),(540),(541),(542),(543),(544),(545),(546),(547),(548),(549),(550),(551),(552),(553),(554),(555),(556),(557),(558),(559),(560),(561),(562),(563),(564),(565),(566),(567),(568),(569),(570),(571),(572),(573),(574),(575),(576),(577),(578),(579),(580),(581),(582),(583),(584),(585),(586),(587),(588),(589),(590),(591),(592),(593),(594),(595),(596),(597),(598),(599),(600),(601),(602),(603),(604),(605),(606),(607),(608),(609),(610),(611),(612),(613),(614),(615),(616),(617),(618),(619),(620),(621),(622),(623),(624),(625),(626),(627),(628),(629),(630),(631),(632),(633),(634),(635),(636),(637),(638),(639),(640),(641),(642),(643),(644),(645),(646),(647),(648),(649),(650),(651),(652),(653),(654),(655),(656),(657),(658),(659),(660),(661),(662),(663),(664),(665),(666),(667),(668),(669),(670),(671),(672),(673),(674),(675),(676),(677),(678),(679),(680),(681),(682),(683),(684),(685),(686),(687),(688),(689),(690),(691),(692),(693),(694),(695),(696),(697),(698),(699),(700),(701),(702),(703),(704),(705),(706),(707),(708),(709),(710),(711),(712),(713),(714),(715),(716),(717),(718),(719),(720),(721),(722),(723),(724),(725),(726),(727),(728),(729),(730),(731),(732),(733),(734),(735),(736),(737),(738),(739),(740),(741),(742),(743),(744),(745),(746),(747),(748),(749),(750),(751),(752),(753),(754),(755),(756),(757),(758),(759),(760),(761),(762),(763),(764),(765),(766),(767),(768),(769),(770),(771): Identity of nucleotide sequences at the above locations are unknown.
ggcgcggcgaggacgccgcgcgaccgcgcgcaacaagcgcgcgccgacgagccccggcgcccacgcacgacgcggacaggagcacacgagcaccgcgcacgacaggcagggccccgcccgcgcgaacaggcacgccgcaacccacaaccccagaccgcgcggcgcgccgcgcacggggagcaagggagagagggaggaagagacggaggaanacgcgaaaaannaaggaagaaaaaaanaaaanaaccaaganaaannaaaaaaannnnaaanaaaaaaaaaagaaaaaaannnnaaaaaaaanaaaaaaaaaaaaaaaanaannnnnnaaaaaaaaaanaaaaaaaaaaaaaaacaaaanaaaaaaaaaaaaaaggnnanaaaaaaaaaaaaaaannanaanaaaannaannnaaaaaaaaaaaaaaannnnnaaaaannagnnnnnaannnnnnnnnnnnnnnnnannnnnnnnnnnnnnnanannnannnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccaatga

SEQ ID NO: 1519 - DNA, 1539 bp, B.fragilis
  unsure (839): Identity of nucleotide sequences at the above locations are unknown.
tttcttaacggaagatcccagccaaaactcactccggaaaacttcttctctacccaggatgaattgaacatgagcatatatgccctttaccagaaagtcaatctttcacaggtatatacgaacatgcagctgtcccagtggcagggggatgatataacgaccaatccggggagcaacaaacagtctgccgcagaaatggacaagtttgccgcagcaaacaacaacaagggtgtcaaagatgcgtggaacatgcattatgccattgtaaaggctgccaatttgatcatacagggggcttctaaaacacctaccactcaagatgagataaatatcggcctcgggcaggctaaattctggagggcatacgcttattttaccctggtgcgactttggggaccgctgccgatgaatctggacaatgtcaacgatgattataccaaacctctatcccccgtggaagaagtgtatggtcatattgtgcaggacctgaccgaagctgaggccgtattgcctacgggttacagtggcagcccccgctttctgaacggagtgaatgtgtatgtaacccggcaggcagccaaatctactttggcagcagtgtatatggctatggccggctggccgatgaacaaaacggaatattacgcaaaggctgctgaaaaggcgaaggaggtcattgagggtgtgaacagaggtgaatacgagtataagctcgataaggattacaaagatgtgtatgctatgagcaataactataataatgagacggtgctcggcataaattattcaccgttcgtggattgggcacaggattcggagcttacttcatgtaaccagtntgaatcgctgggcggctggggagacgcctggggtgaaattcgtttctggaaggagtttcctgacggtccgagaaaagatgcgacttatgatcccaagattcgtctgaaagacggaacgttggttgactggtgggagttgaaggaggacggtacccctgtcgttccggaacatcaccccatgttcagtatattctccgtcaactgggatcctgcgtcaaaagtgaataccagtgccccgtatgattatacaaaaccggccagtcagaacatgtgtaatgaccatcggcatagaatcattcgttattcggaggttttgttgtggtatgcggaagccaaggccaggacggggcagacggacgagttggcattcaagtgtctgaatgatgtccgcgagcgtgccggactggaaccgctcaccggactttctgcagatgaccttgccgaagcggcttataaggagcatggttgggaggtggcaggctactgggtggcccttgtcacacgccgtgcggaccagttccgtatgaacagactgaaagacacctttaaggaaagagcggagaacacggctgttgaagtcgccgacgggatcctggtaaaggagtctgtagaatatacgaacaggacatggagtgacaatctgatgtatcttccatatcctgatatggattcccagaaaaacccgaatctggtaaggtga

SEQ ID NO: 1520 - DNA, 837 bp, B.fragilis
  unsure (211),(222),(223),(238),(243),(252),(256),(257),(265),(266),(267),(268),(272),(291),(292),(293),(294),(303),(320),(323),(324),(325),(326),(327),(328),(339),(360),(377),(378),(380),(396),(397),(399),(402),(407),(408),(411),(412),(413),(429),(430),(431),(432),(433),(439),(440),(443),(444),(445),(446),(447),(450),(451),(452),(453),(454),(455),(456),(457),(458),(459),(460),(461),(462),(463),(464),(465),(466),(468),(469),(470),(471),(472),(473),(474),(475),(476),(477),(478),(479),(480),(481),(482),(484),(486),(487),(488),(490),(491),(492),(493),(494),(495),(496),(497),(498),(499),(500),(501),(502),(503),(504),(505),(506),(507),(508),(509),(510),(511),(512),(513),(514),(515),(516),(517),(518),(519),(521),(522),(523),(524),(525),(526),(527),(528),(529),(530),(531),(532),(533),(534),(535),(536),(537),(538),(539),(540),(541),(542),(543),(544),(545),(546),(547),(548),(549),(550),(551),(552),(553),(554),(555),(556),(557),(558),(559),(560),(561),(562),(563),(564),(565),(566),(567),(568),(569),(570),(571),(572),(573),(574),(575),(576),(577),(578),(579),(580),(581),(582),(583),(584),(585),(586),(587),(588),(589),(590),(591),(592),(593),(594),(595),(596),(597),(598),(599),(600),(601),(602),(603),(604),(605),(606),(607),(608),(609),(610),(611),(612),(613),(614),(615),(616),(617),(618),(619),(620),(621),(622),(623),(624),(625),(626),(627),(628),(629),(630),(631),(632),(633),(634),(635),(636),(637),(638),(639),(640),(641),(642),(643),(644),(645),(646),(647),(648),(649),(650),(651),(652),(653),(654),(655),(656),(657),(658),(659),(660),(661),(662),(663),(664),(665),(666),(667),(668),(669),(670),(671),(672),(673),(674),(675),(676),(677),(678),(679),(680),(681),(682),(683),(684),(685),(686),(687),(688),(689),(690),(691),(692),(693),(694),(695),(696),(697),(698),(699),(700),(701),(702),(703),(704),(705),(706),(707),(708),(709),(710),(711),(712),(713),(714),(715),(716),(717),(718),(719),(720),(721),(722),(723),(724),(725),(726),(727),(728),(729),(730),(731),(732),(733),(734),(735),(736),(737),(738),(739),(740),(741),(742),(743),(744),(745),(746),(747),(748),(749),(750),(751),(752),(753),(754),(755),(756),(757),(758),(759),(760),(761),(762),(763),(764),(765),(766),(767),(768),(769),(770): Identity of nucleotide sequences at the above locations are unknown.
gcgcggcgaggacgccgcgcgaccgcgcgcaacaagcgcgcgccgacgagccccggcgcccacgcacgacgcggacaggagcacacgagcaccgcgcacgacaggcagggccccgcccgcgcgaacaggcacgccgcaacccacaaccccagaccgcgcggcgcgccgcgcacggggagcaagggagagagggaggaagagacggaggaanacgcgaaaaannaaggaagaaaaaaanaaaanaaccaaganaaannaaaaaaannnnaaanaaaaaaaaaagaaaaaaannnnaaaaaaaanaaaaaaaaaaaaaaaanaannnnnnaaaaaaaaaanaaaaaaaaaaaaaaacaaaanaaaaaaaaaaaaaaggnnanaaaaaaaaaaaaaaannanaanaaaannaannnaaaaaaaaaaaaaaannnnnaaaaannagnnnnnaannnnnnnnnnnnnnnnnannnnnnnnnnnnnnnanannnannnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccaatgaattgacttgtcctaaaataaccttacagctcctctctatttctcttattatactttga

SEQ ID NO: 1521 - DNA, 1293 bp, B.fragilis
aggaggtggggcatgatgcgccggatggatgtccacgaggccgccaaccggagattgaagatcatctttgactattttgattacgtgtatgtctctttttccggtggcaaggatagcggtatccttctccatttgtgcatggattatatccgcatgcatgcacccggtagaaaactgggtgtgttccacatggattacgaggtgcagtaccgccagagcacggagtacgtggaaaggatgttttccaacaaccgggatatccttgaagtgttccactgttgtgtccccttcaaggtacccacatgtacttccatgtaccagcagtactggcgtccctggcaagaggggtaccagaatatctgggttcgccagatgccgggcaccgctcttaccgtgaaagattttgatttctggaacgacagcctgtgggattacgacttccagtctcttttcccttcctggatacgtcgtaagaagggatgcaagcgtgtttgctgcctcgtggggatccgcacgcaggagagcttcaaccggtggcgggcgattcattccgacaagaattaccgtaagctggccaactacaagtggactcaccgtgtaggatattacacttataacgcctacccgatgtacgactggaagacaacggacgtgtggacggggtatgcccggtatggttgggattataaccgtttgtatgacttgtattaccaggccgggattcccttgtcccgccagagggtggccagcccgtttatctcacaggccgtttcgaccctacatctttataaagttattgatccggatacctggggacgcatggtcagccgggtcaacggcgtcagtttcgccggaatgtacgggaacacggttgcgatgggctggcgctccatcagttgtccggacgggttcacgtggaaagagtacatgtacttcctccttgacacgcttccccgggcgacaagggagaactacctggagaaactgagggtgagccagaaattctggagagaaaaaggaggctgcctgggagaggaaacgatcgggaagctgcgtgcggccggtgtaccgttcacggtggaagaatgcacgacataccggactgacaagaggcccgtccgcatggagtatatagacgagatagatatccctgaatttcgtgaaatacccacttacaaacgaatgtgcgtctgcatcctgaaaaacgatcatacctgcaagtatatgggtttcacgcagaccaaacgggagagggagatgaaagagagagttttgaaaagatataaattgtga

SEQ ID NO: 1522 - DNA, 531 bp, B.fragilis
ttaatattcttcttggcaagatttatagatatattatttttatcaattattgttgtaaatataaatatgaaaagtaaattcacattatggagtgttgtattgctcttggccggatttatatttgtaggatgtgacaatgaacgaacggaaaacgcatctgattttcagacaggaattcataaaattgtaatccaacagtccggtgacacagattcatttgaagtgagtgtaagtatcggtggtgctgacaagggtggtcccgccaagttgtacaatgacaagggagaatacattggtgattcctattctgcccaaataaggacggcaactatgtcctgttgtacaaatgggaatgcgtttttcatgacctgtgccggttcggtttccagtatctcggaggcgggtaaacggcttcatataacagtaataggctacattgacgacaaggaggttaaccgtttggaaaaagaatatataacagatggtaatacccttattgaaactttcagcgtttcaaccaaggagatatga

SEQ ID NO: 1523 - DNA, 2358 bp, B.fragilis
cccgtttatattttttcaagtatgacatttcatgcatatctccagtatgtgtgcctgcttgttgtctgcctatgtaccctcccttctcccatggaagcacgggtacaggctgaccggcaatcgacgggtacacgcgatactctgctggtcattgaccaggaaagcgggcttcccattgaaggggcctatatcctgaccagggaacggttacttgtcagctccccccgtggaatgattgttttcggtcatggaacgtgtttcatggatacggtcctcgtgcagtgcctgggttacggttcccggcgtgtgcctttgaacgaggtattcaaagaaagcagcatacataccgtatgtctctccccggacatacaaaaactcggggaagtggtcgtgaccggtgaacgtgccggggcgtcacccaacgtggtgagccggcgcctttcatctcccgagatcaggaacgcgctgggaacctcgcttgccaccctgctcgaacgtgtcagcggggtaagttccatcagcacgggaaccactgtatccaaacccgttatccaaggaatgtacgggaaccggatactgatcatccataacggtgcccgccagaccgggcagcaatggggggccgaccacgctcccgaagtggacatgaacggcagctcctctgtttcggtaatcaagggctccgatgcggtaagatacggttcggatgcccttggagggattatcgtcatggagcagtctccgcttcctttcagaaaacgctcccttcaagggggaatctccgcactttacggaagtaacgggcgtcgctacgtggctaccggacagctcgaaggtgcttttcccggtgatttcgcctggcgtctgcagggaacctggtcaaattccggggaccgttccactgcgcactatcttctgaacaacacgggaaccagagagtatcacgcttccgcctctctgggctatgaccgcggacgtctgagagtggaaggtttctacagccgcttctacagccggacaggggtgatgctcagcgcccagatggggagcgaggacctgctggcggaacgtatccggcttggtcgccccctgcacacggatcccttctcccgtggtatcagggctccctgccaggaggtcacccatcagatcacattcggcaggatgcggctcggcatgaagaaggggggaagtattcactggcaaagtacctggcagaaggacgataggcaggaaaaccgtgtccggcggctggattctaacattccggcggtttccctgcacctgaattcattccagcatcttctgcgttggaagcgggattaccgctcctggcaagtcgaggcgggaggtcaggtcatgttcatcgagaaccacagccgcgcgggtaccggattcgtgcccgttatcccgaactacacggagacacaggcagggatatacggaatcgggaaatatcacctggccaggggaggcgttgaagcaggcctccgcctggatatgcaggaaacccgtgccagtggttatgactggacgggaagcccctatggcgggacaagaaagtttaacaacgtgtcctacagcctgggaggacactatcaactttccagacgctggaggctcacctccaacttcggtctggcttggcgtgcccctcacgtgtatgaactgtacagcaacgggaacgagctcgggtctgggatgtttgtcaggggagactctgcgatgcactcggaaagaagctacaaatggatatcttccctccgttacggcgacgggatgttcagcgtctgtctggacggttacctgcaatgggtggacggctatatctatgacgggccggagaaagagacagtcaccgtgatttcgggagcatacccggtcttccagtacaggcagaccccggctttcttccgcggtatggactttgacctgcgtttcactccgggcggttcatgggactaccatgccgtcgtctcctttatacgggcaaacgaacggacaaagggtaattatcttccttatattccctccttccgtttcagccatgaacttgcgtggatacacgagacgaaatcgcatctcaggctgcgtctgaacatcaggcaccgtttcaccgcaaaacagaggcggtttgatccggacacggatcttatcccgtatactcccccggcgtaccatctcctcgggttcgacgctgctcttgaacttcccgtgaaacggggacaccaggtccggttcatgctgtcggcagacaacctcctgaatcgtgagtacaaggaatacaccaaccgctcgcgttactatgcgcatgatatgggacgtgatgtgcgttgcggtgtaaactggattttttaa

SEQ ID NO: 1524 - DNA, 417 bp, B.fragilis
cggattggaatcatgaacattctgaagttacaaggattggacggtcggctttttgaccttgtcgcgcctttggtaatgaacccggccgtattgcggcaaaataataattaccctttcaaaacgacgcgtaaccatgtctggtacattgccatggatgagcaaagggtgttgggattcatgcccgtgaaaatgaccttgacaaacaattgcatagataactactatattagcggggataactcctctgtaatagaggtgttattggaccgtattatccatgatttttcttctgatggttcccttgtggccgttgtacacgaacgccacgtggaagacttttcaatgaagaattttatcccctgtgtcgagtggaagaagtatgtcaagatgcgttatcatgaaggaggtggggcatga

SEQ ID NO: 1525 - DNA, 534 bp, B.fragilis
attgtgattgtcatgtcaagttttaaaagtccggcgtataacgtcaaggccgtgccagtcgagaaaatcgtggccaacagctataacccgaatgtcgttgctcccccggagatgaagctgttggaactgtccatctgggaagacggttacacgatgcccctcgtgtgttattaccgggaagaagaggatatctacgagctggttgacggttaccaccgctatctggttatgaaaacatccgtcaggatttacaagcgcgagaacggattgctgcctgtaacggtcataaacaaagacatctcgaacaggatggcctcgactatccgtcataacagggccaggggaatgcactcgctggaacttatgacaggtattgtggcggaactgtcaaaatcgggtatgtccgacagctggatcatgcgcaacataggcatggacaagaacgagttactccgtttcaaacaaatctcaggtctggctgaattgtttcgtgacaggagtttcgggctctcggacgactggttggaggaataa

SEQ ID NO: 1526 - DNA, 279 bp, B.fragilis
tcatcttgcgtaggatggaattctctctttatcaatctacaggcggcaggtggggccgccttttttgtcttgtgcaacgaaaaaatcccatctgccatgcttaatccccgtggtttacttggggatgtattgggacatgctttaccatctcaccctgttccatttttcatgtttggcaagttgaaaaaaatcctatacatacaagacgtaccgttcccttaccgacgggtctggaaccgacttcccgtctttcgtgcaattttcccgcttggttactga

SEQ ID NO: 1527 - DNA, 1506 bp, B.fragilis
aacctgcctttagcgacaaaacctcccctcccgtctatcgcttttgcacatctttctattgcagcgtacttttgtttctataaaataaaaagaagcacgagtatgacgaacgtaaatagaatcaccctaataacagtctgcctggcagctatcttgcccggcaacggattgtgggcacaacagacggaagctaccggaacatcgcaaaccgccgactcggtatccatgcccgcgcaatgggatctgcagagctgcatcgactatgccttgcagcaaaacatcagcatccgtcgtaaccggatcaatgcgcagagcacacaggtggacgtaaagacagccaaagcggccctcttccccagcctctcgttctccagcagccaaaatctggtgaaccgtccctaccaagagtccagcagcattatcagtggctcggaagtactgaagagcagcaacaagaccacctacaacggaaactacggactgaacgcgcaatggaccgtatataacggcagtaaacgcctgaaaacaatcgaacaggagaagctgaacaaccgcgtggcagacctcgatgtagccacttcggaaaatgatatcgagcaatcgatcgcccaggtatatattcagattctctatgccgccgaatcagtcaaggtgaacgaaaacaccctgcaagtatccgaagcccaacgggaccgtggcaaacaactgctggatgcgggaagcattgcccggagcgactatgcccagttggaagcccaagtcagcaccgaccgttatcaactggtgaccgcacaggccacacttcaggactataagttgcaactgaagcaactcctcgaactggacggcgaacaggaaatgcaggtctatctgcctgcattgggtgacgaaaatgtactgtcgcccctccccaccaaaacggatgtctttcgttccgctgtggccctccgcccggaaatagaggcaagcaagctcagtgtagaggcatcggaactggggatcggaatcgccaaatcgggatatctgcccagcgtcagcctgacagccggtatcggtaccaaccataccagcggaagcgacttcaccttcggcgagcaagtgaaaaacggatggaacaactccatcggactcagcatcagtgtcccaatctttaacaaccgacagaccaaaagtgccgtagaaaaagccaaacttcagtatcagaccagtcaactgactctgctcgacgaacagaaaacattgtataaaaccatcgaaggactatggctcgacgccaacagcgcccagcagcgatatgcggcagccatagagaaattgcacagcacacagaccagctatgaactggtcagcgagcaatttaatgccggaatgaaaaataccgtggagcttctgaccgaaaaaaacaatctgctacaggcacagcaagagctgttacagtctaagtacatggctattctgaatacacaattgctgaagttctaccagggagataagataacactgtag

SEQ ID NO: 1528 - DNA, 186 bp, B.fragilis
aaaaaacgtccgaccttcacaggccggacgtttttcgttctatttgaatacgttatttacatacaacaattaaacagtatgataattaaaataacaactcaacaaaatggaatccgggagaatcacttcggccggattggcttatctcacttaaatgtgacttacgtaataattatgactaattaa

SEQ ID NO: 1529 - DNA, 1557 bp, B.fragilis
gggaaaaaccccgctttcaatttaaaaagaggctcactttacccaatttccggggttttttcacaagcatgcgatgaaataggaatgttattctgggcagaaaacgcattttggggaatcggaggacacaaaggagacgattattggaatgccagtgcataccctgtaaacgaatccgacagggcagaattcgaaaacagcgtaaaagcccaactgaaagagctgattcgcatccaccgcaaccatccttccatcatcgtatggagcatgagtaacgagccttttttcacagcacccgagacaatcgatccgatgcgtaaactactggaagaaaccgtcaaactttccaaacaactcgatcctacccgcccggcagctgtcggtggtgcgcagcgtccgctgggagagaaacgaatcgataagttgggcgacatagccggatataacggtgacggcagctacattccggagtttcagcaaccgggcatgccaacagtagtttcggaatatggcagtactacagccgatcgtccgggagaatatgatccgggatggggagacctggctaagaataatgcacagaacggttttccatggcgtagcggacaagccatctggtgcgcattcgaccacggaagcattgccggcagtgcccttggcaaaatgggcatcatcgattacttccggattcccaagcgtgcctggtactggtaccggaatgcctacaaagggattacccctccggaatggccgcaagaaggaacacctgcccgcatcagcctggttgccgaccggactgataacataaaagcggacggaacggacgatgttatgttatcaataaccatcctggatgcaaacggaaagccggtcagcaattctccggcagttaagctcgacattctatccggcccgggagagtttcccaccggaacctcaatcctgtttgaaaaagagagtgatatccgcatactcgacggaaaagcggctattgaattccggtcatattatgccggagaaactgttatccgtgctacttcaccgggactggaaccggccgaagtaaaaatccgattcaccggaagcactccctatacagaggccttcaaagtaaaagaacgtccctatacacgcttcgaaactccgacaaaaacggataatctgcaaaccttcggacctaacaacccgactttctgcagttcgtctgccaacggacattcatccgcttttgcagccgacggagacgaatctacatactggcaagcttcagagaacgacccggaacgttcctggacactggataccgaaaaaggattgtcgatacgtcacatccgaatcgcatttccggatttagccccttatcaatacaaagtagaggtatccatggacagagaacactggtcgctcataccggatcaaaccaataataagcagaacgagaacattcggatgattcaggttgttcccggtatacaaggacgtttcgtacgtatcagtttcacaggagagaaagctgctattacagacgtacaggtcatcggaacggtaattgactaa

SEQ ID NO: 1530 - DNA, 1491 bp, B.fragilis
atacatattacaattatggcaactcagaataaaacagatataggcctgattggtttagctgtgatgggagaaaatttagctctgaacatggaaagcagaggttggagcgtatcggtgtataatcgtacggtaccgggtgtggaagaaggcgtggtggaacgtttcatcaacggaagggctaaaggcaagcatatagagggcttcacggatatagaggcttttgtagaatcgatcgctttgcctcgtaagataatgatgatggtacgtgccggtagtccggtggatgagctgatggagcaacttttcccgtatctttctccgggtgatatattgattgacggtggtaactcgaattatgaagatacgaaccgaagagtgaaactggcagagtcgaaaggttttctgttcgtcggtgccggtgtttcgggcggagaagagggagctttgaacggagcttctatcatgccgggcggttcggagaaggcatgggaagaggtgaaaccgattttgcagagcattgcggcccaagcgccggatggtactccgtgctgtcagtgggtgggacctgccggatcgggacattttgtgaaaatgatacacaacgggatagagtatggtgatatgcagttgattgctgaagcttattgggtgatgaaggagctgctggatatgactaacgaggagatggcatctgtgttcacccgttggaatgaaggtaaactacggagttatctgatagaaattacaggtaatatactccgccataaagataagacaggggtctatctgattgataagatcctggatgccgccggacagaaagggacaggcaaatggtcggtgattaatgccatggaattaggtatgccactgggattgattgctacggccgtttttgaacgcagtttgtcggcccggaaggaactgcgtgaagctgctgcccggcaatatcaatgcaggcactcgatggctgtatataataaacaagatacggaaaaagagattttctcggcattgtatgcttcgaaactggtttcgtatgctcaagggtttgcggtgttgcaacgtgcttccgatacatttggatggaacctcgatctggcttcgattgcacggatgtggagaggcggttgtattattcgcagtgttttcctgaatgatattgctgcggcatttgaggcaaaagaaaagcctaaacatctgctgctggccccttattttgaagaagagatcaaaggtctgttgtccggctggaagaacttggtggcacaagccatgcgtgaggaactgcctgttccggctttctcttcggctttgaattatttctattcgttagtgtcggctgatcttccggccaatctggtacaggcacagcgcgattatttcggtgctcatacatttgagcggaaagatgagttacgaggagtctttttccatgaaaactggacaggacacggaggagatacaaagtcgggtacgtataatgtataa

SEQ ID NO: 1531 - DNA, 411 bp, B.fragilis
tccggatctacacaagtctggcatgtgcattgcataacaatattcagatgtttagttatagttagtagatctagaacaattaagttttcaagaattatgaaaaaggtattagtagcattggtaatagtaatgggattgggattttcagtagcaaaagcagatgaacctctaaagaaaaagtccccgaaagtggaacaaagagattcgcgggaggactttacacctattgaggttaataatcttcctgaagcggtgattgatgagttatcctgcgaaggagcattgattaaagaagcttttattgcttatagtcgttcggagggtaaactctacaaagtgattatattgtcgagtgattttcatgaacaggctgtattcttgaatgaaagagggaatatactgaatagatag

SEQ ID NO: 1532 - DNA, 225 bp, B.fragilis
aaagcttgtacacaagggcatggagtggatcaagaggaagaggtgagtccgaatcaggtggcggctcttcgttgtctgtttactccggaatatactcgtcccgcagctatcggcactacccgtgctttgcttcagggagtggaattccagaaagtcagtgcgatagggggagcaattaatggcggatcgggtagtggagatattgtggatgatccgacagcctga

SEQ ID NO: 1533 - DNA, 1152 bp, B.fragilis
actatgggtacatacatttttctacaacaatattggtggctggtagtctcactactcggggccatactcgtatttttactgtttgtgcagggtggcaactctctgctgttttgtttgggcaaaaccgaagagcatcgtaagatgatggtaaactctaccggacgcaaatgggaatttacatttactacgctggtcactttcggtggcgctttctttgcttcgtttcctctgttttatagtaccagtttcgggggggcctactggctgtggatgattattcttttcagttttgtgttgcaagctgtcagttatgaatttcagagcaaagcgggcaacttgttgggaaagaagacctaccagacttttctggtgattaacggtgtggtgggacccttgctcttgggaggcgctgtggccactttctttaccggttcggatttctatatcaataaggggaatatggtgaacgaagtgatgcctgtgatcagtcattggggcaacggttggcacggactggatgcgctgaccaatatctggaatgtgattctgggattggccgtgttcttcctggcgcgtgctttgggagctctttactttatcaataatatcgctgataaagagttggtcgccaaatgtcgtcgttcgttgatagccaatacggtcctgttcctggtgttcttcctggcattcgtggttcgcactttgctggccgatggatatgctgtcaatccggaaacaaaagagatctacatggagccttataaatacttcaataattttattgaaatgccggtggtgcttatcgtgttccttgtgggagtcgtgctggtgttgtttggcattggcaaaaccctgctgaaaaaaacgtttgataaaggaatctggtttgtgggtatcggtacggtgctgactgttctggcactgctgctgacagccggatataacaatacggcttattatccgtcgaatacggacatacaaagttcgctgacccttgccaatagttgttccagccagttcacgctcaagaccatggcctatgtttctatcctcgttccgtttgtcatcgcctacattttctatgcttggcgcagcatcgacaaccggaagatcgatgccaaggaaatggacgaaggcggacatgcttattga

SEQ ID NO: 1534 - DNA, 189 bp, B.fragilis
attacaaggtttccatccaattatatattagatttcatttttatcagtagtaagataatgctgatttacaaccacttcatgattgtatcttattttaaaactactgataaaattatttatttttttacctttttatttaacctcttttgggttagtatgccccttgcttcaaatgtttttatagtataa

SEQ ID NO: 1535 - DNA, 711 bp, B.fragilis
tcatccatagccgtgaaattacgttgcgccatagtcgacgacgaacctctggcactcagtctgctggagagttatgtcaacaaaacaccttttctcgaactggcgggaaagtattccagtgccgtacaggccatgaaagaacttcccgggaaccagatcgacctgttgttccttgacattcagatgccggaactcaacggtctggaattctctaaaatggtagcccctcgtacccgtattgtgttcactactgctttcggtcaatatgccatcgacggataccgggtcaacgcactcgactacctactcaaacccatctcgtatgttgacttcctgcaggcagccaacaaggcgttgcaatggttcgaactggtccagaagcccgaagaagtagacagtatttttgtcaaaagtgactataaactggtgcaggtagaactcaaaaagatattatatatagagggtttgaaggattacatcaaaatctacaccgaagatgcccccaaacccattttgtcacttatgagcatgaagtccatggaagagttgcttccccccgcccgctttatgcgtgtacatcgttctttcatcgtccagaaaaacaaaatacgcatcatcgaccgcgggcgtatcgtatttgataagacctatatccccgtcagcgatagctacaagcagactttccaaacattcctcgatgagcgaagttga

SEQ ID NO: 1536 - DNA, 1353 bp, B.fragilis
cccaatacagcagccgtaacatcgtgttgcgcgacggacaagtcaaggaagacagcactaacccggacattctttccgcagccgaagcattggccgctctgccggtacaagaagaataacagacagattattatgaacggaaccaatttatttaaaatagctttgcgcgccttgaataacaacaagttgcgcgcgttccttacgatgctggggatcatcatcggtgtggcatccgtcatcaccatgctcgccatcggccagggatcaaagaaaagtatccaggcacaaatctccgagatgggctccaatatgattatgattcatccgggagcagacatgcgcggaggtgttcgccaggaccccagtgccatgcagacactgaaactgaccgactacgaaacattgcgggatgaaaccagctttctggctgcggtcagtcctaatgtttccagttccgggcagttgattgcaggcaacaacaactatccgtcgtccgtgaatggcgtgggaacggagtatctggaaattcgacagctctcgatagacaatggagagatgttcagcgaagccgatatccagtcgagcgccaaggtatgcgtgataggaaaaaccattgtagacaatcttttccccgatggagaagatcctgtaggacgcattgtccggttcagcaaaataccgttccgtgtagtaggcgtactgaaatccaagggatacaactctatgggtatggaccaggacgacatcgtactggcaccctacaccaccgtgatgaagcgtctgctggcacagacctatctgcaaggtatctacgcttctgccctttcggaagacatgacggacaatgctacggaagagattaccgaacttctccgccgcaatcacaagctgaaagaggcggatgacgatgatttcaccatccggagccagcaggaattgagcagcatgctcaactctaccaccgacctgatgaccacactgctcgcctgcattgccggcatatcgctcgtagtaggcggcatcggcatcatgaatatcatgtacgtcagcgtcacagagcgtacccgtgagatcggtctgcgcatgtcggtcggtgcacgtggcgtcgacatcttgagccaattcctgatagaagccatcctgatcagcatcaccggaggccttatcggagtaatcatcggctgcggtgccagctgggttgtgaaaagtgtcgcccattggcccatcttcatccaaccctggagcgtattcctgtcgtttgcggtttgtaccgtcaccggagtattcttcggatggtatccggccaagaaagccgccgacctcgatccgatcgaggcaatccgatacgaataa

SEQ ID NO: 1537 - DNA, 255 bp, B.fragilis
gttgtaaatttgcggaaaaacaagagtaagatggaatataagtttgacgaacagagtgtgaaagaattaatggaatgggcacagactgcacagttgcctcaggaactggaactgagtaaagcggagcgtatttttgatgtaaaactttgtatagaatctgatttatcgtgtatcagggcccattatcccgatgctttctacaatccggctataactcgtctttatcgtatcagggagaagctggaggagaaatga

SEQ ID NO: 1538 - DNA, 1290 bp, B.fragilis
cagatttattacaaatatatgcaaccattagcggaaagacttcgcccaaagacattggatgattatatcggtcagaaacaccttgtgggaccgggtgctatcctgcgcaaaatgattgacgcagggcgtatctcttcatttattctttggggacctccgggagtgggtaagaccacactggcccaaatcattgccaataagctggaaactcccttctacaccttgagtgctgtcacctccggggtgaaagatgtgcgcgaagtgatagatcgcgccaagagcaataagtttttcactcaatccagccctatcctgtttatcgatgaaatacacaggttcagcaaatcccaacaagattcgctactgggagccgtcgaacatggcacagtcacgctgataggtgccaccaccgaaaatccgtctttcgaagttatccgtccgctcctttcccgctgtcagctctacacactgaaatctctggaaaaagaagatttactggaattgctgcaacgtgccattactaccgacgtagtgctgaaagaacggaaaatcgaattgaaagagaccggtgccatgcttcgcttttcgggaggcgatgcccgcaaattactgaacatactggaactcgtggtagaatcggaaacagaagaaaccgtaatcatcactgatgacctggtaacagaacgcttgcagcaaaacccgctcgcatacgataaagacggtgaaatgcattatgacattatttcggcgtttatcaaatcgatacggggaagtgaccctgatggcgccatctattggctggcccgtatggtagaaggaggcgaagatccggcattcatcgccaggcgcctggtcatctctgccgcagaagatatcggcctggccaatccgaacgcattgttattggctaatgcctgttttgacacattgatgaaaatcggctggccggaaggaagaattccactggcagaaacaacgatttatctggcaacaagccctaaaagcaattcggcctacaatgccatcaacgatgcactggcactggtacgcgaaaccggtaatctgcctgttcccctacacttgcgcaacgctcccaccaagctgatgaagcagttgggatatggccaggagtacaaatatgcacataattacgaaggcaactttgtaaaacaacagttcttaccggatgaaatcaaggccaaacaactatggcaaccccaacacaatccggcagaacaaaaacatgccgagcgaatgaagcaactatggggaaatgaaaagaactattaa

SEQ ID NO: 1539 - DNA, 1578 bp, B.fragilis
cgtttaactctaactactaatgatatgattgaaagtattgacacttcactgattgactggtcgagagcccaatttgctctgacagccatgtatcactggatctttgtgcctctcacgcttggtttggcggttgttatggccattatggagaccctttattataaaacaggcaatgaattctggaaacgaacggctaaattctggatgaaacttttcggtatcaattttgccgtgggagtggccaccgggctgattctggagtttgagttcggaaccaattggagtaactattcctggtttgtaggcgatattttcggtgcacctcttgcaattgaaggtattttggctttctttatggaggccacgtttattgctgtcatgttctttggatgggacaaggtgagcaagagattccacctcatttcaacctggctcacgggcttgggagctacgatttctgcttggtggattctggttgccaatgcgtggatgcagcatccggtaggcatgcagttcaatcctgacaccgtacgcaacgagatggtcgactttatggctgttgcgttttcgccggtggctgttaataagttctttcatacggtactttcaagttgggtgctcggagctgtttttgtgattggcatcagttgctggttcctgctgaagaagcgtgataaggaatttgcggtggcgagcatcaagataggtgcagtcttcgggctggtggcttctttactgacggtgtggaccggtgatggttccggttatgccatcgcacagacacagccgatgaaactggctgctgtggagggctattacgaaggacaaaatggtgccggactggtggctgtcggacttttgaacccggagaagaaaacctatgatgacggtcaggacccgttcctcttccgtatcgagattccgaaaatgctttcgctgctggccgaacgtaaggtggatgcctttgtgccgggtataaaaaatattattgagggaggatatgaactgaaagacggtacaaaagctctttcggctgccgagaagatagaaaaaggcaagaaagcgattgctgccctggccacttatcgtacggccaaaaaagaaggtgatgaagctgccgccaaggaggcttataccactttgcaggaaaatgtgccttattttggctatggctatattaaagatgtaaatcagttggtacctaatgttccgcttaacttttatgcttttcgcgtgatggtgatcctgggcggatatttcattctgtttttcatcctggtgcttttctttgcctataagaaagatttgtcgaagataagatggatgcagtacgttgctctgtggaccattccgttggcttatattgccggacaagccggttgggtggtggccgaatgtggtcgtcagccgtgggcgatacgggatatgcttcctacgtctgtgtctatctctaagctcgatgtgggctctgtgcagaccactttctttattttcctcgttttgtttaccgtgatgttgattgctgaaattggcattatggtccgtgagatcaagaaaggaccgacggttaatcattag

SEQ ID NO: 1540 - DNA, 429 bp, B.fragilis
gttaatatgtatatgaaaactttatttttaaaacgattgatgtttatttttcttctttttgtagcatgttattcaagcgctcagtctctgaggtccttgccctttcaaaaaagagacagtacattgattcggattgcaaaggaaacgttgaagaagaaagcgcctgagtatttaattgaaaatggtgccccgattatttcgaagcaccgggttcgctatttgactccagcagaagaaaaagaagtgcctgaatttagtacgttttatggggccaagtcaggccaagtctattatattgtcgaatttcctcaagatgaatcaatagaatcttttgatgctggatttgtagcccaagtttacatttgggaagatacctcaagacctttttctattgctttaggaaatagtctgattatggatttgaagtag

SEQ ID NO: 1541 - DNA, 1341 bp, B.fragilis
atttatcgtctggggaatagtgacctataccatcaaaaagaacaggagaaaaagataatgtttggactaatggactgcaataacttctacgcaagttgcgagagagtgttcaatccggctttgaacggtaagccgatcgttgttttaagtaataacgacggatgtgttattgccagaagtaacgaagcgaaagcattggggattaaaatgggagttccggcttatcagatcaaagatgatattcagaaatatggtatatctgtcttttcatcgaactatacgctatacggcgacatgtccggacgcgtgatgtccatactggcagaacaagtgccggaaatggaagtatacagtatagacgaagcatttcttaacctggaagggattcgggatattcagtcactcggaacagacatcataaacaaagtaatccgcggaaccggcatacctgttagtttgggtatcgccccaaccaaaacactcgcaaaggtcgccaataaatttgcaaagaaatatcctgcttacaatcgtttatgtatcatcgatacagaagaaaagcgcaccaaggctctgcagcttactgaaattggagacatctgggggatcggtcaccggcaagttgccaagttagaaaagcagggagtcaaaacagcctatgactttaccgagttgcccgaatcttgggtgcgtaagaacatgactgtagtcggagaaaggacctggaaagaacttcaaggcatttcctgtattgatatggaaaccacaccaccggccaaaaagcagatatgtacaagtcggtcattcggcaagatggtggaggacatcgatacaatgtcggaagcaatcgccactcacgcttctacatgcgcaaagaaactccgacaacagaaaggctatgcaatgtcactaatggtattcatccatacgaataacttccgtaaagattcgccacaatattggaggaatacagttgtacatcttccgataccaaccaatgacacattagaaattgtacattatgcactggctgggctaaaaacgattttcatgcaaggctatcaatataagaaagccggagttattatcaccgaaatcaccgatagcacccaattgggactgtttgattcagtagatcgcgagaaacgtgaacgtcttcaacaaacaatagataagataaacggtaaacacagccgactcgtcaaattagcaattcaaggtacagggaggaattggaagcttaaacaaaaacagctatcagggcattataccactgacatcaatcagattataagcattaattgtacttacccaactgcatgtcaacgaaaacaatatagctga

SEQ ID NO: 1542 - DNA, 864 bp, B.fragilis
aaacaattacatatgtataaaaacattttaatattaggtcgtggaattgggcaagtgatgtttcagaataatgctctatccggtgggttgatgttattaggaattgcttttaattcatggcagctcgcagttttatctgtactcggtacagtcgttagcactttgacagcttcattatccggatatgataaggaggatatttgtaacggattgtatggttttaatgggacattggttggtattgcaattggagtctttatggaaatcaatgttacatctatattattgcttatctcaggctctgctttctccacatgggttgcgcgttgttttcgttatcagaacagagtatcgggactgacagcaccctttatttttgttgtatggcttctgcttgttgggtgtcattatctatacccttctttactgttatcttcatcgttggaaaagcctgaactaacaatggatattttccgttcattctgcttaaatatcggtcaggtgatgtttcagggaaatatactttcgggattattttttcttttagggatcctgattaattctcgtatgaatgctctgtatacactgaccggtgcaatacttcctttatttatgattttatatccacatactgatcttgctgcatggaatttgggattattaggatataacggagtgctttgtgccatagccttgggagataagacaggcataggagtagtcaaagcgatattttctatcatactgtctatcgttctgcagttaacgggtatgcatatgggcatagtgactttaacggcaccatttgtcttttccgtatggattaccgggggcctgttcagtgttttcagaagtaaatcctga

SEQ ID NO: 1543 - DNA, 1080 bp, B.fragilis
ttaaacagacatactatgaaacgagtatttgtatttcaggactttaagtcccagaaattttggagcatcgatgtccggggcactgacgtaatagtgaattacggtaagttggggacggatggacaaacacaggtgaagaatttttcgtcggcaggggaagccgaaaaagctgccggtaagctgatagcggaaaaaacgaaaaaaggatatgtggagaccttggaagaggttgccaaagaaatgaaagtggaagccaaaaagtatgcgttgagctatgacgaagcggaagagggcgtaaacttgatggacaagatattgaaagacaaaaaactgccgtcactcaagcagatcacgataggctgctggggatatgaaggggaagactgctcggacattgccgatggcattgtggagaataaagagaagttcgcccatttcgaaggtctgttttggggggatatagattttgaggaacaggagatttcctggattgagcaagtcgatttgagtccggtgctggatgcgatgcctctgctgaataaccttaaaatcaaaggaacgaataatctgagcattggtaagaaaccgcgtccgaacttgaagtcacttgaaattatcagtggcggcctgcccgattcggtggtggaagatatcctgggttccgatctgccgaatcttgaaaagctggttctctatgtaggagtggaggattatgggtttgatggcgatatgaatgtattcagacctctgttctctaaagaccgtttccctaacctgaaatggctgggcattgtcgatgccgaagagcagaatgcggttgtagagatgtttcttgaatcggatatcctgccgcaactggaaacaatggatatttccgccggtgtgttgacggatgaaggggcacggctattgctggatcatgtggataaaatcaagcatctgaagtttatcaatatgaaatacaattatctgagcgacgagatgaagaaagagttgcagaaatcgctgcccatgaagatagatgtttccgactcacaggaatacgatgacgattacagttacccgatgattacggagtga

SEQ ID NO: 1544 - DNA, 777 bp, B.fragilis
ccatccgggcagcaagaagaaaggaaaataagtatgaacaaaacagtcatcgaacttcagaatatcaaacgtaacttccaggtgggagacgaaaccgttcacgcattgcgcggggtttcgttcaccatcaccgaaggagagtttgtcaccattatgggtacgtccggttcgggcaaatcaacgctactgaatacgctgggttgcctcgacacacctaccagcggagaatatctgctggatggaatctcggtacgtaccatgagcaaacctcagcgtgccatattgcgcaaccgaaagataggctttgtcttccaaagttacaatctgctgccaaagacgactgctgtggaaaatgtagaactcccgctgatgtataattcgggagtcagcgcttccgaacggcggcggcgcgccattgaggcgctgcaagccgtaggactgggcgaacggttggaacacaaatccaatcagatgtccggcggacagatgcaacgtgtagccatcgcccgtgcgttggtcaataatccggcagtcatccttgcggacgaggcaaccggtaacctggatacacgcacttcgttcgagatcctggtactgtttcagaaactgcatgccgaaggccgcacaatcatatttgtaacgcacaatccggaaatagcccaatacagcagccgtaacatcgtgttgcgcgacggacaagtcaaggaagacagcactaacccggacattctttccgcagccgaagcattggccgctctgccggtacaagaagaataa

SEQ ID NO: 1545 - DNA, 318 bp, B.fragilis
tctaattacaaagaaattatggctaatctattcataactatagtgtcgacaaaaaaaatgttgaacggcaaacacaaagtacggattgccgtatcccacaacttagcaaccagatatataccaactaacatcataatagatgctgagaatgaattcaaaaacgggaaagtagtaaaaagacctgataaggacatattaaatgcacgattaaagaaaatatacgatatgtattatgaacgttgcatgaaaatagaatatgctaatacgttgacttgcacacaactgatcaaatactgtatatttgcagaatcaagataa

SEQ ID NO: 1546 - DNA, 1518 bp, B.fragilis
tgtataagcaaaaaaagaaatatgagtaagtttgtaatgactatctttggtgcttcgggtgacttgacgaagcgtaagttgatgccggcattgtattcgttgtatgtagccaagcgtcttccggaagaatttgaaattctcggggtgggacgtacggtttatgaagatgcggactatcggacttacatttataatgagatggagaaatttgtgaagtcggaagagcagaataaggagaagatggacgctttcgttggacatcttcactatctggcaatagacccggcattggaaagcggatacggacagcttcgcctgcgcattgaagaactgagcggagatagccggccggatgacctgctgttttacctcgctacgcctccatcattgtatggtgtgattccgttgcacctgaagtcggtgcatctgaataaaggccgtgcacgaattatcgttgaaaagccattcgggtatgatctggaatcggctgagaaactgaataaaatttatgcttctgtattcgacgaacatcagatttaccgaatcgatcatttcttaggtaaagaaacggctcagaacctgttagcttttcgttttgccaatggtatttttgagcctttatggaaccgtaattatatagattatgtggaagtgaccgccgtggagaatctcggaatcgagcaacgcggcggtttttatgatactacgggtgcactgagggatatggtacagaatcatctgatccagctcgtggcattgactgctatggaacctcccgctgtgtttaatgcggataatttccgtaatgaagtggtgaaggtatacgagtctctgactcctttgaccgaaacggatttgagtgaacatattgtccgggggcaatatacggcagggggaaataaaagggggtatcgggaagagaagaatatttcacccgactcacgtaccgagacttatattgcaatgaaactgggtatcagtaattggcggtggagtggagtacctttttatatcaggaccggaaaacagatgccgacaaaagtgactgagatagtggtgcatttccgtgaaactcctcatcagatgttccattgcgcgggtggtaattgtccgagagccaataagctgatattgcgtttgcagcccaatgaaggtattgtgttgaaatttggcatgaaagtgccgggacccggatttgaggtcaaacaggtaacgatggatttcagttatgatcagttggggggcgtccccggcggagatgcctatgcccgtctgatagaagactgtatcctgggcgaccagaccctctttacacggagtgatgcagtagaagcatcctggcatttcttcgatccgattctgcgttattggaatgaacatcccgaggcgccgttgtatggttatcctgctggaacttggggacctttggagagtgaggctatgatgcatgagcatggtgccgaatggaccaatccatgcaagaacttaacaaacacagatcaatattgcgagctatga

SEQ ID NO: 1547 - DNA, 240 bp, B.fragilis
ttagagttaaacgtcagtcgtctattgcccgcgttctataagttcgcccgcaacgtattctcccttgtccttatcggtgggctggctgctcagaaagttggggaagaaaaacaggcggagaatgaagaacatgataaagagtttcacaagtataatgagccacagggtacgtccccagggtcatgcttcgaaagccttctacatagaaattccagatgtggagcagtgtattcttcataa

SEQ ID NO: 1548 - DNA, 2073 bp, B.fragilis
tcaataatgaagcaaatacaacctgtttttttagctatgaagttttcttttcttattttcttcttttttagtttgcctgtcggtgcacaaagtatttttcagaaatacgggcgtttcctgactgaacctcgttcatatgtgtgttatcgtacggatggtaaactgaaaatagatggcaaactggatgaagtttcgtggcagaaggcaaaaccgacagctccgtttgtagatatcagcggggaggggtttcctacacctaaatatgaaactacggccaagatgctgtgggacgatgaatatctttatataggggcgatgttgcaggaggatgatatcaaggcacgtcttacacagcgggatactattatttattatgataatgattttgaggttttcatagatcctgactgggacgggcacaactattttgaaatagaaaccaacgcgcgtggggtcatattcgacctaatgctggacaggccttatcggtctagtggaaactttatggtacaatgggattgtccgggattaaagttggccattcatcgtgaaggtacgctgaataagtcgaaagacaaagataaatattggagtgtggagatggctattccacataaagcattgactatgaatttcaataatccattgaaagctggtaattgctggcgaattaatttttcacgtgtacaatggctgaaggcaggaggacctgaagaaaattgggtttggacacctaccggaaaagttgatatgcatatgccggatcgttggggatatttgttttttgctgccgagaaagtaggaacacccgaacatacttttgcattaccgtataatgcttctgtgtataaactgctttgggctatgttctatgtacaacaggaaaggtatgcgaaagagaaaaattatctgcgtacggaacaggatttcttcctgacagatgccgaattgaaaggtctcccgcaaggtgcgcaaatctcggttgaagccacttggaatacatatcaaatagccattactgttccgggtgaaggcagacgttacatcattaataatgagggacggttttggacagaaaaggttgctccgcgtcaagtgaagaactgggtgtggacacgtataaataagagtaaaagtgaaacggattaccgccaatggtttgccctgcttaaagagtgcggcatcagcggggtgatgtttgaaggatatgatgaaaacctataccgcatgtgtaaggaagccggtcttgaagctcatttctggaagtggacaatgaatcgtgccgaattgctcaacgtacatcccgattggtttgcggtgaatcgtaagggggagtctacgcatgataagcctgcttatgtggattattaccgttttctttgtcccaaccatgaaggagtggcccaatatttggcagatgattatgtgaagatagctcatttaccctatgtagatggagtacatttggactatgttcgtttcccggatgtagttctgcctgtcagcttgtggaaaaattatggaatagaacagacaagtgaacatcctgaatatgattattgctattgtgatgtttgccgtactaaatttaaagaacaaacagggcgtgatccgttggagttaaagtacccgatggaagatcagtcatggatcaatttccgcttggatgcgatcagtcgtgttgtcgaccaaattacaaaagcggtgaaagccgatgggaaagcaatttctgctgctgtattccccggtccttctatggccaagaaaatggtgcgtcaggattggggtaactggtcgctggatgcttatttcccgatgatctataatggtttttattacgaaggaccggaatggatcgggcgttcggttcaagagagtgttaagaccgttgacggacgtgcgaaagtgtatgccggactgatgtttcccgatataaagaacgattttgagaaagcattggatgaagcatttgataacggtgcatccggtgtttcattctttgacggaccatcagacgaatatctgcatcggtttaaagcctatctggacaagaaaggattaaagacggaataa

SEQ ID NO: 1549 - DNA, 894 bp, B.fragilis
  unsure (778): Identity of nucleotide sequences at the above locations are unknown.
gatcatgctgaccgaccggggttcgactattcagaatgggagaaaataggacttgcccactctttcagtactccatatttcatgtcgaaggacttttatgtaggctacggatggtaccgtaaagcttttccggtaaaaaaagagattcttggcaagaaaagttttcttgaattcgatggcgtatttcaagaagcagagattttcgtcaacggacacttggcaggcactcacaaaggaggatataccggattttccatcgacatatcagcttacctgaaagaagggaaaaacctggtagccgtccgagtaaacaactgttggcgccctgatcttgccccgcgtgcaggcgaacatgtatttagcggaggtatctaccggaacgtacgtctggtaataaagccccccacttacatcgattggtatggcacctgggtcacaaccccggacctggcagagaacaaaggtaaatcgggaagcgtccacatacggacagacgtatgtaatgcttcaggaaaaacagacacttaccgactcctgaccaccgttgtcgatgcacaaggcaaagaagtgtcttcggtttccacatcccaagtattgccggacaatgcaacctacacatttaaacaacaaaccaaagaaattcaggcacctcaactgtggcatcccaatcatccggcactatataaagtgataagctcactctatcacggacaagaattgatagaccgttacgaaacaacattcggatttcgctggttcgaatggactgcagaccggngatttttcctgaatggggagcacctttattttaaaggagccaatgttcacctagatcatgccggatggggagacgctgtaacccaaaaccggaatgccaaaaaaaatctccggtag

SEQ ID NO: 1550 - DNA, 1026 bp, B.fragilis
ttacggagtgagcggatgagaatacttgttgccagtaactcgacttccaagcgtacggactattttatcaaagcgggtagaagcctcggggcggacacctgctttgtcacttatgacgagttgtcggccgttcttcccgattgtcgcgatacggttgtaaagctggagcctccggtgtttcgggaggcggactttcggaaatacaatttgctctgcgaggagtatagaagtctgttgtcccgactggccgatatggataagtcggaaagtgtacactttctgaatgaaccggctgcaattctttgtgcactcgataaagtgtatactcagcggaaactgaccggggccggcctgaaaacaactccgttgctttcggatgcgcttagcacatttgatgatttggccgccatactttgccggcagaagaggggaggatttctgaaaccccgttatggttccggggccggtgggattatggctgtcaggtataatcatcgccgggatgaatgggtggcttatacgacgatgtcctgggaaggagggcgcgtttgtaatgcgaaacgtatctgcaggctgacgaaccggaaagagattgccacattggcggaagaagtcatacggtgtggggctgtccttgaagaatggatggcaaaggaaaagctggaaggtgagaattatgacttgcgtgttgtctgcaggggggatgaagtcgattatgtagtggtgcgttgcagtgacgatgccataactaatcttcacctgaacaataaagcgaggctgttcgaagaactttcgttggctccttccgttcgtgaagagcttttctgtcggagcatcactgccatgaaggccttggggctgcgatatgcgggcatagacgtgctgatagcccggaatacggacacaccttatattatagaggtcaatgggcagggagaccatatctatcaggatatgtatacggaaaataagatatatgccaatcagataaaaacgatagaatcacttttcaatggaaatagatga

SEQ ID NO: 1551 - DNA, 1236 bp, B.fragilis
cgttataacgatatgaagaagaaaaagatcattcttattgccgtaagcctcgccatactggcaggcggaggggtttggctctttggcggttctacggccaagcacaaagtgacctatgccacggcaaccgtaagcaaaggcgagatatcggagtcggtaaccgccacaggaactatcgaaccggtaacagaagtagaagtcggtacacaggtatccggaattatcgacaaaatctatgtggactataacgcggcagtgaccaagggacaacttatcgctgagatggaccgtgtgacactgcaaagtgaactcgcctctcaacgtgccacctacagtggtgcaaaggcggaatacgaataccaaaagaagaactatgagcgcaacaaagggttgcacgaaaaggggctgatcagcgataccgattacgagcaatcgctctacaactacgagaaggccaaaagctcgttcgaaagcagccaggcttcactggccaaggcagaacgcaacctgtcctatgccaccattacttctccgatcgatggcgttgtcatcagccgggatgtggaagaaggacaaacggtggcttccggattcgagacaccgactttgttcaccatcgcagccgacctgacccagatgcaggtagtggccgacgtagatgaagccgatataggcggcgtggaagaaggacaacgggccacatttaccgtagatgcctatccgaacgatgttttcgaaggaatagtgacccaaatccgtctgggagacgcaagcagtaccagcaccagcagctcgtctactaccgtagtcacatacgaagtagtgatctccgcccataacccggacctgaaactgaaaccccgcctgacggctaatgtcacgatctacacactggacagaaaggacgtgctctctgtaccggcacgtgcactccgcttcacaccggagaaacccctgatcggcgataatgacatagtgaaggactgtgagggcgaacataaaatatggacacgtgaaggaaatactttcacggcacaccccgtgcagatagggatcactaacggcatcaatacagaaatcacccaaggtgcttccgaaggcatggtagttgtcaccgaagccaccattggaaatatgccgggcggcaatgtatcgcctgaaggcggacaggaaggcggaggagaacaaagtccgtttatgcctagccatccgggcagcaagaagaaaggaaaataa

SEQ ID NO: 1552 - DNA, 621 bp, B.fragilis
aaccccgcccgtcgtgaagcggagaaaagtcgcaccgaagcagagttgaagaacttgcgaaaccaacttaacccgcattttctgctcaacacgctgaataatatttatgcactcatcgcctttgacagcgacaaggcgcagcaggccgtgcaggagctcagcaagttgctacgctatgtgctctatgacaatcagcagaactatgtacccctttgtaaagaggtagacttcattcgcaactacatcgaactgatgcgtatccgtctttcgggaaatgtagaggtcattacacaattcgacatacagccggacagccggacggagattgctccactgatcttcatctcactgatagagaatgcctttaaacacggcatctcccccaccgaactgagtttcatccacatcctcatctctgaaaacaaagaggagatccggtgtgagatacgcaatagttatcatcccaaaaccaacacggataaaagcggatcgggtatcgggctcgaacaggtaaggaagcgcctcgaactctcttatcccggacgttatcaatgggataaagccatctccccggatggcaaagaatatatatcgaaattattaatatttaatcatccatag

SEQ ID NO: 1553 - DNA, 780 bp, B.fragilis
gcatggtgccgaatggaccaatccatgcaagaacttaacaaacacagatcaatattgcgagctatgaaaccctacatttttccttcgtccatagagacggcacgtgcactgatattacatttggtgaaactgatgttagatgaaccggacaggaccttttgtatcgcgtttagtggtggaagcactccggcactgatgtttgacttatgggcgaatgaatatacggatatcactccttgggaacgactgaaagtgttttgggtagatgaacgttgtgtgcctcccgaaaattcggacagtaattatggcatgatgcggtcgttgttgctgagtattgtacctattccgtacgagaatgtgtttcgaatacagggggagaagaatccgaagaaggaggctgcccgctattcgaagctggtgatgaaagaagtgccggtggagaatgagttcccgctatttgacgtagtgctgctgggagcaggtaatgacggacatacgtcgtctatctttcccggacaggaagaattgctttcaactgatcatatatatgaggcgaattttaatccgaataacggtcaaaagagaatagctttgacaggacttccgattttgaatgcccgaaggatcatcttcctgataacaggaagggtgaaaagtccggttgtagaagatatcttctattcgggagataccggaccggccgcctatatagcgcatcatgccgataacgtggaactatttatggataatgcagctgctgaaaaagtcattcgcggataa

SEQ ID NO: 1554 - DNA, 1281 bp, B.fragilis
tatcaagcgcttgtattaagatttgtagtattaattaataatttgttttatatgagaataaaaaggttattgtatgctattgctacaatacttccctttctgtttctctgttcatgttatgaagaacaggaacctcaacaggagaaacaggataaggaaaaatggacaatgcaggttgccggtaatcagttaaatgaatttttaaatattaatccggatttacggaacctttacgcttatccggactgggatgctgcgcagattataagggagcggagcgatacagtttcatattacgtccctgtagtggatataacagctgatacatgctcttatttaataatagcacgcgcttcgaatgatgtttatttgtacatggtaagacttcctgaggaatactccggctttgattcctttttggaagaacatttaaaaatattacggattattgatggtgcccggagagtccctgttggatatttgcataattttccggatgatgtactgactcgtacccgttcttcaggctctctgtttaatcatgaccgcgaaacgaatacggaaattcttgaaaataacacctttgttaaagacgatctttttggtgccggtttttcgttacccgaagtgacagtaatcggtagacgtcctacatcttctgaagacccgtttaaatggccttttggggatatgccttctgagtctccgaaagcccttcccggacttgatgactttttttctcctcaaggaggcggttcatcttcgttatcttcgccacagcaatcaggctctttgcctaaacctgaagaagtcattaaggatgcaactgtaaaaaaggctttggaagaagcctggagtgatatgcttaagcgttccacaaaagatcagaggcaagaggtcggtttctggatttattatgatccggtgaaaaagcaatattatataggtaagaaacgatatggtatagcagtgaagaatgacggaaaagcaagagggaatataagccttggagacaaatccccttctgtaaatggtgtgcctgccacagcaaaggtggttgcttcttttcatacacacactccaatgactgaaataaaaggcatgaaaagaaaagtaggtccatctaaagaagataaagggaatgctgataaaaataggattccaatcattgtttatgattacattggtacaaaagatcctcgaacaaatgattattatgttattggtggacataaagtaagtgaccccaaaaaaatgtatatttaccaacctaagaaataa

SEQ ID NO: 1555 - DNA, 1260 bp, B.fragilis
aaacaattgagtatgaaaatgattttaaatttttctgaatgtattattagttttttctcgttatgtttattgtgtgttgtcttctcttgcgatgaaatggatattgaccaaggtcctccaacttccgttacgcgtaatctgatgacatcagatggtcccggttttaagatcgatacagttacgtacgataaaattccggctgaatatgcccggaaaatattgtctcttgaagaacctacttcagttgtaactgataagagcaagcgctctttcagagtgaatgaactttttcaaattagaaaagcaaatgatcaattgctttcaattaccagctattccgccaagacggtttatgatctcatacttgaagtctatgtagaaggtggttcccagtatgttcctattgcttatctggactccataccgggattctcacaatttgagtttaagccatcgttgatcaatggaaatttcatatataaaaaggataacggtgtggatactctgtccctttcgagcctgaacgaaaagagaatgaaatttcgtttacttagcgatgataagcattttgaaatgctttctaaaatagatgcggagtggaatatttctttttcaaattatgattggaaaccggggtatgaaagtggttcatggcgcgagttgagtgccatctatgcacgtgagtgggtggtcattattacaaattatgcctatatgatgactactcccgagtatgcttttatcatgagaaattttagtaaaatatttggtggagaactttatgataataaccgtgttaagttcacaccggaaaagtatttatcagaagaaaaacgtttcaaacaaccgcataactttgtttgtggacgatctaaaccctctgttggcggtttgggcggaggaaacgtgtggggagtaactcactggaattattatggtcattatgcttcttttagcggttgggaatcaattacacatgaatttatgcactgtatgggatatggtcattctagtaacatgacttatgcttccggtggagtgggatggaccgagttcatgtggcaactacatacttatttgagagggaatgattggctgccatatacggatcggaatctgttaggttttcataagccggaaaacgcgaaatatcgtgatggtggaattgaccctgataaactgaatgataataagattctgcagttttataataaaagtaaagttacccaatattttttagctaatccgttgtctaaataa

SEQ ID NO: 1556 - DNA, 477 bp, B.fragilis
actaaaattattatctttgttcccatgaaacaatctctgacatcagcccgccgtcctctggaaatcctgatacacatcatcagttgggggattgtgttcggtttcccgttcttcttcatcgatcgtacaggagacagtatcaattggcatgcctatctgcgtcattctgccgtacccctctcttttgtcaccgtattctatttaaactatttcctcctcgttcctcatctcctcttccaggaacagaagaataaatacatcatctacaacatcttattggtctgcctcatcggactgctgctgcatatctggcaaagcctgaatgccccggctcccactcttaaaaaaccgcatatgcctcccggatgggatttttttcgtaagagacattctaagcctcatcttcaccatcggactgagtgccggcatccgcatgagtgccccgttggggacaagctgaaaccccgcccgtcgtga

SEQ ID NO: 1557 - DNA, 1548 bp, B.fragilis
tgtccgaatatgtatatccctgatccgaatagaatgatgtcctctttgagtaccgtccggagtatctattatagaggtagtctggagcattgcaattatacgtgttcgtattgtccgttcggcagaaagtctgtgtctgccgatacgacagaagatcaggaagcattggatcgctttatttcccgtatcggcgggtggaaatacggttcattacgcatcctgattattccttacggggaagcgatgatacatcgctactatagagagggcatcatgcgcctggccgctatgccccatgtgattggagtctcttgccagaccaatttgtccttttcggtatcccgttttttagatgaggctgaggcggagcaggcagatgtgtctaagttcaggttttgggcgagctatcacccggagatggttggggtaggggagtttgcatccaaagtagagatgcttcgtgcggccggcatcggggtatgtgcaggggcagtcggtgatccttcggcaaaggaacaaatccggaaactgagacagctgctggatccgtcggtttacctgtttgtgaatgccatgcagggattgcggaagccgctgtcggaagaggatatccgtttctttggtgaaatagacaatctgttcgattatgaccggagaaatgcaaaggcgtgcttggacggctgtgtgggaggtagggaaacactttttatcgaccggaaaggggatatgtatgcttgcccgagaagtgggatacggatgggaaacttttacgatgaccccacttcggattttcagcccttctgccttcgtaaagtttgtgattggtacattgctctcagtaatttgtgcgatacgcccttgaggagaatgatgggggatggcgctatgtggcgcatactcgaaaggaagaaggtggaagctgtcttctttgatgtggatggtacgctgacggatgctcagggacggattccggaccgtacggtttcggtattggagtatatggctaagcgtttgcctttatatctgagtactgctttaccggtgtcgcatgctaaaaaacggcttggcaatgtgttcggcctgttctcgggcggagtttttgcggacggaggtctgttatgctacggggaaactatcgaatgtgttccgattgcaaatcctgtgactgccggttttccgggttgcagggtgacccgttatacccgggaggggaaagtctttaaatatgctgtgcttgcaccgaatacccgggaagctgtccggtggctgaccgaattggatgaagaggcgtatcaattgtatcaggagggacgattgctgacggtggtagacagtaaagccggtaagaagaacggtctgattactctgtgtgctcgattggggatttctcttagggaggttttggtagtaggcaatacgatgcatgattggccgatgatgtccgtagccggctattcttgtgccgtgatggatgcggaagaaaagttgaggaaactatcgggatatgttctgaaccccgatagtattcctgtattttttgatatctga

SEQ ID NO: 1558 - DNA, 1188 bp, B.fragilis
aacctcgtaatgaagaaaatacacataggacttttgccacgtatcatcatagctattatacttggtatcgctatcggaaatttcctgccgacacctttggtacggctgttcgtgaccttcaactccatctttggagaattcctcaatttctccatacctcttatcattctcggactggttaccattgccatagccgatattggtaaaggagccggacgaatgctgcttgtcacggcactcattgcatatggtgccactcttttctccggatttctgtcctacttcaccggagccgccattttcccttcgctcattactccgggagcacctctcgacgaagtgagtgaggcgcaaggaatcctaccctatttctctgttgccattccacccttgatgaatgtcatgacggcactggtccttgcctttaccctcggcctggggttggcaagcctgcatagtgacgccctgaaaaacgtagcacgagactttcaagagatcatcgtacgtatgataagcgcagtcatcctcccgttgctgcccatttacatctttggtattttcctcaatatgacacactccggacaagtattctccatccttatggtgtttattaaaattatcggcgtcattttcatactacatattttcttgctggtttttcaatattgcattgcggcattgtttgtccgtaaaaacccgttccgcttgttgggacggatgctgccggcttatttcaccgctttaggcactcagtcatcagccgccaccatccctgtcacactcgaacagaccaagaagaacggtgtatcagccgatatagccggatttgtcatcccgctttgcgccaccattcatttatccggaagcaccctgaagattgtggcctgtgctttagccttaatgatgatgcagggcatgcctttcgatttttccctgtttgcaggtttcattttcatgctcggcatcacgatgattgccgctcccggcgttcctggaggcgctattatggcttctttaggcatcctccagtccatgctcggtttcgatgaatcggcccaggcattgatgatcgccctctacattgctatggacagtttcggtacagcttgtaacgtaaccggtgatggagccatcgctctgattatagacaagatcatggggaaaagaaaaactcccgaaagcctctaa

SEQ ID NO: 1559 - DNA, 450 bp, B.fragilis
aatagaatgatgaaaagaaaacttgaaatacataagattgacgtatccagcagtttgccgatcccatacgccgatgaaggtatacgggccggtttcccgtcaccggcacaagactatatggagcaagccatagatctgaacaaagagctaatcaaacatccggccagtacattctttggacgtgtagtaggcgattcgatgcgggatgaaggcatagaagaaggagacattctggtcatcgacaaatcactggaattacaggatgacgaccttgccgtgtgttttattgatggagattttactgtaaagcgggtacgaattgaacctaatgccgtctggttaataccggcgaatccgaaatactccttgattaaagtaacaaaggagaatgaatttatcgtctggggaatagtgacctataccatcaaaaagaacaggagaaaaagataa

SEQ ID NO: 1560 - DNA, 960 bp, B.fragilis
tttatgaagatagtagttttagacggttatgccgccaaccccggagatctgaactgggacgaattgagaactttgggtgagtgtgaaatctatgaccgcacggctcccgacgaggtacttgaacgctcgaaagatgcagaagcgattcttaccaacaaggtggtgatcacggcagaacacatggcatccttgcccaacctgaagtatattggcgtaatagccaccggatataacatcatcgatgttgccgcagccaaagagcgtggcattaccgtaaccaatatccccgcctacagcactccctccgtcggacaaatggtttttgcccatatcctgaacatcactcagcgagtacagcattatgccgacgaggttcgtcaaggacgctggactcagagtcaggatttttgttactgggatactccgcttatcgagctgttgggaaagaagataggtcttatcggcctgggacaaaccggatacaacacagcccgtatcgctatcggatttggtatgaaagtgtgggcttatacatctaaatcacgtctccaactgcctcctgaaatccgaaaagcagaactcgaccaaattttccgcgaatgtgatattgtcagcctgcattgcccactgacggaatcaacacgtgacctggttaacacccgtcgcctggaactgatgaagcccaatgccattttaatcaataccagccgtggtccgctggtcaacgagcatgacctggcagaagctctgaataattacaaaatctatgccgccggactggatgtgctctccaccgagccaccccgtgccgacaatcctttgctgactgccagaaactgcttcatcaccccacatatagcctgggctacttcggctgcccgcgagcgcctgatggctatcctggtcgacaacctgaaagcctatatcggcggcaagcctgtgaacaacgtggccaaataa

SEQ ID NO: 1561 - DNA, 804 bp, B.fragilis
aacatacgggtggctatgattaaaaaaagtgataagaaaaatgtgaaaaaatgtataagaacgaattttaatttttatctttgtccaaatttgtatgcgatgcttgtcccaaccatgaccaccgaagaggtgtgtaaagaaataaagaatgactatccggctttttatgaaaaaatgttggataataaggctagtaactaccgaaagtttattaaagctgtcctatttccggttatacatcagttttcatggaaatcgtcatcgggtaatatgtggaatgtgataatgttggctcgttatcgtaatgagagaaaatgtcccggtattgtcccttaccttaaatatgaaaattggggtatgggaattatttatcctaaaaatatatatagtaatctgtctataattgactttaaacctcatttttggaaaaggtatcgggagcgtcagctaatacccaacggcttagaagggatttcttttgatgaacaaataaaatatttctttttaaatagcggtctctttacttttgatttcagagaaggctctaataaaggacatgagggttttgtcgggtatactaagaccggaattttctttggtgtcgtaataaaagagttggattatctctgtgtcaaaacttatgtgtctgctaatatgctttttgataatcagatagaaagcttggatagcgctgatgagttaagagagaagatattgtcgcatccggactattttcagaaaagagggaaactctttcatatcatgaatgactcttctttttggatggatgagacgatacgttaa

SEQ ID NO: 1562 - DNA, 864 bp, B.fragilis
aatcacttttcaatggaaatagatgaattaccctccggcacgcaggatcagaagccggacatagatatgaatgaaattgtaggtacgcatgatatactgatgctctgtttcgatactttgcgttatgacgtcagcgtggccgaagaagcctccggggggactcctgtactgaatagctgtggcaacggttgggagaaacggcatgctcccggtaatttcacttatccgtctcacttcgctattttcgcaggattcttgccgtcacccgccgagccgcatatgttgcgtaaccgaaagtggctcttttttccctttcaggccggtacgggacgtatacctcccgaaggcagctatgctttcaaagaggctacgttcgtacagagtctggctcaggtaggttatgaaacaatctgcatcggaggagtcaactttttcagtaagcggaatgatataggaagggtatttcccggctatttcaataagagttattggctgccgactttcggttgcacggataagaacagtgctgccaatcaggtggactttgccgtcgacaaactggaaaagtatccggcggaccggaaagtatttatgtatatcaatttttcggcgattcattatccgaactgccactacgtggaaggaaaaaagaaagacgataaagagtcgcatgcggcagccctacggtatgtcgacagtcagctgccccgcctgttcgaggctttcaggaggcgctcggacacgttggtcattgccctgtccgatcacgggacctgttacggtgaagatggttacgagtatcattgcatctctcacgaaaaagtatatacggtgccttataaacactttattctcagaaaatga

SEQ ID NO: 1563 - DNA, 1299 bp, B.fragilis
acactttattctcagaaaatgaacgaacaacagcagatttcacgatatgtcagctatatgtacagttatccgcataagacggcttaccgtacgttgactcctccggtctctctttctccttatcttgaacggctggaaggaagggaggctagtttatatttccacatacctttctgtgcccataagtgtggctattgcaatcttttttcacagcagtgttgcgatgcggagcgcatttcattgtatctccacacgatgcgccgccaggccgaacagctgtctgtggcggcacaaggcctgaagtttacttcgtttgccgtcggagggggtactccgcttattctggatgaaggacagttggaagagttgttctgcctggccgaactgttcggtgtgcatccttcccgggtgtttacttctgtcgagacttcaccggaatatacgcaaaagagtgttttgaggcagttgcgggcgaggggagtggagcggttgagcatgggggtgcagagtttcaatgagacggagttgaagaaactgaaaagaagacccggactcggtacagtagtcggtgcactcgaaaatattgtggaggcaggttttcctcagtttaacctcgacctgatttatggtatcgagggacagacggtagagagctttatgcgctctctgaacactgcacttacttatcggcccaacgagttgtttatttatcctctttatgtccggccgggtacacgcatcgatgtacgttcgacggatgacataggttatgctatctacaaatctgcccgtgagttactggtagggcaaggatttgtacaaacgtccatgcgccgttttgtcaggcgcgaaacaacggaaacggaattttcgtgtggtgacgaagtgatgctttcctgcggggcgggaggccggagttatttgggaaacttacactatgccactccctatgctgtacgtcagcaggcaatagccgatgaaatagaccattatatccggactaccgattttatgactgccgctaacggtttcttgctttccacagaagagatgcaaatcagattcattataaagaacctgatgtatcaccggggagtggacttggcggagtatgaaaaacgttttggtgagaagccggaccggaatcttttccgggagttcacagatcgtggatggattgaagagactggccggatagtgcgtctcacggaggaaggaatggcttattccgattatatcggacaggcatttatttcacctgccgtgaggaaactgatgtccgaatatgtatatccctga

SEQ ID NO: 1564 - DNA, 1608 bp, B.fragilis
gttatgaatacgaagacaaaacttctgtatgtaggctttcgtgcgttaaacacatgctgtctgtacgcggcttttttaatgataacatcgtgtggcgacaatgttgtgaaccccgacagcccggaaccggacggggaggatatgattcctgttacggtcagccgggttgaggatggcagctatatggaaagccatgttgatactcccgacacaaccgggggaagaacgcttgtagacgaatgggtgccggtgaaagagccacccgccagcagggccataccggctgccgtgccttacgaggggccttcagcggtacggatgacgctccgagaagagccacaggtcactacccgtgccgctacattgggcaacgacatttatttccggttgatcgctttccgtaaagtaggcagcaattacgtgttccagtcggctgcggattttacgacaaacggggcttccgctcccacactcaggcaaggaaatctgctcaccagagcaggaactgtccgtgtgatcggatactcgttcaatagtacggcagcgatgggaacgatcccttcatcctatacttataacagtacttccgtcactatcccggatatgaacagtgactttatggtctatgactcgggggacatagcgaatgtgagcacaatcagccacaacctgtcggttagtttcacgcaaaaactctgcaagctgacggttaaactctccttgtcgcagtttgggagcaacacgtttaccaactgtacgggggtatatgtttctcaagggggcaatgcgtctgcctggacgataggcccctctacaaataatgtaagtgccaataccggaaatacacctacattcaatatagccaataattcgactgccactgtacggttagtccctttttcgggttcccgggcaatcacggtgcatatcggtacgttgaaacttagtaattatttcaatgcgaataaccggaatatcacctcaagccagaatgtacagttgctgccgggaaagagttataccattacactgaagtttgagttggggatacaattggcggcaagtgacattaacctgacacaaaacggatgtacggcgagtgataagaatgatttggcaaagctgagatgggctacaggaaatttgaagagtacaggaaatgttaattacgtatgggcatcttcgcaaacagaaggcggacatttttattccttcaataaactttatgatggaagcaccggagatccatgttctaaactaaacactgcatattatggtacaagctggcgaacaccaactaaaaatgaactggaaaaactggtacgatgtacagatagagtttataacggaggtatgtggtttatgaataaccgtttagggctatttttaaaagcagcaggaatgcgaccggaaactggaccgggcttagagggaacgggatcaggaactagtggtgtttatctaacttcaacactagggaaccgtaaaaatacttgttatgctctggattttggaacaacatatatagtggtcactgatactggtgcttggaatgctctccaaattaatggttattctgtccgttgtgtaaaaggtaccaaacaataa

SEQ ID NO: 1565 - DNA, 1425 bp, B.fragilis
ccttgcatcaacaatcacacatcgtataactactataaatttagaatcaaaatgaacagagagaacaaacctttattcctatatacctttatcaccgtctttggtggattgattgtgggattaaatatggcaggtatttccggagccgttccttttttacaggaacaattcatgttggatgatatggctttgggattggtggtaagtattctgaccgtaggttgcctttgcggtgctttgctgggaggaggttttagcgaccgttatggcagacagaaagtcatgttctcgtcagctgtcttttttattgtttcttctttgggctgcgcattatccggtaatttggtttcactgctggtttttcgcctgatatgcgggctgggtatcggagtgatctctgccgtagcacctatttatatatctgaaatatctcctgcccggctgaggggaacactggtttcctacaatcagttggctattgtgataggaattctaattgcttacattgtagattatatattgctggactatgagcggaactggcgcctgatgttgggattcccgttcttctttagtgtggcctatctgttgttattgggtatattgcctgagagcccacgttggctttcggctcgtggaaaagcaggtagagccaggcaggtggccagtaaactgaacctggaagccggtgagatgaccgtgtccgacacaaacacacaagaaggtagagataggataaaggtaactgaattgtttaagggtaacttggctaaagtggttttcataggttctatactggccgccttacagcaaatcacgggtattaacgtcatcatcaattatgcaccttccatcttcgagatgacaggtgttgccggggatattgcccttgtgcaatctatcctggtgggagtggtgaatctgctgtttaccctgattgctgtgtggctggtcgataaagtagggcgtaagattctgcttctttgcggaagtctggggatgggcatctcattgctgtacctggtttacactttcgtagttccggcagccaatggtatcggtgccttaatagccgtgttatgctatatcggattctttgccgcttcactggcacctttgatgtgggtggtgacttccgagatttacccttctcgtattcgtggaacagctatgtcactctccaccggaatcagctggttatgtacttttctcaccgttcagtttttcccctggatactgaataacctgggcggatcggttgctttcggaatctttgccattttcagcattgctgcattcgcattcattttgttttgtgtgcccgagaccaagggcaagtcactggaggcaatagaaaaagagctgggagtggataaagaggctgaggagaatgtgaaagaagaacatgctttctcgaaaatataa

SEQ ID NO: 1566 - DNA, 555 bp, B.fragilis
ggagaatgtgaaagaagaacatgctttctcgaaaatataataaacacaaaattggatataagtatgaaacaaagtaaaagaaatgtatggtggtccgtctgtgcaggacttttgttctgctcgtggggatgtagttcccgggtgtcggataagccggtaacgctggaaacgttgttggacgaaatggtatcggtggaggaacaggcgctgtatccggttccctcttatacctgtcgtcaggaaagtagctacgaccgtgcatcagtatcacccgattctgccggttggtttgccaatagtgacgggtttggaatcaaacgggtagatacggtggcaggccgcattgagaaagtgatgttcgacgaagtcggacctggagcgatcactcgtatctggattactaccattgacaagcggggtacgtggcggttttattttgatggttctgatcaaccgggctggatcattccggctcatgacctgttgcggatcaatgtacccggattgggaaaggtaatgttacatggcacacaccatctatacgccttatggtaa

SEQ ID NO: 1567 - DNA, 186 bp, B.fragilis
tgcaacaaagataagacgcttttttcatctgtgcaaatatttatacattattctaataatcagttatttatctcttcttcttatattcagtgcacagagccaaaacagtgtttcaaaaaaggaacgtcttttgaaacacaagagtcgttctatctgtctaatttacacaaacttaccgcaaaataa

SEQ ID NO: 1568 - DNA, 1512 bp, B.fragilis
tatatgaatagaacttttattatgcgagagtgtctcggtaaagccttatggctgtgtttttgcctttcgatagcaggatgtgccgaagatgacagaatgactcccctgtctgctgacagcggggatactgccgacgagttaatccccatccatatcagtctgacaggtgacaacgactatcattcttcctcttttaacaacgcttcgacccgtagccactctcccctgatcgccgaatgggtgggggtaaaagctttctcacctacacgcacaggagagcaaccggactatgacggtccacggatagcctcgatggaactgacggaagataccctgccccgtgtaagtacccgtgcaacagtgcctgcgggagtctatttccggctgattgtttttcggaagtccggaaataactatgtcttccagtcggttgccgattacgcctccaatggtacgggcactcctgtactcaaacaagggaaattgctgacacgctcgggaacgatacgtatggtgggttactcctttaataccgctaccgctgccgacttgggaactatgctttccacgtatgcctacaacagcagcacagtgtctatccctaacatgagcaaggacttcatgaccttcgattccggagatataacgaatgtaaatagcctcagccacaatcttccggtgagtttcaatcagaagttgtgcaaactgacaattaccatcagtcctaccggatttccaagcaatacgatcaccaattgcacgggtgtatatgtaaagcaagggggaaactccacatcatggaagatcggcccttcgaccaatgtggtggccaccaacacgaataatacggcggcattcagtccgagcacggccctaagtacaaccatacgcatggttccgtttgcaggggccagaacgataacagtgcatttcaatacactgacggtaggcggacggattgtgaacaacaacaccgaaatcacgtccacccaaagcgtacagttgaaggaagggaaaagctatacactaaaaatacagtttaaaaagggacccggcatcaatgtgttggagagtgatataaaccttacaggtaacgggtgtacggctcaggataagaaggatctggctaaattaatatgggcggacgggaatctgaaatcaacaggaaattctaactatgtgtggaccacttcaacagatagaggttattactatacttggtatagtacttacacaggaaatacaagccaaaataataccgatccatgttcgaaacttaacgtttcaacttatggaaccgggtggcgtacaccgtcgcgaaacgaactaaccaagttatctcggtgtacaaataaggcaaaagtaaataatggaatgtggtttatgaatagttccaaagggctctttctgccattagctggacatacacctagtgcatctggagccaatactggtggtaatgcaataatgaacggtaatcgccatggtaattattggtgtaccaaagaataa

SEQ ID NO: 1569 - DNA, 213 bp, B.fragilis
cccccgttatttattttattctccttcttacctagaattgttcgaatattctttccgaatacaatgcatattggaatcgtcttattcactaaacctatgccttttatattatattctgccgttgtgctcatctatatttctaattatatatccttattctataggttatacctaaactctcttgctcctactccacttataaactctggataa

SEQ ID NO: 1570 - DNA, 330 bp, B.fragilis
cttttcccttccttcaactgtacgctttgggtggacgtgatttcggtgttgttgttcacaatccgtccgcctaccgtcagtgtattgaaatgcactgttatcgttctggcccctgcaaacggaaccatgcgtatggttgtacttagggccgtgctcggactgaatgccgccgtattattcgtgttggtggccaccacattggtcgaagggccgatcttccatgatgtggagtttcccccttgctttacatatacacccgtgcaattggtgatcgtattgcttggaaatccggtaggactgatggtaattgtcagtttgcacaacttctga

SEQ ID NO: 1571 - DNA, 618 bp, B.fragilis
ataaaagaaacgatgctcttaccctggttaaacgaagaactgatagaagccggttgtgatgaagccggacgcggttgtctggcaggtgcggtttatgctgctgccgttatcttaccgaaagattttgagaatgaattgttgaatgactccaagcagttgtcggagaagcagcgatatgctttgcgcgaagtgattgagcgggatgcggttgcctgggccatcggcattgtttcgcccgaagagattgataagataaacatcctgaatgcatcgtttctcgccatgcaccgggcggtagaccggctgaaaacccgtcctcagcatctgctgatcgatggaaaccgtttcaagaagtaccctgacatacctcatactactgttataaagggagatggcaaatatctttcgatagctgctgcttctatccttgccaaaacttatcgtgatgactacatgaacaggctgcatcaggaattcccatgttatgactgggagcataacaaaggttatcctacgaaaaagcaccgtgcggctattgccgggcacggtactactccgtatcatcgcatgactttcaatctgttgggcgacggacagttggaattgttctcaaaatag

SEQ ID NO: 1572 - DNA, 936 bp, B.fragilis
aatattatgagtaagaaagcccttttaatgattcttgatggttggggattaggcgaccacgggaaagatgacgtaatcttcaacactgctactccttactgggattatctgatggagacctatcctcactctcagttacaggccagcggtgaaaacgtaggtttgcccgacggacagatgggtaactcggaagtgggtcacctcaatatcggcgcaggacgcgtagtttatcaggatttggtgaaaatcaacctctcttgtcgtgacaacagcatcctgaagaacccggagatcgtttcagctttctcttacgcaaaagaaaacggaaagaatgttcattttatgggactgacttcggatggtggcgtacatagctctctggaccatctgttcaaactttgcgatattgctaaagaatataatattgagaacactttcgttcattgctttatggatggacgtgacacagacccgaagagcggtaaaggctttatcgaacaactggaagcgcattgcgccaagtctgccggtaaagtggcttccatcattggccgttattatgctatggaccgtgacaaacgctgggaacgtgtgaaagaagcgtatgacctgctggtaaacggcattggtaagaaagctaccgacatggtgcaggctatgcaggaatcttatgatgaaggggtaacagaccagtttatcaaaccgattgtgaatgccggtgtagacggtactatcaaagaaggtgacgtggtgatctttttcaactaccgtaacgaccgtgccaaagagctgactgtggttttgaccaacaagatttgcctggagccagcatgcccacaataccggggattgcagtactactgttttgattccggaccagagctttggttcaagggttgggcatattttggttccataatggaaaacgttggctaa

SEQ ID NO: 1573 - DNA, 948 bp, B.fragilis
caaacgaaaggaggcaataagatgcgaacatatctttattgtgaggccggctttgtggaaaaagcacaatggcttcataacagctgggtcaatgtagtatgcccggacagcagtgatttcaaattcctgaccgaaaccctgaaagttcctgaatcttttttaaatgacattgccgataccgacgaacgtccgcgtacggaaacggaaggcaactggttgctgaccatactgcgtataccggtccagaacgctcaaagcagtatcccttataccaccgtacccatcggcatcatcaccaacaatgaaatcattgtttctgtgtgctaccatcagacggatatgattcccgatttcatcgaacatacccgccggaaaggcatcgaagtacgcaataagctcgacttgattttccgactgatctactcttcggctgtctggttcctgaagtatctgaaacagataaatatagacatcaccgctgccgagaaggaactggagcgaagcatccgaaacgaggacctgctgcgattgatgaagttacagaagacactggtctattttaatacttccattcgtggcaatgaagtgatgatcggcaagttgaaaaccatcttccaggataccgattatctggatgaagagttagtggaggacgtgatcattgaactgaagcaggcattcaatacggtcaacatctacagtgacattctcaccggaaccatggacgcctttgcatccatcatctccaataatgtgaatgcgatcatgaaacgtatgacaagtctttccattacattgatgatccccacgttaatagccagtttctatggcatgaacgtagacatacatcttgaggagatgcctcatgccttcctgctgatcatcctggtatccgtattcctgtctgccctctcctttgtgatcttcaggaagataaagtggttttaa

SEQ ID NO: 1574 - DNA, 185 bp, B.fragilis
ttacgtttgggccgaaggtatttggctttcttaaacgggaaaaaaaaacagcttttattttttgtcgcaaaccacggagaaatagtgcgtacacgtaacatgttatttttttttaacgtggggggtgtgttgaaattcgcgctatgtggaataacgaaatatgccggcttactctttgttttccg

SEQ ID NO: 1575 - DNA, 579 bp, B.fragilis
cccgaaaagacggaggcaccggcaagggcaaacccctttttcggatggcacccggaacatagcttttcacccatcaccacaaccgactttgccaaagctgccagagtggaacttgagcatcgcggcgacggagcaaccggatggagtatgggatggaaacttaaccaatgggcacgtctgcaagacggtaaccacgcctacaaacttttcggtaatctgctgaaaaacggtacactggacaatctgtgggatactcacccgcctttccagatcgacggaaactttggaggtaccgccggtatcacagagatgctgctgcaaagtcacatgggcttcatccaactattgcccgcacttccggatgcctggaaagacggaagcatcagtggaatctgcgccaaagggaactttgaggtagacttgtcatggaaaaacggacagcttgcagaagcaaccatcttctcaaaagcaggcgaaccttgtacggtgagatacggagataaaactctctctttcaaaacaagtaaaggaaaagtttataaattggctttagatgcagaccgactggtcatcaaataa

SEQ ID NO: 1576 - DNA, 270 bp, B.fragilis
agaaaaaggacgaatcagaaggttcgaagttatataaaagccgatttatcacttttttccaagttccgtgagaacttaatcacctttggacaaacaaatttaataaacaaatcagcatggttcagaaaggagcaagaaaagaatgacatacatacagtaacctctaataattatgcttatgaagtagaaaaaacgaatcctttacaaaccttattccggaaacaaaataaaatccggaatcctaaaacaaactatcaaattaatgtttaa

SEQ ID NO: 1577 - DNA, 189 bp, B.fragilis
ccttttgcaaatagagagaggcttatttttctaccaccttcctctgaggcggcacgttttattcattatctgctgctttttaataaaatagtggtgcaaagagcagtgataaagaaaattattattataaattcttgcatattattaaaagttatcgcatctttgccgagagatattgtgattttataa

SEQ ID NO: 1578 - DNA, 288 bp, B.fragilis
ttctatcaaataaaaatatccccggaagaaaagtattttttccggggatatttttgctttattacacagagttcactccatccggagaagtatattcatcatacagagatatccaaacctaatgttactgccatccggatcttactactaacgttctactatctttattgtaaaatccaaaaagtatcctatttaacattttggtatttctcaactccaacattcctaaatataaacactattaaacagaaccggatagaaaaccggaacgaaaagacaaaaccttaa

SEQ ID NO: 1579 - DNA, 1164 bp, B.fragilis
gatcacacatcaagatctcttgaaaaatcgcttttatatgattttactaactctcaaaaaacggtttacatgaaaataggaatacttacttttcatgatgctcataactatggtgccatgctacaatgctacgctctccaacagttcctctttaaaaaaggatacaacgtagaagtgattgactacagaccggcattctatcaaaagcaataccatcgtcacagtctatgcccgtggatagggaaaaatccagtacgcacaatgaagagtatctattataattattatcttttcaacaaacgttgtgccgcattctctgattttcacaatcgccacctctacatgtctataccggctactcgtactaatataccacaaagctatgatgcttatattgtaggcagtgatcagatttggaatccccaactcactaatggctttcatgatgtctatttctgcgatttttgttttcctaaaggaaagagtcggttcattgcgtatgcccccagtatggaaatcagcagattatctacacaagaagcagaatacctaactcgtgttcttaactgtttcgatgctctctctgtacgtgaatcatcacttattcccatactacagcctctcgtcagccagcccatccaacaagtacttgacccgacacttttattagatgcgacagcttggaatccattaataggcaaatgccctgaaaatcgtccttacgttgtattatatcaagttcgtgaaaacccagcagtccggatgaaagctttcgaaatagcccaatctattggaggcatagtagtagaactgacagcacgtatcgactgtcattattccactaagtatcaaacagcctcacctgcagattttgtcacttacatccgatatgcaacctatgtagtcaccacctcattccatggaaccgctttctcacttattttcaatcgtccattttacacattttctcttggagataattttgactcccgttcagcttccctccttgagtcagtaaatctcaccgagcgtttagtatgccccgacgaacagtttgaaataagtctaattgatttcaaacaagcgaataaaagactgaagcatttgagaaaacagtcatgtgattttttaagacagtcattacacgaaagacaagaacaataa

SEQ ID NO: 1580 - DNA, 2400 bp, B.fragilis
atatacttgtttccggtttatcattcctatcgcatgaaacgctgtctgctatatatcctttgctgctttggggttgtgcaactgtcagctcagccggcggataacatccgtaattcgtttgtaaaggcggaaacattttataagagcggagatatcgatgaagcttgtcgtatcttggaggagaatctgtcgtcttttcaaggtacgatgcataccgaggcgtgccgtttggctgcattatgctgtttagctttagaccgcttcccggaagcggaaaagtatgtttcgctgttattgaaagacgaaccttattattatatctcgcttcaagatccggaacgctttgcggatatggtaaggaaacacagggagactaaagtaactctggtcacagcctcacaacaggtagagaccccggaagaagctccggtgcctgttactttaattacggaggagatgatacgggctatccatgcccggtgcctgcgggatgtactgatagcttatgtgcccggtatatccggtttgtcttccaatgaagagatgaatctggctatgcgcggggtatattctcccgaacaggagaacatattgattatgcaggatggacaacgtctgaacagttatattactaatgctgtttcgccggattatggtattagtctggcaaaagtcaaacaaatagaggtgctgcgcggaccggcttcttcgctttatggcagtgtggctttgacagccgtgattaatatagttactaaagacggggtggatgttcgtaatggttccatatctgtcagtgccggtaatcggggccagttggctgctgacctgctattgggaaagcacgacatgaacatggactttatggcatggttctccttgtaccgtgcaacgggagaatcggtttttgtcccggccgaaaaacaatatgctctttaccctagggacggattcatccgtctggacaattattcgggatttcctgccatggatggaggaattaaattgcaacgtggaaatttgctttttagtttcagtatgaattacgcgaagaaaaggcaaccttatagcatgtggctcttttcttctccatattcttatgagcggtttcgtacttttgacggttccggcccgggatattccagatggtcggcaagagaacaggctgtttatagccgcacgtggcagcggatcactttcagtaccgcattttataccgattggaataaaaacgtacattatgaaacctcgggagatactttacaagactatcctatttttcctaactatgattatcaacctattatttatccgactcgcggagcatttcaatacatccgctggatggattttaacgtaggctttaatgggcgtgtaaactatgcctatgattgggggaagctggggaaaggcaatatgcttggcggtgtggaatggaatcggtatacgctttatgattccgagtatttggaaggtatgaattttaaagagatcgtcaggacgtggatcgaaaaacgactttacacgggacacgagatgaacacggatgcctttcttcagattaaacacaacctgcataaaaattggattgtcaatgccggcatcaggtatgactataaacggcgaagtaataagcggacattacaggctttttctccccgtctgtcactgatttatctcaggaacggattaaatatcaaagccagttattccagagcatttgtcgatgcgccctattattacagaaacaatgaaatggatacctattcgggtggcgaaaatctgcaagctgaatatctaagttcatatcaggtgacttgtgcttatcatcattcaccttcacatatagatgtagagtgtaatttattttataatcgggcgtcccatttcctgttcacacagccggaaacacgtgtttatgaaaatgccggttctctggatatgggaggtgtcgaggttgttgcccgttataaggcagaccgactgagcctggatggaaacctgtgttttcagaaagtattgaattataccaatttttttgttaccgatggatctgtgaataacgtacccggcttttctatgaatcttgtagcaaactactttttacttaaaaagaaagtacagagctggtctgcccatttaaaattgaattgcagtagccactgctacactcagataagtgtattggaagatggactcaatggagatgcgacgaattacacagtccgtttgcccggttatgctgtcttttctttcactaccagatataagtataaaaggatagaaggcagtctgggcattgagaatcttttcaataaccgatatgaatgcggaggagcgactgttcctatccgccagaaaggaaggtggatttccgccagtatattgtataatttctaa

SEQ ID NO: 1581 - DNA, 204 bp, B.fragilis
ctgcaattcccctcccccgaggggaaagaggattctgttcctctaccaataccaggatacgcctttaatacaatggcccacaattatccgggtctggcagatatcctgaaaagattaggcattaacgaggtgaacgaagtaaatgccattctcagactgccagattatgaaagaaagggaacagtacagcccctcttttcatag

SEQ ID NO: 1582 - DNA, 2865 bp, B.fragilis
atcctattacctaaaaacgtatcagccatgaaaaagatagtctttttgataatgtgtctttgctcggtatatgcaaattcacaagaaggtatcccgttttttgtaaactatccggcttcggtttatcaggcgcacaatcgtaatttcgatgtcgtttgcgacagttgtggaaatgtctattttgctaatttcgaaggtatccttcattatgactataaccgttgggaaactatttatacaccgggtttttcccgtgtcacccgtttgtttcgtgattcggaaggtaggatatgggtgggaggatataacgtgttcggacggatagagcgtgatggacgcggatgtattacgttgagaacccttctttccgatctggacacagactctttgggcgaattggaagatatggcagaaatagataaacgcatttatctgaaagctacatcaggaagatattatacggttcagtcagattccattttgacaccggttcaggtacttccggcccaattgcaggaaaagtggagaaatcaatcctcagtctcaatgaatcgggcgttttctctacccggaggagaaacaatctcgataaactctgcccatggattaataatggatgacagtgggaaaaaagaacggttttccgtaactgagagaaatggcttatgcagtaacgctgtttcgggtattgcggccgatgggcgtggcaatctctggggagctacggataacggtgtgtttcatgtttttattccctctttgttcagccgttatacctctggtgaaggtctgaagggagaggtaatatcggctgtctcttacaaaggaatgatatatactgggaccttacagggattatacgtattgaagcaaaacacttttgttcctgttcagggaatttcgcaagcatgttggcgactgtgtctttctccacaaggagaattatatgcagcgtccggcgatggtgtgtatgtgatccgggattataatcattcggaaaaactcacagatatggcagcttattcattggcattcattgggcatacgaaccttctgatgggcactatggatgggatttatcaatattcggcagatgaggaacggataaagaaaatttccgatgtcgaaaaagtcgttcgtctggaagtgaagaaagatcgttctgtatgggctaaaacgttgtacggagaaatctatttgcgggaagagggcgaaagctcttttgtacttcaagacagagagagtgaagaagtaatgaccgagtatacggacaacgatggctgtcattggcagacaaatctgaaaggaaaagaggtacaggtacatcattcgcaaattgatacggagaaattcaaccaatgcctgtatgccattcggaattatgtcgtgagggtgatttatattgaagaagacagggcggcatggttcggcggtgattttggtttaattcggatggaccttgaaaaggcccggacatttactccggttgctccccgcatctatcttcgtgaaatttgtctgaaccgtgattctgtctattggggaggagatttgccggaagagtctgggggagcggactggcagataaatagtacagcacctcgtttggggaatgatgtacgttccattcgtttttcatttgctaccgatgcgccctgtttcaccggctccaatgagtatagatatcgcctggtcggttatgatccggaatggagttcgtgggatcccgggactgtgaaagagtatgccaacctttcgtcgggtacgtatacgttttgtgtccgggcccgtgatatttacggtacagagagtgaaatgaaccaattccgcttttcgttattgcctcctttttatttgcaatggtattgtctgattctatatgccgttgcttttggaatgctgttgttcttattatttaaatggagaatgcgcagtttgctgaaagagaaggagaggttagaggcccttgtcggtcaacgtaccaaacagttggtccaccaaaagaatgaaattgaggaaaagtccttaaaattggaaaaagcattgaaggagctgggccaggcacaagatgaattggttcgccaagaaaaaatggctactgtaggtaaactgactcaagggttgattgaccgtattctgaatccgttgaattacattaataatttttcccacttgacctcaggattactgaaggacctatatcagaatctggagagtgtaaaagaacttttggatgaagatacctacttggattcggtagatgtcatcaacatgatgagagataatctggaaaagattgaggaacatggaagtaacaccactcgtgtactgaaggccatggaagaaatcctgagagaccgtaacaggcaactggaaaaaacagaattaatcggtttatgccggaaagacatggagctattgagcagttattatcagaaggagattacggctatgcacattgcggttcgtacttccttgcccgataatccgttgtttattgacgggaatgccgaacaactgggaaaaaccattatgagtcttcttaacaatggtatgtatgccatagccaaaaaatacggtaagaaagcctatccggcagagattggcctggcattggaaagtaaggacggacaggcagtcattcgcctatatgacaatggagtggggatcgagcagagtattctggataaaatcttcgatccgttctttactaccaaaacaaccggagaggcagcaggtatcggtttgtatctgagtaaggaaatcatattaaatcaccatgggcagatagcagtacgttctgaaaaagatgaattgacagaattcactatcactctgccattgtgggaggaaaagtcagtataa

SEQ ID NO: 1583 - DNA, 1032 bp, B.fragilis
tctatgatacctaaagtttcagttatagtaccaatatataatgtagaaaaatatctagaccaatgtgtacaggcacttcttgcacaaacactatcagatatagaaattattctaattgatgatgagtctcctgacaattgtccaaagatatgtgatgattatgccgctcaataccctaacataaaggttattcataaaaaaaatgcagggctgggtatggcttgtaacagtggcttagatgtagctacgggagagtatgtggcattttgcgactctgatgattatgtagattctgacatgtatatgaccatgtataatgtagcccaaaaatatacctgtgatgctgtttttacaggcttaaaacgaataacaatggctggcatccctacaggaacagtgactcatcaaaaagaatttaaactatacaaaaataaaaatgaaattcatacgcttctaaaagatttaatagcttcagatccttatgcacgcgaggagcgcgctattcaagtatccgctaaggtagtcctctaccgtcgtaatttgatagaaaaaaaacatctacgattcgtatcagaacgtatattaccttccgaagacttgatattcaatgtagatgtattggctaatagtaatattgtatgtgtactaccacaaaccttctataactatcggacaaatccgatctcaatttcgcacacaataaaaaaagataaattcagcctttttaaacaattatatatagagataaccgaccgttgccatcgattaggagtggaagacaatgtacaactacggatacaaagaatgttcctcggttacacacgcaactatatatgcaacatactcaattctagcataacaaacattgagaagaaacaaattacttcttcaatatgtaaagacggtatttggaaacccatttggaaaacatatcctctgtcagtaatgcctttaccacatagaatatttacattcgctatgcgtcataatttctattcattactgttagtattagcaaaaatcaagaaataa

SEQ ID NO: 1584 - DNA, 231 bp, B.fragilis
aaaaaggaaccggaagcttttatacaaattaattatgcagattcctatttaagattcagcctgatctgttatggtccaggaaataaaggccaacagaatatagccaaacaaaatagcaaccggtcagcccggattaagacagaaaagagatcagcacccctgccgctacggcagacccgatcactcccgagatattgctggccatgcaatattgcaatacatgatttttag

SEQ ID NO: 1585 - DNA, 432 bp, B.fragilis
gcaatgacgttacttcagtttcgccctgtcgatgggaggttagatgaaattcttagtatgctgatgcatagtcgtgaagttgcttcacatccttccctgtcttatgccatccgtttggtcagtgaggagatcattgtcaatattctcaattacgcttatccgcagcaggcagaaggttatctgactctgtgcttatgggatgaagacggagagattactttggagtttatagatggtggtattccattcaatcctttggataaagccgatcctgatatttcattaccgttagaacaacgtgaaataggaggattgggcattttcctggtacgtgaaatgatggatgacgtagcgtatacgtacgtgaataaggagaatcggttgaccattaaaaagaaatatctgcaacccactgatgaacctgtatcatga

SEQ ID NO: 1586 - DNA, 1551 bp, B.fragilis
tatcatatgccaagcgattctcaaaataacaaacgcatagcccaaaatacactgttattgtattttcgaatgctctttttaatgctggttagcttatataccagccgtgtcaacctaaatgcattaggtatagaggattttggtatatacaacgtagtaggcggccttgtcgctatgttctccattatatcgggctctctggtgtcatccatcagcagatttatcacctttgaacttggaacagaaaataaagaaaaactaaaaaaagtattttcaacagctgtttctatacagttttttctggttatcatcgtggttattcttgccgaaaccattggactttggtttctaaataacaaaatggtaatacccgaagaacgtatacttgccgccaatatcatttatcagttctctattatatcttttgcactttcgttaatgagtattccctataccggaacaatagtagcacacgaaaaaatgtcagcttttgcctatatcagtatttttgatgtcatagggaaactggctgtcgctctaaccatttctatagctccgatagataaactaatttggttcgcaggcttcattgtattcaattctaccatcatacaaagtatatatattttttattgtaaacgccattttgaggaatgtacttaccatttcatttttgataagtctttactcaaaaatatgttcggtttcgccggttggaattttatcggctctatagcagctattctccgtgaccaaggcggaaacattgtcatcaatatgttttgtggaccagccgtaaatgcagctcgtggagttgccatgcaagtcaacaatgcagtcagtggttttgtctccaactttcagacagcactcaatccacaaattacaaaaagttatgcttctggcaactatgattacatgatgcaactcatctttcaaggtgcacgactttcttattacattttacttatccttgccttacctatcatcagtaatacccattttattcttcaattatggttggggcaagtaccaaaacatactgtactattcgtacagcttgtcctattcttcactatgagtgaatctttagccaatcctctaataaacgctatgctggctactgggaagatcaaaaaatttcaaattatagtcggtggacttaatctggtcaatttacctttatcttatatctgccttcgtttaggatgtattccagaatcagttgtgataatagctattatcatatctatgatatgcgaaatggcccgtgttattatgttacgtaatatgatacactttcctgctcgctccttccttaaaaaggtatatttcaatgtaatatttgtcaccatcacagcctctatactccctctgtacctacactttatacttgaagaaaatatttatacttttactctcataagtgtagtttcattttcatgtacacttctctctattttatatattggttgcagtagtgaagagcgtgtcatggtatttagtaaagttaaggtaatagtgaacaaagtatcaaaacgctataaataa

SEQ ID NO: 1587 - DNA, 453 bp, B.fragilis
tcacaattcacacacactaatcacatgacgattgctgttgattttgatggtaccatcgtagaacaccgctatccgaagatcggagaagaaattccattcgcaacagaaaccctgaaaatattggctcaggagcgacataagcttatcttatggaccgtacgcgaaggagaattgcttgaagaagcgattgaatggtgccgccaacggggagtctttttctattctgtcaacaaggactatccggaagaagaaaagagtcataacggattctcccgtaaactgaaagcagacctgtttattgatgaccggaacctgggaggtttgcctgactggggaaccatctaccagatgatccatgaacaaaagccatacgaacctgttctatgtgacaggcagaaaccgaccggcgatttaagctggatagagaaactgctcggcaaacgtaacaaataa

SEQ ID NO: 1588 - DNA, 1065 bp, B.fragilis
agaaagaggttgacaatgaacaatcatgtagtaattatggccggtggcataggaagtcgattttggcccatgagtacaccggaatgtcccaaacaattcatagatatattgggatgtggaaaaacactgattcagctaactgtagagagattcggtaatgtttgtccacaggagaacatgtgggtggtcacttcggaaaagtatatagatactattcgggagcaactgccgggtatcccggaaagtaatatactggcagaaccctgtcccagaaatacagctccctgcattgcgtatgcctgctggaaaataaaaaagaaatatccggaagccaacattgtcgtgactccttccgatcaagtggtaatcgataccactgaatttcgcagggtgattgagaaagcgcttttgttcactgataaaagcagtgctatcatcacattgggaataaaacccgcccgtccggaaaccggatatggatatattgccgcaggtgaaccgataacgagagacaaagaaatattccacgtagaagcattcaaggaaaagcctgataaagaaactgctgaaaaatatctggcagcaggcaactacttctggaatgcaggaatattcgtttggaatgtgagaacgatcacagccgtaatgcgagtatatgcaccggggatagctcagattttcgaccggatatatcccgacttttatacagaacgcgaggaagaaagcgtgaagaagctattccccactgccgaaagtatctcgatagattatgcagtgatggaaaaagcggaagagatttatgtattacctgcccaaatggggtggtcggacttaggtacctggggagcattacacaccttgttgccaaaagataaagaaggaaatgcaacagtaggaccggatatccggatgtatgaaagtcaaaactgcatggtgcacgcctcacaggaaaaacgagtagtcatacaagggctgaacgattacatcatagccgaaaaagacaatatattattaatatgccagttatcagaagagcaacgaattaaagatttctcaaaagaataa

SEQ ID NO: 1589 - DNA, 1110 bp, B.fragilis
tataacacaaccatgacaaatatattgggattgaaacaaaacagatggatcgttggggcagtactgctgctgacaacctgtaacttacaggcacaggaacagccaaacgccagggaaaagtttgaaagaggaaattggtttgtatccggtgccctgaatggagaatggctgaccaagacaatcggtaacgtatatgcaggcggcaaaatctccggaggtgtatatctgacgcctctttcgggattcagagccactgcagagatcggtaagaactggatagggaatgacacagaagccacgcaactcagcgcaaacctggattatatgttgactctgataggaaacaatggattcaaaagatttaatctggcggctattctgggtgccggtttcaactattatgactttggggacaatgatccgaaatatacaagggtcaacactatttcgggtaacttctcgattcaggcttcgtacaatgtaaacagaaaattcagcatatttatagaaccgggattaaaggttttacccaaatactacagcaaagaactgaacaacaaaatttatatgcaaagcaacctcacaataggacttgcatatactttcagagataaatatcggaagagcgtggacaacagcatccatcccctctatctaccggaagcggatctgctggagataaaggagaaaatagggatgctctgtgaagaggtaatgcaaatgaagcaggaattaaaggaacgccggaaaataacagacgggcaaaacctgatgattgttccgcaaaaggatgcactctccatcgatattatgttcgacgaattcagctcgttcgttagcgaagagcagggacagaaaatagacggaattggcgaatggatgaagaataataacgcaagtatccggatcattgctttcagtgataacctgaccgacaaaaaagcggatcaggagctgcgtaaacgtcgttcggaagccatccggaagatattgatagagaaatatcacatctctcccgaacgcatttcggaatcgacaccggaagcgatgggatatgaaaacaaaacgggatgtaatgcaatgattgtatacattcctgaaaacaaataa

SEQ ID NO: 1590 - DNA, 1752 bp, B.fragilis
aggcgtgaaacaacgtacaaattaaaagaaacaacattcaaatacatgaaaaagagcatactattcacatttgtgctttgcctcctgtcacaatggagtgtagcacaagaccctaagtgggttgagaaagcgaaacgatcggttttttccatcgttacgtatgataaagacgacaaaattcagaataccggtaacggattctttgtaaccgaagacggagtggctctgtctgactattcactgtttaaaggtgcccagcgtgctgttatcattaactcagaaggtgaaaagatgcctgttgagtgtattctgggagccaatgatatgtatgatatcattaagtttcgtgtgggcattacagtgaagaaagtaccggctttacaagtggctgctcttgctccggctgtgggtgctgaagtttatttattgccttattccactcagaaaggcggtaacgtgacccgtggtaaagtgaaaaaggtagataatatcggtggtgataaatatcattactatacgctggacatggtattgaaagataaaatggtcagttgtccggtcactacggcggacggtaaagtgtttggagtggcacagaagtcctcgggacaagatactgcctctatcagctatgcggccggtgcggctttcgccatgtctcaaaatatcagtgcacttgcgctgagcgaccctgccttgaatgctatcggcataaagaaggggttgcccgaagatgaagatcaggctctggtctatctctttattgcttcaacacaatccacacctgaggcttatgccatcgcccttgacgattttataaagactttcccgaacagtgccgacggttatcttcgccgtgccggaaactatgtttttgcagacaaggatgaaaaccacatggataaagcggctgccgacctggaacatgcgctgaaggttgcacagaagaaagacgatacctattataacatagccaagctgatatacaattatcaattgagtaaacccgaaactgtttataaagactggacgtatgataaggctctggagaatgtacggagtgcgattgccattcagagtttacccgtctaccagcagttggaaggagatattctttttgccaagcaggattatgcaggtgcatttgccagctatgacaaagtgaatcagaccgaactggcatctcctgcctctttcttcagcgctgccaaagcgaaggagttgagtaaagctgctcctgaagaagtaattgctttgttggacagttgtatagcccgttgccagacacctataacttccgatttggctccttacctgttggaacgtgcccagatgtatatgaatgtagagaagtatcgtttggcactggcagattatgatgcctatttcaatgcagtgaaaggtagtgtcaatgacctgttctattattaccgtgagcaggctgccttcaaggctaagcagttccagcgtgcgttggatgatatagcaaaggcgatcgaacttaatccggaagatctcacttatcgtgcagaacaggctgtggtaaatctccgtgtaggccgttacgaagaggctgagaaagtattgaaagacgcattagctatcgatccgaaatatgctgaagggtatcgtttgctgggaatctgccagattcagttaaagcaagagaaagcggcttgcgcaagctttgccaaggcaaaagagcttggagaccccaatgtagacgaactgattaaaaaacattgtaaataa

SEQ ID NO: 1591 - DNA, 318 bp, B.fragilis
aataaaagaacgatggaaaagtatgaaattcattttgtaggttccgtcttggattcaaatacaagcggtgacgaacaagcaaaaattgtagctcttatcgagcaaggacattctgttgcattagatctcagcggctgttcttatgtatccagtgccggattgagagtcatgctttatgcctttaagctggcgaaagctaaaagtagagatgtttgccttgtcggtgtgtcacaagaggttaaagacgtgatgcacatgaccggattcgataaattctttcgtttttatcagactctcgatgaattatcacaaccctaa

SEQ ID NO: 1592 - DNA, 1944 bp, B.fragilis
tgtatctttgcaccgcctaaaacaaaaactgtaaaacaaatgaaacagaatttttttcatcggtatctttctgcgaaggtactgcccatttggactattctattgattgatatatttattatcgtcgcatcctgcttgctcgcttactcgcttcgttacgattttcgcagcattttcttggattcgtcgacaatagataagaccattctttggacggtagtggctaacttaatcttcttccgggtattccgtacctattcaaatgtgcttcgcttttcttcgtttgtagacattatgcgcatatttgtgtcgcttacggtctcctatggggtattgatgattctgagtcttctgctggatgcttacctgggcattcggattggtgccatcagtgtactgtttatggcatatgtgatcaattttgctatgatggcctgttcgcgtattgtggtcaaaatgttcttcgaggtactcaattttgacggtagccacacgaccaacgtctttatttatggtgctaaagaagccggagtaaacatcgccaaatccctgcgtgtcaatttgcgtaatcattatcgtcttcgtggtttcattgccgatgaacccgaactgattggtaaggtgatgatgggggcgaaagttttcccgaatgatgaagcattgattgaaaacatgaatgaccgtgatgtgcataccatcattgtttctccggctaagatggaaaagctgaagaaatcagatatgattgatactctgctttccaataacgtgaagttgcttactgctccccctttgagtgaatggggtgggcaggcactgaataaaactcagttgaaggaaatacagattgaggaccttttgcaacgcgaaccgattgaggtggacatccataagatagcttctcacctggaaggtaaacgtgtaatgattacaggagccgccggttctattggtagcgaaattatgcgacaggtcgcttctttcaatccatataagttgatcctgattgatcaggctgaaactccgttgcatgacattcgtctggaattgcaggatcgttggcgtgacattgatgctgaaacgattgtagctgatatttcgaacgcaactcgtatggaggccattttccgtgaatacaaacctcagtatatattccatgcagctgcctataagcatgtgccgatgatggaagacaatgtttcggagtctattcagattaatgtatcgggtacacgtacgcttgccgatctggctgttaaattcggttcagagaaattcgtaatgatttctacggataaagccgttaatccgacaaatgttatgggttgttcaaagcgtatttgtgaaatctatgtacagtccttagccaagaaattacagaaggaaggcacacgttcggtacagttcatcaccactcgtttcggtaatgtattaggatctaacggttcggttattccccgtttccgcgatcagattcagcgtggaggacctgtcacagtgacccatcccgaaataatccgttatttcatgaccattccggaggcttgtcgtctggtactggaagcaggaagtatgggtaatggtggggaaatctacatcttcgatatgggtaaaccggttaagattgtcgatctggcaaaacggatgatcagtctttcgggacgtacggatgtgaaaattgagtttaccggtttgcgtcatggtgagaaactgtacgaagagttgctcaatgtgaaggagctgaccaaacctacttatcacgaaaagattatgattgccactgtgcgtgagtatgattatgacgaagtgaaagagagaatccagaaattaattgatgtaagctatacctatgatcagatgaagatcgtagctgccatgaaagatattgtccctgagtttgtcagcaagaattcttgttttgaggcgttggataagaaagactaa

SEQ ID NO: 1593 - DNA, 1152 bp, B.fragilis
actcttcatgcaacgtctacatcatttttttactataccaaccaatcagttactctcgtattcctacaagatgcgtttgatacattacttggtaaaaagcaaacattacacgatggcccatgtgctcttaatattcctttcaatcttaaagcattaatctttatgagttcgcctaaaatatctattatcataccagtttatatggcagaatcctatctacaccgatgtgtagatagtatcattacccagacatttactgattgggaactccttttggtggatgacggaagtcccgatcatagcggtgagttatgtgaaaaatatgcttccgcctacaagtcccgaataaaagctttccacaaaccaaacggaggcgttgcttccgcacgtgaatttggtatgcaacaggcgcgaggcgaatactctattcatgtagatccagatgattggattgacagtaatacactagaagaactctaccaacaagctgttaaagaacaagctgacatggtcatatgcgactttatgatggaataccctaaccgtcagatacacaattgtcaaaagccacaattattagattccagcagtttcatgcaccaactccttcagcaggaacgccatggcagtttatgtaacaagcttatacgtaccgaactttaccataaataccaactacatttcccggaaaaaatgatatgttgggaagatctttatatctgctgttccattctgctacatggatgtaaattagcttatgtaccccacgcattatatcactacgacttttatacaaacgataatagtatggtacgccacactgatatgcgtggtcttcaggcacagatagacttctgcagacttatgcaggccaaaatatcaccagagtatctgcctgaactcaatgaactaaaaggtataacccttatcacggcctttcgtaaccaattgcttaatgaacaagcaattcgttctctttttccagaaatcaatgattggtatgtaactagatatggacatgattatgaaaaatccaactactatggcctaacattagttcttcgtggctacaatttcaaaactgcaagaagaagaatgtttgtagccaaattcctagtacaaataaaaaataaaattacaagaatgctataa

SEQ ID NO: 1594 - DNA, 1650 bp, B.fragilis
acaacgaatgccatgaaactccgtacgatagtgaaaatagccgtaatctcgtctgttgtactgctgtgtacaggctttgccatgttttctttcttcaggttgtcggcggcggaaggacgcaaggattttaatctctacacgcttgttccgggttcggccactgtagtcctcgagacggatgatcttgccggaatgatacaggggatcaatgagttgagttgcagtaaagaccgacattttctttatgtttccaaattattttcttatctgaagctccatctgtatacgttgttggaagatacgccgcacgggttgagcaagcagatgaataaagtgttgttgagtttccatgaacccgacaatgatcgcaatcaggtgttgtattgcagcttgggaaacggcgattacgagttggtggaaaagtttatacgtaaatactgttcgagtagtttcccgtcaaagctgtttgactataaaggggaagagattcgtatttatccgatgccggatgacagtttcctggcttgttatttcacttccgactttctggttgtgagttatcagaaaaaactgattgagcaagtgatcgatgcccgtttgtccaagaaatctttgctgaccgatgcctcgtttgccaaagtacatgaggataaacgtgcccgtgtggcagctactatttatgcccgtatgcaaccgttgagtatgggaaaggctaccgacgggattcgttcgtgtacacagttgggcggatggaccgaatttgatatgaaaatgaatggagatgccatttatttctccggtgtcagccatgatacggatacttgtctgacatttatgaatgtgttgcgccaacaacaaccggtggaggatttcccgggagatatcctgccggcttctacttttttcttcaataaacggtcggtaaccgatatgcaggctatgcttgatttcactgccaggcaggagtatacgacatcgacttattccgactatatcagagatcgggatggggagttgctcgcatatcttaaagagaatgcagggggggagattgtgacttgtctgtttcattcgacagatactctttcaaatccttgtgcggtgatgagtattccattgagggatgggcagcaggctgagcgtgtgttgcagggaatgcttcgcactgctccgaaggaggtagacggtcctccgaaaccacgtactactttctgtaaaactcctttaagggcttatacgctctatgtactgcctcgtaatacgttgtttacgcaattgaccgggataacagagtcggctttatacatttacgcttgcttctacgagggaagactggttctggccccggatgtggaaagccttaccgcatatctccgtcatctggataaaaaagaaattctggatgatactcccggatatgaagaggcggtggtcaatctttctccgtcgtacaactttatgatggttgctgatttgggagagactttctcacaaccggagaattatgtgaggctgatacctgcatttttctttcgtaatcaggagtttttccgccactttattctttctgcacaatttacttgtacggacggaattgtatatcccaatgtggtattgatttacaaaggtgagtctgatgacatttcctga

SEQ ID NO: 1595 - DNA, 204 bp, B.fragilis
atctttcattttaaggttgagattggtgacttggacgagatagtctttaaagaaattttcggattggatcttgaatcacaagttgtagaatacgggcataaaaaatgttcctccgaccacgcctggccggaggaacacacacaaacaaaacaaataaaagcagtcacgattcgcatcgggacgcccctacacccggtattataa

SEQ ID NO: 1596 - DNA, 1473 bp, B.fragilis
  unsure (145): Identity of nucleotide sequences at the above locations are unknown.
aaaaaacattatcgtctggttatcagtatgtttctgtcaggagggcggacgctgtcatggcgagtcaggggccaaaagtccaagggccactctatgctctcagaggagggggagagtgaagaggatatggaggatgtgttgttcngaaaccctgaacaatttcgtcgggtggctccttactttcccgaagaggtgtttgagcatttgcctgatctgcttgcgcagggggtgaaggcggccggcaattatcgggaacgcgatatgttgctgatggcgatgatcaccaatatcagcgcctgtctgcccgaggtgcgtgtattgtacgatcaggtgtattactcgccgcatctgtattacatggtgatagcccatgcgggaggcggaaagggggtggtgtctctggccggcttgttgcccggagagattcaccgctattatgagaagcagaacgaggagatgcgcctggtgtatgataaggccttttttgagtgggagctggagttgaaaaaggcgcaggcggaaaagcgttcgccggatttttcgctacgtcccaaagagcctgtccgtaagctgttgacgctttctcccaatgtgtcgaagagtatgctgatcagtgcattggaggagagcggcaagctggggtgctgcatcaatgctacggagctggacatggtgtcgggagctatccggaatgattacggaaagcacgatgatgtgtttcgggcggcttttcaacacgaagtggtttcggccgatttcaaggtgaacggccgtcaggtggtggcccataatccgcatttggcgttgtgccttgccggcactcccaaccagctggtgcgtttcattccttcgttggagaacggtttgtacagccgtttcctggtgtatacgggccagagcgattggtgttggcgttcggctgccccgcgggagggaggtgaagatcatcgggcgatgtttgcccgcctgagcggccggttgttggagttgcaccagttcttgcttcagtctcccacggaggttacgtttacggctgcacaatgggaggaacatacgtctcgtttctcctcacacttgtccgaggtggtgaacgagcgggatgattcgccgggagcgatcgtgcttcgtcacgggctgatggcgagccggatagcaggggtgctcactgcccttcgcaagggagagtgcgcctgggcgatgccgcagtatgtatgttcggacgaggatttccataccgctatgttgatgacggatgtgttgttggagcatagcttgctgctgtccaccagtgtgcggaagagcgagagtaagtccgggcccctgaagccttatttcaggttgcgtccggtgttacagactttttcaggaacttttactttatatgatgcgatggatcgtgctgtagagatggggatctcggtacctacttttaactgcttattcatgaggactatagagcttaaaaataattga

SEQ ID NO: 1597 - DNA, 1380 bp, B.fragilis
aacatgaattatcaggagactttagactacctatacaacagcgttcccatgtttcagcaggtaggaagcagcgcgtacaaagagggactggaaaacacctatgcattagatgaatatttgggacatccccacacagcatttcaaagcattcacattgcagggaccaacggaaaaggttcctgctcacatacattggctgccattctgcaatcggccggatatagagtcgggctctacacttcgccccatttagtagattttcgagagcgtatccgcatcaatggcgagcccatcccgcaagaatacgtcatccgctttgtggaagaccatcgtctgttctttgaacctctgcatccttctttctttgaattgaccaccgcaatggcattccgatactttgccgatcaacatatagacgtggctgtcattgaagtcggattgggagggcgactggactgtaccaacatcatccgtccggacttaagcatcatcaccaacatcagtttcgatcacatgcagtttttaggtaatacgctggcccaaatagcaacggagaaagcgggtatcatcaaaaggggcataccggtcgttgtcggtgagacgacagaagagaccaagcctgtattttatcggaaagcacaagagatggaggcacctgtcacctttgcagaagaagaacaacgcctaaaaggagcaactaaattcaaaactcgcgcggatcgaaaaccgggacagtatacagatcatcagccgaataccgcagcagaaaaagatacagagtatattaccggctggatctatgaaaatgatgtatatcccgggttggaaggagtattgggaggctcgtaccaactaaaaaatacaaatacgctactgtcggctctccctgttctgaaaagcctgggctataagatagaagatcatgacgtgagaaacggattcctgcaagtagataaaatgaccggtttgcaaggacgctggcagaaattgagtgactctcccactgtcatttgcgatacgggacacaatgtagcagggatttcttatatcgtggagcaactgaaacaaatgaaatacaattgcctgcacatggtcatcggcatggtgaacgacaaagacgtaagtggaatattgtccatacttcctgaaaacgcagtgtactatttcacaaaagcgagcgtcaaaagagcattaccggaggctcagttacaacagatcggagcttctgccggactgcaaggaaaggcttatcccgatgttcagtctgccgtaaaggccgcacaagaaaaaagcctcccggaagacctgatcttcgtaggaggcagtagctttattgtagccgacttattatcgtgccgcgatgcactcgatctcgactaa

SEQ ID NO: 1598 - DNA, 267 bp, B.fragilis
aatacttctctgagaaataagatgataatagcgagtggtgaacaagcttcacagtttgttcaccactcttttttaatccacagttctcttttaattcaaattttattgagatggttcaaaggttataattgtcctacgaaaatttctggtaagccgctgctaattttttatcatattgattctgctcataagcaggaccattataacgtttggcaaactctgcccagtctttggcttgcaaagcggaaagcattccggattgtttga

SEQ ID NO: 1599 - DNA, 1065 bp, B.fragilis
acaaagtatcaaaacgctataaataatatgtccttagtcaataacttcacagttaaaaaagttcgttcttccaatctggagtcgttacgtttgctttcaatgtttttcgttttggtagtacatgccgattttcaggctcttggtatgcctgacaggacagaaatgacaattcttcctttattttctgtatttcgaattattatagaagcatttgctatcgtctgtgtcaactctttcgtcttattatcaggctggtttggcataaacttccacattaaaagtctatgcaatctgctttttcagtgtgcattctttttaattggtatctatacttttacaatattgattggcattgaaccattatcgataagtggtattaaaagatgtttgatgctcactaataatgtttggtttgtgaagtgttatttaggtatgtttattatggctcccatcctcaatgccttcgttgaaaaaactgacaaaagaacatttagtacagtgctgctctctttttttatcttccagacaatatatggctggttttccaatggggccccctattttgaaaaaggatattctgccttctcttttatggggctgtatcttttagcgcgctacgttcgtatctatcaaccatcttatacacagtggtcaaaaagcaagaatctccttatgtacataagtttgtctacttttacagccctaatgctaatcattacatgctactttgacaaagttggatatttttgtatgttttggacttatacgagcccattagtgatagcaggtgcactttatctgctccttttctttaataggttcgcttttcaaaacaaaggaatcaattggattgcggcgtcctgttttgctgtttatctattccatttcttcatatgggaatactttatgaaaccacacatccaacaactagcagttacctacaatggtatatcatgcctgttggtaatcacgggtctattattaacattctttacagcagctattttaatagataagatacgtctctatatatggaaccattttgtatctaaatatatcagttaa

SEQ ID NO: 1600 - DNA, 1266 bp, B.fragilis
atgtgtcttaatccattaagctgtatgaagaaacaattgacaataataatcggcctgctcctctcctcctctatcactgtccatgcacaggtcgcccaaaagctcagggagctgggtatggaaaatatccggaccattgaaacgggaggaacgactgttgccgcctttgaggacaatgtatacagaggaacctaccgcggagtgggaaaagcaatcatcgcaggaatggaagggatgggcaacggcaacctggaactggtggcactggacggaaacggtattccacaactcagcatcagcctgccggatacgttgatagcgggctataaatccggtgggatttcattgaaagaggtgtacgaacggatggagatgagttatgataccgaccgccctatgggactattgaaaggaagcgcaggggtgatcaaccgctcggcatggaaagcggacatcgtcctgtatccggaagtgtcactggaaaactccactttcgataaactgtattcatacagagtcaatctgtcgccggctgtagaaatggacttgtggaaaggagcgaaagcaacggcacaagtggtcttccccatcgcaaccaacatgaagggcgaatacaaaaagatacgtccaggggtaatgacgatttcacaggaaataaggttccggaataattttctggcccgcatcgtggcaggcaacttcaccgatcatcggatcggagcacaggctgaagtgaaatatcgtaccggcaacggacgggtggagctgggagcgcagataggcacaaccggatactcggccatcacggacgatggatggtatatcggtacccgtcaacgaatcaatgcagccgtgaaaggttcgctctatgtaccgcaattcaatactcaactcgacctacaggccggaagatatttgtatggagactatgggctgagaggagactgcacacgccacttcggagagtatgccgtaggagtgtatgccatgtatgtggaaggagaagttaacggaggatttcattttgccatccccctgcccggaaagaaatggaaccggaatcatgctgtcaggatgaagccggctgagttttttgccgccgaatatagcatggtatcgtggggcgagtatgccgataggaaaatgggatatacctatcagacacgaccggcagaaaaccggagcaacggattctttcagccggaatatatacggcatttcctgataaaaagtatcgaaaaagagagaaacaaaaaacagttttaa

SEQ ID NO: 1601 - DNA, 753 bp, B.fragilis
cgtacttataactacccattccatctcagaaacatgttgaagctcaaaacagtttcactcctgaagcacaggagcgacttatctatattgcccgaaggtaaattattgataaacacgattaacgcccattcatataatacagcgctgaaagatgccgggtttgcagaagccttgctcaaaggcggagcactgattcctgacggggcaagcatggtattggcgtttagatggctccgaaaagagagcatagaacgtactgccggatgggatctctttgaatatgaaatggaacggctgaaccggaaaggaggtatttgctactttctgggaagcagcaaaaatacacttaaattgatcaaagaaaaagctaaaaccgtatatccgaatattcgaatagagacttactccccaccctacaaaccggaatttacagaagaagaaaatcaaatgatgatagatgccataaatgcggtaaagccggacttattatggataggtatgacggctcccaaacaagagaaatgggcgtatacgcatctggatgcactggaggtgaccggacatataggaactatcggagcggtattcgacttctttgcgggtacggttgaacgtgctccggtccggtggcaagagcacggactggaatggctatatcgcttgatcaaagagcctaggcgcatgtggcgccggtatatcatcgggaatgccctgttcctgtggaacatcaccaaagaaaaattctctatataa

SEQ ID NO: 1602 - DNA, 813 bp, B.fragilis
ataaaaaataattggaatatgaagactattaaattaggttatgaaggtgaagaagctctcttgctgtgtcgggagttgaaacgcaatggttattcagtaaaggaaagccggacttttacacaagaaatgaaagaggcagttattgattttcaacagaaaaacaagttggatgctgatggaatcgtgggatatcgcacttgggaagttctgttctttacagggcatcccattaccgaacgtttgactgaagaagattttattcttgtggcccggttgctcgatgtggaagtggctgctttaaaagcggtacagcaagtagaaacaggagggagaggaggattttttgctcccggtaagcccgctatccttttcgaaggtcatattttctggaatcaattgaaaaagcggaatatcaatcctgaatcgcatgtgaaggggaatgaaaacattctctatcccaaatgggagaagggacattataaaggcggtatgggtgaatacgatcgtttggaacaagcccgtaagatcaatcatgaagcagcggatgcttctgccagctgggggatgttccagattatgggtttcaactatgcagcctgtggagagaagagtgtcgacagctttgtaaaagctatgtgtatgagtgaatgtcgacaattggtgctgtccgcccgctttatcaaacaatccggaatgctttccgctttgcaagccaaagactgggcagagtttgccaaacgttataatggtcctgcttatgagcagaatcaatatgataaaaaattagcagcggcttaccagaaattttcgtag

SEQ ID NO: 1603 - DNA, 195 bp, B.fragilis
aggcgtatcctggtattggtagaggaacagaatcctctttcccctcgggggaggggaattgcagttacggatgctccgttctatgggaatggtacgagtgaacgtttatttaatatcggtctgtgtctgccttcgggacctacattgacagatgaggatatcaggagagtggtggatacgatcaggaagatgtag

SEQ ID NO: 1604 - DNA, 756 bp, B.fragilis
aatgcagacaattacatgattgataaaagcgaaatgattttcggcgttcgtgccgtgattgaagccattcaggctggtaaagagatagacaagattttggtgaaaaaagacattcagagtgacttgtcaaaagagctgtttactgctctgaaaggtacgctgattcctgttcagcgtgtcccggtggaacgtatcaaccgtatcacccgtaagaatcatcagggggtggttgcgttcatctcttcggtaacgtatcagaagacggaagatttggtgcctttccttttcgaagaaggtaagaatcctttctttgtcatgcttgatggaattacggatgtgcgtaattttggtgctatagcccgtacttgcgaatgtgccggagtagatgccgtcattattcctgcaaaaggaagcgttacggtcaatgcggatgcgatgaagacttcggccggtgcattgcacactttgccggtttgccgtgaacagaatctgaaaacaaccttgcaatatctcaaagatagcggcttccgtattgtggctgctaccgaaaaaggagattatgattatacgaaggcagattataccggcccgatgtgtatcattatgggggctgaggataccggtgtttcctatgataatcttgcactatgcgacgaatgggtcaagattccgatgctgggtagcattgaatcactcaatgtatctgtagccgcaggtatcctgatttatgaaggcgtgaaacaacgtacaaattaa

SEQ ID NO: 1605 - DNA, 831 bp, B.fragilis
aacttaaaaaatcatattatggctcagttaagttcagtaatcggctctatattgcgtgatatcgtttcggcacaacacgaagcaaatctttattcgttgtcgcttggcgactcttacggaaaagacggaaaggcgaaagattttcaattgcctaatgttatggtaagcgatatggaactggatttgaaatatggtgtgaaaagtgcatcggaaagtcagcaacagtttaatatcaagtatgataagttccgtcagttccttaaagaactgtgcgaacaagttgccagggtagccattagcagtgctgtcaccacagtgatgacttcggatatagagagaaatgaaggagagaaacacttctttgaacggcttaaaaaagaaaacaaacttcatcaggaattctgcacttttctgagccgtaatatgagaaactctttccgaaataatctctatgatgccgtagacagtagtaatggttctgtgaataacgatgttgtgattagcagactgacagatgtcgtacgtaaaaaatttctttacgatacagatcttgatgatctttttgccggagaagatggagaaaaacttcgtgataccgctgaaaagaatattataaaagcgatggaagctattgtaaaaaagctgtcggtagatgccaactttaaaagtcttcattcatttccacagctggatgtggccatcacggctgatgaactgatgaatatgcctgaagaagcgatacacagttttaagatcaagttcagccctcgcaattattcagtcagtcaaacggatgatgattcgttactggaagattttgtgatgcgataa

SEQ ID NO: 1606 - DNA, 537 bp, B.fragilis
aatcaaaaaaacggattgactacaatgaaattaagtaaattcttatcgagcagaacaggaaaacgtttctataacctctgttattgctggggagcctgtctggttattttgggagccgtattcaaaatcgctcacatgccttatgataatctgtttttaatgatcggattatttacggaggtattcatcttcttcatctccggatttgacgaaccggcaagagagtacaaatgggaaagggtgtttccgctattgaatgataaaaacgcaaacataaatccccatacaggagtatcggatacactgatgacagaaaagtacatacaacagctgaaaagactggaaaacaacgtgtgtaaactcaatgaaacgtacgaagcgcaaataaagggaatgacggaacacgctaagtcgttgaacgagatgaattcggaggaactgaaaaaggagacagaaaaaatggcagcatacatagaattactgaacaagcaatatagtcagatgctgaatgccatgaatgtaaaaaccgggaaataa

SEQ ID NO: 1607 - DNA, 192 bp, B.fragilis
ttatggaaaaaaaacgacaagtttaagagtccgaacgaattgcttaaagagttgtccggacaggtgtttgccctggtgcgtgagcttcccaaaccgctttcgagagaagagatgcgggagttgaaacggttgtgccgcttcctgaacaatacggtgaaggatcaggagcggaaacaggaggtgagaaaataa

SEQ ID NO: 1608 - DNA, 243 bp, B.fragilis
  unsure (145),(184): Identity of nucleotide sequences at the above locations are unknown.
aaaacacgaaaaagacttagacgtttccctcgaaacatccaagtcttttcctctaaactcttaagtcttttcggaaaaggcttaagagtttgtcatacaatcattggttggtccggtgttttcgaagggcaaaagtccaaagggnaactctatgagtcagtttccggcaagccccgcggagttntgatatacatatctccatctttatcaattatttttaagctctatagtcctcatgaataa

SEQ ID NO: 1609 - DNA, 606 bp, B.fragilis
agagtaggaaaaaataataagaaatatattatggatgagaaattattaccttactttgagaatgttaatgatggaggagaacagggcaaatacttaaaagaatttggaaatgaagaaacgcaaggaggtatttgtctacacttatcaattacttggttatatctatggcataacagcacaaataaagctccgaatacgatatggcaggaaatgaaaactcccactttaattcaacaaatagcaagcaaccaaagaagttaccaacaatattatccgaatattgcagataatgtatctttagctactcgtaactcccttcatgtaacagggactaacgcaggagaaatttatcagataacgaccaatgcactagtcaagagtaacatgcttttgtatgtcatcaatttagaaaaagaccataagccagtcggaagacatgccattgcagcaattgcaacaagaggacgtttctatttgtacgatcctaatgttggtgtaatgtcagtgcctatgcccaatatgaaagaactaatagaaaaaatcccttatatatatggtaagcattctctcaatattagtcagacttctgtttataacatatcctaa

SEQ ID NO: 1610 - DNA, 345 bp, B.fragilis
aagagtatgaatcctatattgaataaaatgggcgcaaatgccaatgaacagaaaaaactcttgatggagtgtgtgtcaatgcttgaaaagtatgtgaacagatttccggcagaaaagggatgtgcttcattctccggagaagatatgaagctgtggaaggaagtttattttccgaaacttgttcagacggatattttgttggacggtaaatttttctgtggcacgtcgtccggtaatagtggtattggtacagacggttattttaccggttatgaatttttccagtttatttatcgtgcctacaaggcactttatgaactggaaaaggcttcacaaatgagatga

SEQ ID NO: 1611 - DNA, 972 bp, B.fragilis
tactcaatgaaaaagagagagtttaaaatttcctttttcctccatgtgtgggaaaggaaagcggaagagatttcgctggaagagtttcataatgacctcaggggagcacgctggaaggtgcttgccgagtcgtaccggcggtggatgcggacgggcatgacagaggagggcaaaaggctgaaaggggctctgaatgcggtggtcgtggccggcaagtgccggggcggacatgcggcgaaccaggtgaccgagctgaacggactggcgctgttcgactttgatcattgcctcgagatgctggccgggatgaaggagaaggccggggcgctgccttatgtggtgggggcttttgtcagtatctcgggtgaagggctgaagctgattgtgcgtatcgatgccgagaatgccgggcagtatgcggtggcttatcctgtcgttgcccgtgagttggagcgggtgctggggcatccttgcgatatgtcgtgccgcgatctgggacgggcgtgctacgcttcgtatgatccggaggcgtactataatcccggtgccggggtgtttccgtggcgggagcaggtggacgggctgttgcaggcggaaggggagtgttccgcgcagtcggtgggcaaggcttgtccggcgggcgttgcttccgaagcgggggatggctttatgcaggttttcctgaatgattttgatgcccggaatccgtttgtggcgggagggcgccatgcgtttgtgctgaagctgggacgtgttgcccggtataaaggtttttcgccggaagaaatgcggctgttgcaaaaagcagtggttgagaaatacgcgcaggctgatttcgggagcggagaaatagaaaaaacattatcgtctggttatcagtatgtttctgtcaggagggcggacgctgtcatggcgagtcaggggccaaaagtccaagggccactctatgctctcagaggagggggagagtga

SEQ ID NO: 1612 - DNA, 246 bp, B.fragilis
attaagatgaagcggataacggacaggacaaatttttccgtcataaatacggtggtgaactatagcgaagctccctatgctgtctgtccccaatgtaatatccggacggcctgcagaagatttccatcttccatacattccgtccggcatctgtacccggacaggtcgacaacccaaaagcacaaatatgataaagacaaaatacaaaaaaaagctgtaatgattcctatttttacccatatataa

SEQ ID NO: 1613 - DNA, 1350 bp, B.fragilis
aaagtatcgaaaaagagagaaacaaaaaacagttttaatattttcttaatgacaaaaatgattatgaaaaagagtgacttatttaaaataggtgtgttgctgatggcaacgaccttgggaacaaccggatgctctttcggagaagacgagaagaaaccggaaattgtagtggatcctgccgaaaaaacaatagaatactacattgcaggtaaagtgacggaaggaacgaccgcgctgtccggtgtagaagtgaaagccggtgaagtaacggctacgacggatgcggaaggggcttataaactgacagtggacagcaagaaggtgtacaccgtgacattcagcaaagaagggtatatgagcatagacaatgcaacggcaaccatcgcagacaatgcggcaaaccgcagtatggtgagtctgagtgtgaaattaagcaagaaagctccggaaaaagaagtgaaggccgatgcggaagaagaagtggtggtaaccgataaaggagacagcaatatttctcaggcagaagcagctgtaattattcctcccaaagccatagaaacaactacaaccgtaagcgtgactccatatgaagaaccggctgccgtgacaacaaccgtaacaccgggaaataatgtggagactccggtagcgatcgcaaacatcgaagtggaaacagcccaagaggtcactctggccaaaccggtaacactggcaatcataaacaaagcttcggaacatacaacgttcgaaaatgtggaagtgtacaatcagaaaacaaccacaagggccggagaaaactggaacaaagtggcagatgccatttatgactcggaaacgaacagctataaattcacattgcccgcaggcgcatcactgtccggaaaatattcgatgcgtgtcaagagtagcaagaccacaggaaaagaacggataggcgagacaaacaaggaagagaaaaaaagcaatgaaggcaatatgactgccattccggaatacaaaatcaactttgaggctacggccggatgggaatatactgtcagtccggaaaaggcgctgatgaatgcaggcgtagacgctgcggatgcccaaggcatgggcacgacgatcaacagtgccattgaagcgcaggaaggaacgacgggaacttataaagtggctcacgaactgatagcgggtatcagcggtaaccatatcctttattacctgaatcaggctaaatattgcgaaaagacatatacattcaaaatcagtggcggaagaacagtgaccatcaccctgaaattctatacaggaatgcagattacttacaccaacgtggaagcaagccagcactcgggaggtaagatttaa

SEQ ID NO: 1614 - DNA, 1212 bp, B.fragilis
  unsure (250): Identity of nucleotide sequences at the above locations are unknown.
gttaaccggaaaataattatgctgaacggaaagaaaattatactcggtattaccggtagcatagctgcctataaagcttgttacatcatacgtggcctgatcaaacagggagctgaggtacaagtcgtaattactcccgccggaaaagaatttatcactccgataactctctctgcgttgaccggcaaacctgtcatcagtgaattctttgctcaacgtgacggtacgtggaatagccatgtagacctgngattgtgggcggatgctatgttgatagcccctgccacggcttctaccatcggaaaaatggcgaacggcatagccgataatatgttgattacgacttatctttctgctaaagcgccggtttttgttgctccggctatggacctggatatgtttgcccaccccagtactcaaaagaacctggatacgcttcgttcgtatggcaatcatatcattgagccggcttcgggtgaattggccagtcatctggtaggaaaaggccgtatggaagaaccggagaatataatccgggtacttgatgaattcttttcatcaacgggcgaactggcggggaaaaaagtgctgatcacggccggaccgacttatgaaaagattgatccggtgcgcttcatcggcaattattcttccggtaaaatggggtttgccttggctgaggagtgtgcccgtcgcggagccgatgtggtactgattgcagggccggtacaacagaaaacatatcattcacatattacccgcattgatgtggagtccgctcaggacatgtatgaagcagccatggcgcaataccccttggtcgatgccggaatactgtgtgcagcggtagcggattttactccggacgctgttgctgacaagaagataaaacgggaaggagacgagttgttgctgcatcttaaacccactcacgatattgctgctgcattgggcaagataaaaactccgggacagaagttaatcggttttgctcttgaaacgaatgacgagcagcgcaatgccgaaggaaagctgatccggaagaactttgatttcattgtgctgaattcgttgaatgatgctggtgcgggattccgttacgataccaataagataagcattcttagttgcaggggcagaaccgattatccgttaaaatcgaagacggaagtagccagagatattattgatagaatgataaaagaaatgtga

SEQ ID NO: 1615 - DNA, 1368 bp, B.fragilis
tcagatgctgaatgccatgaatgtaaaaaccgggaaataagacgaagagacatggctaaatatacattgccgccaaggcaaaagatgattaacctgctgtacgtggtattgattgctatgctggccatcaatatatcgtcggatgtcttagaggggtatggacaaatgaacaacgactaccttccacaaataaaaaagctggaagaatataaccggactttactggaaagaattaacagccgaaatgataaagcggctttatctgcacagaacatagatgcggcggcaggaaaactaatggatacactggaggaactgaaagaagatatcgcccggaaagcggacaaagagaaatatgaagccggcaagctaaaggcaaaagatgacttgaacgctgtgccggaggtatttctgtcggtcaccggggggaaagggaaagcactcaggctctcactggatacattcaaagaagacgctttatcgctgatcaagaatgatgcacacagacaactggtaggcacttacctcaatacggaaagtccgggtaccggaatatcctgggaaaaggaaaccttctcttatcttcctgccatcggtggagtgacatttatcaataaaatgcaggaagaggtgttgctgtgcgtgaatgaagtatatcggtcactgctgtacgaagaggcagaagatggaaaaggcggagcttttgtattcatcaatgaagaccagatgatagtaaataaagatggaacggtggacctgcctgtagtacagatcacacccgccttaacaagtatcttgtataccgactatgaaaacccgctaaatatactgactgcgggaataccgttcaacgaggtgacattccggatgacgaacggaaagatactcaaaagaggaaaccattgcatagccgttcccgacgaaaaagcacagacagcgacagttaccgccacacagataaaaaacggggtggcaaggcaactggccgaataccggtataccgtaaaggcactgcccgatccgacaccttatatactctgcacggatgaaaacgggagaacggtacaataccggggaaatgtgcccattaacaaacggctggtatccaacatgacacagctgggagcttcaatcagcgatggtccgaaagccaactacgagatcagcagctttgaaatggtattgatcaaaggaagcagtaaagcggtaacttcaatacccaacaccgggaacaaattctcggccaggcaaatggaactgatcagacaattggagaaaggagataaattctatatcacttcgattgttgtgaccggtccgggaaacaaaaagaaacagattgcatcaatcaatgtcgtattaatataa

SEQ ID NO: 1616 - DNA, 1257 bp, B.fragilis
tgtattaatgaagataggatgatgaacggaatatttgaaaaattatatgatatgactgccttcagcaatattgttgccgaaccgcagtttctggtgatgtatgtcattgccttcgttctcttgtatctgggtataaagaaacaatacgagcctcttttattggtgccgattgcctttggagtgctgttggctaacttccccggcggaggaatgggagtgatacaggctgacgagaatggcatgatcctggtgaacggagtaatgaagaatatctgggagatgcctctccatgatattgctcatgaattgggactgatgaactttgtgtattatatgcttataaagacagggttccttcccccgatcatttttatgggagtgggggccttgacggacttcggaccgatgcttcgcaatctgcgtctgtctatattcggggctgccgctcaattgggtatctttactgtgttgttggtagctatcctgatgggatttacacccagtgaagcagcttctttgggaattatcggtggtgcggacggacctacggccatctttaccaccatcaagttggctccgcatctgttgggcccgatcgcgattgccgcctattcttatatggcattggttccggttatcattccactggtcgttcgtcttttgtgtaccaagaaggaactgagtatcaatatgaaagagcaggagaagaaatatccatcgaaaacggaaattaaaaacctccgtgtattgaaaattattttcccgattgtggtgactacggtcgtggctctgtttgtaccgagtgcagtgcctttgatcggtatgctgatgttcggtaacctggtgaaagagatcggtgccaatactttccgtctgtttgatgcggcttcgaatagtatcatgaatgcggcaaccattttcctgggtttgtcggtaggagccacgatgacaagtgaagctttcctgaactggacgactatcggtattgtggtaggaggattcctggcttttgctttgtcaatagcaggaggtatcttctttgtgaaactggtgaatctgtttacgaagaaaaagattaatccgctgattggtgctacgggacttagtgcggttcctatggccagccgtgtagccaatgacattgctttgaaatatgatcctaaaaatcatgtattgcaatattgcatggccagcaatatctcgggagtgatcgggtctgccgtagcggcaggggtgctgatctcttttctgtcttaa

(The sequence listing continues in the following parts.)

What is claimed is:

1. An isolated nucleic acid encoding a *Bacteroides fragilis* polypeptide of SEQ ID NO: 9306.

2. A recombinant expression vector comprising the nucleic acid of claim 1 operably linked to a transcription regulatory element.

3. A cell comprising a recombinant expression vector of claim 2.

4. A method for producing a *Bacterioides fragilis* polypeptide comprising culturing a cell of claim 3 under conditions that permit expression of the polypeptide.

5. An isolated nucleic acid selected from the group consisting of:
  (a) SEQ ID NO: 4084;
  (b) a complement of SEQ ID NO: 4084; and
  (c) an RNA of (a) or (b), wherein U is substituted for T.

6. A recombinant expression vector comprising the nucleic acid of claim 5 operably linked to a transcription regulatory element.

7. A cell comprising a recombinant expression vector of claim 6.

8. A method of producing a *Bacterioides fragilis* polypeptide comprising culturing a cell of claim 7 under conditions that permit expression of the polypeptide.

9. A probe comprising a nucleotide sequence consisting of at least thirty contiguous nucleotides of a nucleotide sequence selected from the group consisting of:
  (a) SEQ ID NO: 4084;
  (b) a complement of SEQ ID NO: 4084; and
  (c) an RNA of (a) or (b), wherein U is substituted for T.

10. An isolated nucleic acid encoding a *Bacterioides fragilis* polypeptide of at least 20 consecutive amino acids of SEQ ID NO: 9306.

* * * * *

UNITED STATES PATENT AND TRADEMARK OFFICE
CERTIFICATE OF CORRECTION

PATENT NO.       : 7,090,973 B1                                      Page 1 of 1
APPLICATION NO. : 09/540209
DATED            : August 15, 2006
INVENTOR(S)      : Gary L. Breton It is certified that error appears in the above-identified patent and that said Letters Patent is hereby corrected as shown below:

Col. 1765 Claim 1, line 1, change "*Baceterioides*" to --*Bacteroides*--;

Col. 1765 Claim 4, line 1, change "*Baceterioides*" to --*Bacteroides*--;

Col. 1766 Claim 8, line 1, change "*Baceterioides*" to --*Bacteroides*--;

Col. 1766 Claim 10, line 1, change "*Baceterioides*" to --*Bacteroides*--.

Signed and Sealed this

Ninth Day of January, 2007

JON W. DUDAS
*Director of the United States Patent and Trademark Office*